United States Patent 7,868,149 (PLANT GENOME SEQUENCE AND USES THEREOF) - sequence listing, part 61

SEQ ID NO: 32856 - DNA, 24112 bp, Oryza sativa
  unsure (1)..(24112): unsure at all n locations
acgttttcggccgatcgatctctctcggcctctctccttcgccgccacgagacgctcaatttcatcatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcatttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccacttgttcttcaagaccccaaatgacctctcaatgacattccgacacgaagaatggcagtaattaaagtgctccctttttccccttggcaatgtgctttcgttgtactcttggaaatgatatgttatacccttgtatggtgctagataacccggcctatttgggtatcccgagtctacgagataaaactttcctggaggtggctttggaaacttggcactaaatctagtatgtgcatcattgaataccctcatgtcatgaaccgaaccaggccacccagcaagcacgaaagtaaatctcatatcgaagtcacagacacacataacattctgactcttctccttatgtctattcctatgttgaacagcagctgaatttggcaccacaacttggatgtgagtaccatctattgctccaatgcaattatccaaatatggtgtgtactgaggagaaagcaatttcttatggaatgttgtgaataagggatcttttggcctaatgatatcttgtgcaagtttcagtagagcggtcaaaactgctttgaacttactatgtactgttttaagagacctaacaaatctgtcttgggcttgcctaactgattggggagcacctactatccataaaaaaagacccaaacactccatggaatccatgttgtttgtggacttcaactcatatgattccacaagcacagaatgtaacctctcaaaaactggcctgtgcatcctaaacatgttgtaacaagcagttctattagctaatgttctcataacccaatcatgtccagactcaggtgctacccttcttggagccttattagagtaaagttccaagtaatacgtaccaatcatggcggcaagcatacatgctcttctcctgtccatttctcttttcttcaaaatataaatgataagatcaatctcatcatcactgctatcttcatcagagatatcttcatcaccactgccttcaccatcctgcaggtgtgacatatgcatagaaagaaagcacatcataaatataatatgaacaaacttcaagaagaaaagaagggaaggtttaaataggtccacacatcacatgttcattacgtcacatcacatcaaacaagttgatagttcaacacaaaagtagatcataactaatgcagctaagacacaactaatgcagaccagacccatgatatgcagctaaagaaagggatcatctaatacaaattcttctgctggcaccatctcctcagccacataaatcttgcttctttagtgctaatgttcttaaacataactctgttatgtttggaagcaaacaactgtgtggcacaaaagtattccacactgtcttctgctgcaccacactctactgccaacctctgacagtttgtcaatgactcagcaattgattctttcttctgctcctttaacttcttgctgttaacaagttcagtaattagggtatttgacttatcacaatcagagttgaaagaattgagcagccccttcatgagctgcaccactgggctcttgctttttttcccaggactagaagctgtggacacatcacagctgctactccctctcttcctgctgttattgctcatggggctgttctcataaccatcccctacagctctttcccctctagctgcctcccctgcatcccctgcttcttcttctccttcctcttcatcttcatcttcaaaaccagggatgtatgctgtggaaccatcaactgcaactccttgaaatatctctataagaaaatctaagtactcagggttgccatggcgaaatttcttggcgtcccccttctcctgtattgacactaaatcaatatcacagaaaactctaaaatcatgtaaactagctatatttttgacaactgcataccttaattttttttcccaccaagcatttgatgcaattatttctccactagcacttctaccagctccagtttgttggttcagccacacccaagcactgtaataattctttagatgggtgaatctattctttatctgtttggttgaatgccttaggttagccctttggaaatatttggccttcaaattctggtaccctctagttgtccatgctccattaggacaatgcccatccattatttcctcacatgctatttcacacaatgtgtaagttttttcttctgtccaatttgccttgtcatacgtattctaggaaagacaaacatgatttaaccctaaattaaacaatgaacaacatatactgtaatacaaatgcttagatcacggcatccatagcagtatcaatatcatgagcaacaattggcatatttcgcaatagcacaaaagagacataacagaaagtaaccatggggggtttaccatgtgctgaccatcaggaccaaagtcctcttcgtcttcttcgttgccgtcgtcctcggacacatttgtcccttgggacgacgaggcaccggctcgccgtcctcctccgaagactccaaagttgaaggcgggtggcccgctgtgcgacatggatgccccatgacctcggacgcctccttgaccagacgatgagccaggaggaacaaatcctcgcattcccctgccagatccagcgccattggtcaacgacctgccacggcctcgtcctcctcctctccctccacgactgctgccacgtccccctcccgccgctggaggaggacgtgacggggggactgtggatctgctccctgcccgaatcggaggtaacacaaggctacccggttcaaggatctgttggtaggaggcgaaatcggggaaggcgtcggcctgggagttcagatcgaggccccccgatccccctcccccaaaatggatgccggtgccatatccaccatatcctgaagacccctgcgagaagccgtagtcggagccgtccatgtggcccgttggagcttcatttaacgactgggagaagaaatcgtgaggatttccacccgccattgctgatgcgcgattcgtgaggcttgcgcgagcggcgtcggcttgcacgacaccggcgaaccaagcggcgggcagaggactagctagcgcgtagctgcggtgggggctaacgcaggacggcggcgagggcgcggggttgtgagtagcgagagagagacgacgcgaggaaatggatagggatggctggcgtgaaggggcagtggctggaatagagccacattttcccaatagagccactttagtcccggttcttaaccctaaccgggtttaaaaagaatttcgaaatagcgggaaaagatctttactcccggttgttctcaacaaccgggactaaagatatctttagtccaggttgttctcaacaaccgggagtaaagatccgggggtatatatattcccggtgcgccctcgtcttcttcaccaacacttagacggtttaggccgatcgatctctctcggcctctctccttcgccgccactgcctagggcaaatccccgcgccgacgccgccgtcgccgtcgtctcgagctacgtcctcgccgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgacgatgacgcgccacgccgccgccttcgccgccgccgcatgccaacgccacgccgccgccgccgccgatgccttcgccgtcgcgcgcgcaatgccgtcggcgccacgccacgccgccgccgtcacgccacgccgtcgccgccacggccccgcaacgccacgccgccgccgccgccgcgacgccgccgcgccaaccgccgccccgatgccgccacaccgccgttaacgaacgagagcgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacggacgtgaatgagaacaaacgaacgaacgtgaatataatgagaacgagcgaacgaacatgaacgagctagggaacgtgaacgaacgttaacgtgaaatgcaatatatatatatatatatatgttacttcgcatttatcctaatacatctttttgtatcttgcagaaaagacgtgttgtcggagtcgtccgtcaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaagggaaccagcaggggcacgtggaaagggatgtggaggggaaccaggaggaggaggctagtgatagtcaaccctccgttggacagaagagggcacgcgggcaacgaggtgcagcgaagaagcttgagggtcggcacatcataacggaagtgcaagaagatggacgtcctagtgccccggccgaagcagccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccaaagtgggaggagatggaggctagcttgattgagaggggtatcgaaacggcaacagccaattggccggaacgatcgaagttctggtactatgctcacggtggaacgctcaacccagctgatggctcactggtcttcggcgatcagatacgagaggctgcacgacgactaacagatgcagtggaagcctcctctcagggcacgttccgaccagacagagatagggacgagctgacactcgccctacagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtaagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttccagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaggcgcgtacgaggacctcgagctggattaccctggaggagacggtgagacgcatctacgagacacaagccatgccattattctatggcgcaggcggtacatcatcctccctggtcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccattgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgtactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgtggcaaatggagagaaagacttaggcggaagttcaaatttcctgttagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatataaaccatgcagcaacagggccatgaaaaaaaaaaaggtcagctcgatctttactcccggttatttcaaccgggactaaagatagcgatctttagtcccagattggtactcccggtttggaaaccgggactaaaggggggttacgaaccgggactacaaagggtttctccaccagtgcttatagcttcatagtggtagtgctagggatttaaaatttaaaatatgtagttttgtgacaacctcaatattaaatatgtagttttataatgtttggccttaaatatgtaattttaggatgaatttatcgctaatatatagttttgtgataaatttaccattaaatctgtagttttatactggtaattttataaaatttactcttaaaaaacagtgggatccacgtgatactgtgaccggcggcgagagacggctgccgctgcccagatagcccatcttcaatcataccattgcactagaaattcaaacaaagattgaaaactctgtcggcttctttttttttttgaaaaaaaagaagaaaatatgtcatttgtctttctgacacaggattgtataatgtatagagaaacatagttgccgtcacttgtgtatcgataatccctggtggaccatgaatacgaacaggacgacgcgtacagggtacagcaataatcatcgatcatcaacccaacaagacaacatggttgctgtatcttgagacaccaatctgaataatagacaggacatcgcgccagctcttcggaagttgcctttatttaatttgcactaatccatcgctacaatgatacaatctcatgttactgttcatcctacacagataaggatgtactcatgtaggttgagaactatattgagatagtgcttgctcacttttgtcaatatgatgcatacaatttgcaagaagtacgtgagcactcactttattatgctacagaaccaattttgcaatgtacttacacaacagtaccaagacaatgccctgtgaatatgcagttttttttaagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcgtcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccgccgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatcaagtctgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctccgggccngngcaagcacaaccccaccccccctcaggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttgtttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccgaggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacctcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgtcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatagatcccgaccgcgtctccattctaaccattatgttgggggtcggggcctcagaggagagagcccctaagggccacgacggcgcgggcgagcgacgccggagggaacaacctgccccaggagggggtcgtgcttctgggccccgcgtcgggggctcggggagcagccgccctgccgacgcccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgcaagacgggggagacggaaccgtgccggggaaacctgatttcccctccaaggtggtcattcaaccgaccccctcgcaggttcgtctcactctcattgcaaccatctttctccaaaaagaagttttttttcttgctcactttgttcgtcttctggctttttttttctgtttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgtcagccgctgctggcgcgtcacttgggcccactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgcgcagaacgagcggagctcgaggccgcatgggcgcgtgttgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggtgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgccagcggtgaggatgacggtggcgacgaggccggctacccgggcgcatcggaatgagcccccgagcccccgccaatctttactttttttctttttctttcttctaaggccttcatgcctcttttttgtataaattaactcaatctgcaatcagaaacgaaatgatgaaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggtggggttgagcacgagtgacattatttcaagtcaagattcctcaaaaggaaaaaacggctcagacacaacctttagaaaattgaaactgcttctattgaaatgctgaaataaaggaaaaaggaatatatgtgcatgtgtggtagcccccggctaacccggcacacccgaggggggtgcggggttagcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgttttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcgtccatctgcgggtcggagcaccggtactccttacagacttggttaacaaccagctgagagtcgcctaacaccaggaggcggcggatccccagcccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgccctgtaccctctcgattatgcaagatttgaccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtagacaggccgctgcacccttcggtggggccgatcctctttgctaggggccgtacccccggggcgttcttcgtccaagtggccccttggggcgcactcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcggctcagcacagggttagcctcggggtcaaagggcgttaagtgtggccttcccgcagtggcctcggggccttcctgagggtcggggacacccagcaccgtttgacaagcgggcagagggccgtctccggtcgtcaggggccttaggccaccgtttgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacatccctaagtttgctaggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagattctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggtattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcggcagcgaggtggtccgcgcgctgctccatgcaagcaagcgcgactttaaggtcgccacggacagagatggggccaccagggcccggcatcttcatctggaggtaggcatagtggaccgccgccatgaacttcaccaacgcgggcctcccgaggaccgcgttgtagggcagactgaggtccgccacatcgaagcttacccgctccgtgcggaagttggcgggtccaccaaaggtgaccggtaggtcgatgtgacctaatggccacgtgtgccccggcgtcacaccgatgatcggttgagacggctggagcaccatccccggggccttgatagcatcaaaggccgcgggggaaagaatgttgagagccgctcctccatctatgaggacacgtcccaacttcacgttgcagatggtgggggaaaccaccatcgcaacctgccctccccgggcaatgcacggtgggtggtcggtctggtcgaaagtgagagcgacctccgaccaccgcgctcgacgcatcgcctcatgagtaggggccatggtcagaagctctcgtttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttatggacggagcaccacctgccggcgggacgctccctgctgggagtaccagcctctttctttttgtcgctcgcaggcctcccctttcgggtggcccgcggagtgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagttccgcggtagtctggggctctttggaggcaatcttttcgagcatgcggttgtgccgcacaccccccctgaacgcgtaaatcaccgcgtgtgcagggatgcatggtatagtattgcggacttggcaaaaccgctgaatgtacgagcgaagcgactcattatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggcgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacagggggtacgccggctattacgccggcgctcgatgttgaggcgggcatccggctccccatgctgatcctcccgagtcgaaggcgtcgacgagggagtagcagccgaatgacgtgcagccgccgccgctcgccgcgccctccgccttgacgacatggagccggtggtagcggcgccggaggtcttggtggtggcggaccgtccaccagcacccaagcgctgctgagccgtcatgaccaagttggccacgtcttccagccatcgttgggctggagactccgggtcatggacgacaggcgggtgtcgtaggagcgcgccagcagcctgaagcgcgccctgaggcgtgctgccgtcgccgtagacgaggaggcgacgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttg

SEQ ID NO: 32857 - DNA, 990 bp, Oryza sativa
accccccctcaggggaaatcacgaggagggcggacacctcaccctcgggcccgacgtccccgaaggtgccaggccacgtgggcgattgcgtctgcctcaagcctctggtcatgatactcccggtcccatatcaccgacaaagtcgatctcagccgtccgttcgcgtgaaccgccgccgtgcacccggtctaccgaaaccctagccgctgacgcaataatcctcttttccttttcaaaaataattcattattgcgccataattcaattaaaatcaatataagtattttaatccgatttaatcttgaaaattcataactaattcatcttagctcggatttagttggttcaagtctctaaatttttctaaaattgagatctacatgttaaaaatatccacatgtactgttcatgcttgtttatgtgctgtttggtgattttgcttctttctgtttagattccgtcgtttccggagagtccgttttcgcagcagaagagtttgaagagttccaaggccagcaaggcaagtcacacagatcccaaacaaccctttgagcatgttgatcatattttaagctattgtttctattcaactattgcatttattttcgaatgtcattgggtggaattaacctattctttgttatagcccttttgttctttattactttattccttgataccttgggttattataatttgactagttgagctttatttatattggttcaactagatattagatataattgcttagccctgcttagaaacattagcacattattgggataacttatgactcactattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccagccacaagccag

SEQ ID NO: 32858 - DNA, 1275 bp, Oryza sativa
acaaattgagcctccatttgctacatttatactcagtcagaatcagttctttcatcatcagagttattattgctcggctgaaggtcgttgttgcggaattgctctacaacatcacttgcaatcttgtcagccgcactttgagcattactgataagatcaagagcagcttcttcgcttgtcccgtctgcaaagccatcaatggcgtcaatttcaatcctcgggtacaaggatttggtcatcgccaatgccatactagctcccatacttccagctttcttgatattcttgaagtatacatccggtgctactctcagcttgtcaaagatttcggttgcgtcaaatgcactcggaccactgtcattaaggaacatagcttggacaagtggtgtagcgacattggcgacttcgtctattgctccttcaagcttcttgatcttaccaaccaggacatcaaactgagcttgagatttgattttacggtctacaaaacacatttataataagaatctgctgcattaaagagaggacagttcaaattgtcagctggcagtaccttcaacctccttcaaggctgagtccctttccgcagcaagttctaccttgtcttctttcaaggcttcaatctgtttctccatttgtgccatcctggtagcttgtgctgtttgaaatccaaatatttgaggatacagctatgatagcataaattaatgggacagatctagaagattaccttttgatgaaccactcagctcgaagtttgaatcctggagctgggcaattcggtcccttaactccttctctgtctttttggcgtactccttggcctcatgcagctggtccctaactgcttcaagagttcccaaatgaggaaccagcttttccaaagttgtagtcttggcctcattgcgaagatggattctctgcatgatggatcatggttcagttctgctaaagagagaacaaagttattaaaggcggtcacccggaagatttacatttacaatgcaagtggcttctccaagtgctttcttcagctggcacacttcctcatcttctttttgacgatttataacgatgccggcaacttgcgagttctcgtcccaccatttgagcaagataggaggacgggagtcactagctacctttatgcggagaatttcttcttcgtcgccgtctggtggacctgatgtattcccaagacattagacgaacaagctggaattattcagaactgcatcactcgagaagatgagttacctgaagatgtgcctggct

SEQ ID NO: 32859 - DNA, 30560 bp, Oryza sativa
gaagatttcagatacatacctgcggaggcggattgaatgcgttatatggcacaactggcagctggtgtgagtagctgacgacaatagcattcgagaatatcttgtacatcctctccttcatgatcttaaaatccagagaatctgggtcttcacggtttggatcgtgcttgccgtcaaattcaaaagctgtgcgggatctttctttgatgggagccaatcggcacttaatgaaatgccgagtgatttgctctccctgcaagccttgttctttgagttttagcatgcgttccatcaactccaaggcttgggccgcttcatctccaatcggaagagagttccaggtatcctggtacaccggaggaagacaggagtactcgggaagagcaggctcaggattctgaacataaaaccagttcgcatgccaccccttgtttgaggtcttgaagggcatagagaaatacttctggctcagagttccccttagctgaaatcctgcccctccgactacgcatggcttgctcttgttcggttggggcttgagaaagaagatccggcgaaacagagcgaagtggggtctgattcccaaaaaggcttcacaaacatggatgaaattggcgatatggactatggaatttgggtttaggtgatgcaagctgattccataaaagtttaaaatcccgcggaaaaatttcgaggtcggaagagcgaagccgccatagaagaaatgcgagaagactacgatctcatgtgtatcgggggtcggaaaagcctcaccgcacgctggccgccacccgatgatctccttggctgggagaacgccgtgcgccaccatctccttcaggttctcttccgttacgtcggacgccgcccattggccttcgaagctttccttctcttccgccatcgattttacccgaatgcgctgatttgattcgagggatggctggggagaagtgagggattgaggcggtggatcacgggaagggttttgatgcacttttcgaaggtggatttgagtggagtggtgaaccctagttcgccggcgcagttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttcagcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctgttagacttattcattaccataatttttataatacctggtgggtaatctttagagtttttattcggatgcctgtcaagtgtgttcattcgtgaaccttttagagtgttaaccactcggatttcttttgttgtggctaaaaagcagtcggctagaatgcctctttaggcgccgcatatgcttttgtcatatgatgcatggttgtgctattattttgttctcaactatatgtttagtttgttaactaatcacatagttgggggctacacctaattaggtgcatctattcgatgcaccatattctttaccttttcgccctttacagtcttcgtcttcgctactcggcgggccttggcatgaaaagtttgaagcactcggattatttttgagatggctacgatggatgactgcaaaggtctcgggggctactgtggagattatggatatcccatatctacacggcgacggtatttggactaggtacaggatacctaatgtagatagaatatcttatttgtatctcgggtttgtttcttaacttgtgtatcaaggaaacaccctgagacttagtcggttacgactatatttcatctgtatttgcatattccgttagggatatagattatcttttgtaaaacggactcttccccatatataaggggggtccgggtgcctctagtggcagaggttggattttctccaaatcatacaatcaataatacactcgtcggattcatccccggacaggagtagggtattacttcttttataagaaggcctgaacctgtataaatcctttgtcttcaaacccatacactttcctagcttgatagccaccccctttcattattgccgaaatctagtttcgacaaggtgtatttcagggcgctctcacgatcgtaggacgtgtcccagagtcacagcccaaacaaattcggacatgaattgggcctgcgatacctgggccgggcgacgcaaatccgactcggtctcacggtttcgcgccgagaaaggccgaagcacactagcgtcttttggcgatcttaattaaggcgccaagctagccggccggtaacgcgcgtagtctgcaaattctgcatctccgcgacgagaaaggaagaaacaaatacgccggcgaggcgacgacaatgacaagccagccgcacgccggcgaggatggcggcgaccgcctgagcgcgctacccgactgcctcctccacgcaatcatgtcgttgctcccggcgcgacacgccgtgcagacatgcgcgctgtcgcggcggtggcgcgacctgtggcgctccatgccatgcctcgacatcgtcggcgacgagttcacgtcgtcgaccaccggcagcgtgaggtgggacaagttcgagagcttcgcaaccaacctgctcctcaaccacgacgccccgttcctcgacaggttccggcttcgtctacccagctcatggcacgtcaggggaggtgtacagcaacgcgacatcaaatcacactcacagcccgacgtgcgacagatcgagcgatggatcaaccgcggcgtccggttctaccgacccgtcgagctcgagatcaccatcggcgttggttatgacctcaagcttccaatcctcggcgccgtcgtcttctcccaccgactgaaatcattgcgtctctctcgccttgttctggaccgcggcttcggctacaccatccgttcgtggtgcccggtcttggaagccatggagctcaactcctgcatcttcgagttcgacgagatcactggcaatgcgctcaggagtttggccattgatggctgctcccgacgtggtctgcaggtgcctgatgatgcattgtgtgtcacggcgccaaagcttacctcccttcggctcaagttttcgatacatgatttcagcgtgtttttggttgatcgaatgggtttcctcgttgatgcgtcgatctgtaaaatgttttcgtccacgaccaactttggaaacaatgtatgcaacttgtagaagtcgaattagaatccatgtccagtttgcttgggagtctactcaacgtgacaaagcttaatttgtcctgcattcagctatcggtatgcgtaacccctcttgatgcttgaataatattacttgttcgcttcaagatttagatggaaatgtactactcctaattaattactaatctctgaattgacatatgcacccaagtttccttctgtgtattaaattcctttcggctgcgcttcaatttgtctggagcctcactgttactccctccatttcaagttgattaagtttgtagataaatatagtaatatttatgacactaaattagttccattaaatctataattgaatatattttcataatatatttgtcttgagttaaaaatattactattttttctattaacttgaatcaattttgactttgatcaaagtttttttttctgaggagaacaacggcaggagatctgccggaatttaattagaaggaagaaaaaacagtacaaaaccagttcagtccagaaaattaaaagaaaacggtacaacaatacacagcacgaaacaaaagaaactatggaagcctaaaagccgagcaacggagatcaagatcttgttttactatatatgccactgctctctctaagattgaaatgttgttgaaaattctcctgtttctttctaaccaaacattccactaagtggtaagcagagctcctctcatcgccttcttttgctccttcgatcccacgcaatcgatttgggcccaccaatcagaggttccaacagagaggccaacattgtttgtaggtaaatgttgccaggaagtaactagagacgaaacttccttgaagaaggggcattcgctaaacagatgattagtgtcttcaaaggcgcttgtgcataaactacaaatccaattgcacggccagtgtcttctcaacaagttttgagccataagagttttctggtggaggactagccagccaaaaaatttaagtttcggctcagccggcgccttccagagcgaagagaaatctaaggaaacaaaagatccttgatattggaaaagataagcactcttacttgtgtaaactttggattcattccagttccaagagatgtcatcaagacgcggggtaagcaggactccctgaagcatgctcccaaagtgaacaagttcgtggatttcttctactgatgttatttgcctgaaagagatcagccagttattgttatggagctcttgatggacgcttttttgctttctttttgccaacttgaaacacagtggtgcaatgtcttttgggctgctgttttgtagccaattgtcatgccaaaagcttgtttttgcgccattacctagctcaattgtcgttgctgcctgaaacaaccttttatctgtatcatcacagggaacgctcatgccagcccatggtttgttttcatccttccaaccgagccaaagccaacgaagacgaaaggctcgcgaaaacctctctaaatccaggatgcccaaaccacccaaaacttttggcttacacaccgtctgccaattaactaaactgctgcctgggttggttttgtcagggtcttctcctttccaaagaaaagatctcctaaagcgatcaattctttttatcacccatttgggcacttgcaatgcggtgaagtgatgaattggcatagagcttaggaccgattggaccagcgttttccttccggctgaagtaaagaacctccctttccagccaggaattcgcaagccaattttttcgattagcggtaggaagtcgattttccttagctttcggatatggagtggcaggccaaggtagcgacaagggaattgctttaccattccagggaaatttgcaagaagagatacgaggttgatgttttcacatctgatcgggtagatctctgtcttactgatgtttgtgtgaaggccagaggtttgcgcaaagaaagttaggagtctcataagcaccgataagtctgaagcgtgaggcttcacaaaaactgccacgtcgtctgcatacagggagcacctgaatctgtcaaaactcccacccattggagagagaagtgatgcattttcagccgccttaagaattcgatgaaaaggttccattgctaggatgaacaacatcggcgagagcggatccccttgtctaaggcctcggacatggtttattgattgccccggagatccattgagaagcacttgggaggaagaggttgcaagtaaattggaaatccagtttagccaacgagttccaaatccaaactgatgaagcacatcaagaaggtagggccaacaaaccgtgtcaaaagctttggcgatgtcaattttgataaacagactcgttttcttcgttctatgtaaatattgtaccatgttttttacgaagacgaaattatcatggatagccctttttcgaacgaaggcactctggttgggggagacaagctcacacagtcttggcgctagcctgtttgccaaaattttggaaattatcttagagaaactatggattaggcttatcggtcgatactgttcagctcccaaagcatcttcttttttgggaaggagacaaatgaaggctgagtttagttcctttagccgcaaagtgttaagatcaaaaaacgatcttactgccgataacaaatcttctttaatgatctcccacgctgatttgaaaaaagcaccaatgaacccatccggccccggagccttctcgggtggcattgagaaaacagttttcttcagttcttcttctgtgatgtcttattctaaatcgccaaggtccagggagagcaaatccatcatgttccagttaatccctgacgttctttgaaaacgagttccaattctttccttgaagaaacgcagcagttcctcttctttgtcttgtgctgaaattgcaatcccagatggcgtgtgcaaggattgaataaaattttttcttcttctggaattggccttgatgtgaaaaaattttgaattaacatctccctctttgatccaggtctgcctagagcgttgtctgatctggattttgtttagaactgataaagccagaatcctatttttgaggttagacaccaggaggcgctcatcgtctgacaaggtcctagtttcctgagctacgtccagctgaaagaccacttcagatgcaaccgcaagttgtaacttaatgtcacccacttggctccgactccatccctttaaatctcgagcgagacgtcgaagtttgatgcggaaaatagctaggcaattagtggcaaggatcggccgttgccatgagtcttgcactgcttccaagaacccaggaattttgagccaaaaagattcaaatctgaagcttgggaatttcgatcatttctcatttcctaccagaaggagaggcgcatgatctgaacatgctgaagacaaaggatacaaattggaaccctcaaacattaaatcccagtcagttgtgacaaaagcacggtcgatcttggtttaagttgggtttgcaccttcccctgcccaagtaaaacgacgaccagggagttgaagctccttaacctgaattttgtctagcagaccacgaaagcgctgcatcattcgtctatttaggcgatcgttgtttttgtcagaggctttatagatgagattaaaatcaccgatgatcagccattcagatttcatggagggctgcaggctctctatctctgagagaaaaaccactttgtcagcttctagttgaggcccatacacaactgtgattgaccactgtagcccctcttctcgcatggtcacagttgcagacagagagtattgtccaaggataacatcagaaggagaaaagaaattttcattgcaagctagcaacagaccacccttggtgccgtccgccggaagggccacacattgccgcacaaaattttggcccaaactgctgagaacaacacgatcatttaaagaggcaatcttagtttcttggagacaaacaatagtagcaccatattattgcaaaataattttcacggcgtcttgcttcgcctttgaattcaggcccctaacattccaattaaacaggtagacattgtcttgtgacattgaaacatgagctgctgcaactacatctttggttgatgaggaaaggaacaaagcttttgccgaaacacaaccagccaaactggaagaaacacaggcaaaaggtgacgctacaactctgctttaacacagcaagcaacaggcagaagtaggtcaagcacaaaaggctcttcatgggtgttgtgcagcccatcttcatcctgaggcgttctgctcacaggggcgcgaccgccaccttcttctttgcagccttcagacggatggtcttgcatccccccttctccacgagctcagcgattgtcttcaaggaggatggagagagaggcttcctgtagcgctgcaaataaatctttttgatgttatcatcaaaggaagcatgatcatccaaaatgcaaaacttatttgacaggatttcttgagcaagagtttcaagttttgctcccgcccgcttcttgcgaaggaggcgcttactgtggcgttgcgccgaggagatggcaggaattgtcaccttagcatagcttggacaacgagcattgacgtcgggagcaggtagcagcggctgctgaagaggagtcgagagagcagagatgaactcttccaccctgttgccctgcctcgccaccagcccggcttgagtctgcacatccgtcgccaccccattggtatgcggagtcccctgttctgcaaaagaagaaagtacaaaaacaggagaagccacacggggaggagcattgtctggtgagtagatggaatgctgcacggacgcctcatgcaacattgggtcaagatgactctccagaacggaaaggacatctccctgcccctcacttggctccctagaccgaccgcttctgctacgaggacccgagcgttcccggttgcgcgggcgccccctgtcttcattgccctgacgccggccgtcatctctctctggctctctgctgcagcttgaggatcggcgcccaagccgatcccacagggagcgactcctgtgatgggacctacttggcttgtctctgtctttgtcgtcgtcatcatcagtcggccctcttgaaggatcaggctcagctctacaaggcagaggatactctctatatcgagtaccgtcatcttggacatcatactcccacttataggcatgggctttgcgagtgaggaggtcttcaagagtatccacatgaacgaggacattgtaggtccaccccttctttgtgtctgacggcggcgggttgcgaagcggctccaagtccggcagaggaatgtccgtggacagaccttcctcatcagcagaagtgatggcgaaagtgccaccacgagggattgccctgggctcatcagtccaaatccaaagatcataggtgcagctgtagttgcgccggcgggagtattcttcaacatattgaaccgagcacttgcgcccgattatcttggtcgcggcttcttcagtgcggccattgggatgccctcaatgcagatgcgagcgcggtagcaaaaccgtgcctcggtaccatgcaggctctcgtcccagggacgaaagaggtacactctgccagaggcagtagagagcctgggctaacgaagaattgcatcgtggtcactctgatttgaacaagtgatgaagaagtcttccgggtgaaacttggtgaactgaatgtcagcgcacctgatgcgaaaagctgagcggacatcgtctgcaaaagtgttgagctcaacctttccttcattcgcccccacttgccaagccacaagagaacgggctgagaagcgctctctgttcctctcaatttcaccagtggcagacatcacaacggaatcaagaagaggacgagcggttagatcatccatggcgagaggattggagggagtggggatggagcggggagggaagcgaagtggagccaaaggggggaaagctgcagtggatagcccatggggaaccgaaggggatttatagtcagctttcttgctacagctggaagctcgatgaccgaaattcaaacatcgccaacagcgaagaggatctctacaatcaaacacttgatgctctgtgctcagacaccagaagcatttaccttccatatgctgcaggaagcgcgccctccttgactgcagatactctttgttgttgggaggattgaatgcagaggattttctccaccagtgcttccctctgacctctttccaagaatctgaattcacttgaatgcctcctgtaccttgcctggaagctgaaagattttgagaagacaactcaactcttcgcccactcttgaggatcttgaaatcctttacagctgcagcaggcgagcttgtaggcttcataggggaggatggtggctgcaacgaagttaagagggaggtactagcagctggaggacgaagaggagcggagagcacctcagagtaaaggcgcttaaatccctgagcacctgctttcggcgaaccatgaccttgaagggacagagcgagcgcagcagcagcgccggacccgggattgagcagatctgcattgagaaccttgcctgtgctgacctcaaccaaatcttgaaccgaatcccctggagaggagacagcccaaggtgcagtcgccggcctagggagcactggagacgtggtctgacccggggggaaaagctctagggttggggaagctaaggacgctggtggatctgagggagaggagaaaaacagggagggcgacagggacagggatgagcgatgacgacgatggcgggggtgagtgtctggacttaaaggatctggtcatgatgtggatgtgggggagaaaggggagaaggagagagagagggagctcaccggaggtggccgccggaaccgaagaggccgccggcgcgggtgcgtctagtcgcctaacctgtcgcgagagcatcctaactcgtctttcctttcaagagtagaagtatgacctgtaaacttgatcaaagtttaaacgatttataaactgaaacggagagagtagctctatctatcatatcactaagcttccagcttttgttttctcttgtgtagttttttatattgccattatattttttttcttatgtcccaaaatatatttattttttcatatttcttggataatatccttttactgatatactatactttttgagacctacttcataatgtcatactcaattgttctccaattttattacaggagaagcattctgacaactctacaaatgttccgacgtttcacaaactgactaccttgtgcttcgatgcatgtgatctggacaaaaatctagatatattgttgagttttctggagaatgctcctcatatggagaaagcaatattgcagaactgcaaggtactagttttctcttatttctgtttgtcttgttactctccattttgttggctacttggtttatcttctcacggtgttcgtgtgtgatgctctcacagattccaaataattcgagaaagaggaaaataatggcaagggcaaataggaccctgatttctcccgagcacgaaaacgtgacagttttggcgtttcagtacttttaagcttatcaagatcgcatataaaaacgacaatatcaaagatgtgattgaacttttactgtgcaattcgacagaacttgagaacagcacaatcatcctcacaagacattaaattgtttgagttgtattcgcgtgcagcttgttggtatgtcacttttgaattgttttttaccaattgtatgcccaaatgtatacaaatatatagcaaaattgtttgtttatccgacatgaagtgtcctgggtggttacattatcatccattgtgggttggataaacgagagtgatgacatcggaattcctgttccgccccactgcatttggtccggtccattagttagattcagccataagtaggcccaattttctaggaataaagttcacctgtcgtccctcaactttaccccaggtttgtttgacatcccccatccatcatcacacttaaaattagggatccggatagacctccaggggtccggtcagatcaattttgcatttgaatttgtcaatatcagtagtaccaaatttgatcgtaaacagaaatctcaatccttacatcgaacatatcgtgtttgagttacatttaggccatccttgattttgtttttatggcatggctttgatataagctaggttcgattgttcacaaaacttagtagcatgtcctacgttgtaacgggctataagtagcaatgactataagaagattagggataaaatatttggtagttacctataaatgctacgtgtaggagcgcgttgcctgccgtggagaaggggaggaaagtaagacaactttacttttaacagtactacaaattgttaaacataaaattgcttcatacatactaccttcgtctcaaaataaaacaacctagtacaacataagacacattctaatactataaatctgttgttataccatagtagggaaggagtataacattagaaatttaattgtccataaacaaaaatttttagctgtgataatgatgtcataagtgggacaccgggttatttttgctctggatttgcattgactcagttctccataccgtgcaaaaactgcggaggccaagaacagcccgtttggttggagagagttttcaagagggattgaggctactaagtgttttgtttggttgggagacatggaaattttggtgggatgaggatagagaattgaggaaggaactccctccttttcaatacctgggtaggggcagttaattgggagggaattcctcctttactttgtctaagcaaatctcacccatccgtttttattactgatctagtctccaactaaactccctatcaatttccatcgcctctgccaaacaagatattatgattaaaaatcaaattcccatcttaattttatcatcaatttcctcgtgtaaactcccaatccccttccctcgagttcccgagcaagccggaaactctcatctgatcggccaccgtgcgttccacgggtccaaagtccaaaccctaccgtcttcttccgcgatctagcggtggcaacgcgcgcgcgcctgcatctctggaaagaaagaaagaaacaaacagagaggagaatacgaccccaacgaacgaacgccggcgatgaagcagccgtacgccgacgacgacggcgaccgcctgagcgcgctgccggactgcctcctccacacggtcatgtccttcctctcggcgcggcaggccgtgcggacgtgcgtgctgtcgcggcggtggcgcgggctgtggctgtccatgccgtgcctcaacatcgacggcgacgagtaccggccggccacggccggcggcggcggcggcgccaccatcaccgagaggtgggagaggctggagaacttcaccaccagcctgctcttcgcccacaacgcgccgttcctggacaggttccgcctccatctcccaaacttccagcgcatcacggctactcagcagcatcacgggcggcagatggagagatggatcctccgcggcttccggtaccggcccgccgcgctggagatcgccgtcggagtcgccgccgtcgcgttcaagctgcctctcctcggcacctcctcggctagccgcctcaagagattgcatctttccggcgtggttttggacggcggcttcggcgagtgcatccgctcatggtgccccgtcttggaagccatggagctcaaggcttgcatcttcgaggatctgaaggagatcgtctccagcacgatcaagagtttggccattgttgactgcagaagtgggcaccatactgatgcattggtttgtcgaatggattccctcgttgaagcatcgattagtggaacacgtttcggatccgactttgacaagacgacatccactttaataggcagtctaatcaacgtgagggaacttaatgtgtcgtggtttcagccagtggtatgtagtataacccatcttgacacatgaacattacttattcgcttcgacattcagattacttttacagaaattgtaggagaaccactttttccaagctagtttctatctactgcactcctttcaatcctagataacttgatctaccacaaaagcacctttttatgctatactttgttgaacctgtctgctttttcatattgctattataaatttcttctatctaacaataatcattacactatatataatgccttaccaactgtgtatggtcctattatgaggatcctatatatgatcatgtgatactcaattcagctccaatttatttcaggagttgaaatatggtgaatctgcgaactttcaaacatttcacgagctcactacattgaacatatatgaatgtgatctgggtcaaaatttacatatattgctgagttttctgcagaacactcctaacctcaagaaagttatattgcagaactgcgaggtactacttatactttctttcagtttgttttgttactctgctttcttgatttatcatcctagagtgatcctgtgtgatgccccaatagatttcaggtcattcgagaaagaggaaaagaacacccagggcaaacaggaaccagattcattccaagcgcagaagtctgataacttccaagtctgagatctcgaagataatgaagatgacatatgaagatgacggtgtcagtgaccttattgaacttttgttgcgcaattggagaaaacttgaggaccatactatcataatcaccaagatttgagtcttttgcatatggtgttatcatatgcctgattcttatgtcattttgtactatactgtgtgtatttttacaaatagtaactaaaaccatatatatgactaatgccagactggtgtgattaagggcattacctccaatgtatgctagtattaactgattccagtgagattcgtaaaatcactcttttatagtttcaagttgagaaatttaagtaaaacagccatttgattatttgatgatgctcctccctattgatcaattgacagttgacactgttaccatactacaggtgcaaggattagcttcattttctgttctgtcattccaatctattgattcctttcaaaatgataagtgccaatttgtcaagtttttatcctagaaatgcaaataaacatcttcatgatgctcttggaataatctgttgtgaggataatgttttgtgacactgcttgtgttgaaagtcatttattataaattggggaagacaaagtaattgattttcttgtccaaatatcgttgagcaaactataataggagaactaaactttctccctccattattgtaataacataggagaactaaactttctccctccattattgtaatcataaccagagatctaaataaaataccttggtagctggatgaaaactattccataggagaactaaactttctccctccattattgtaatcataaccagagatctaaataaaataccttggtagctggatgaaaactattccatgtcaatatgaagcgtacttcgaggcaaactcagcaatattcttattcgagctccctcctttcttcatggcttccttagctttcttcatccacctattagcatttttcctgtactctgccttcctctcactctctagaacctctctgatgcatctctccacctcttcttttctcaccatgccttccttgtcccgatgtacgcgtacaccatttccccatgcactttcaatgtacttcgctgtagttggttggtctgtccactgaggcatcgctaacagtggaacgccagtaacaattgcttctgttgttgagttccatccacagtgagttaagaaacagcctgttgattaatgaagaataatcagtttctacctgcagcttaattatttgaaactgtttactgcagatacttccgatagaattgacatgatacacacatcttatcgcccaagagttggattgacaagataggttacccattggataatttggttgaaggcagtaacttgagctaggtttgtgggatccaaaatacagatcttatgaaaatgactcagtatgccatgtgtaaataattagggacagtatgtccttgtagaattctatagctgccattagattttgtaggatcgaacagcaagaactaagccaaccagagggggggggggtgaatggttgtaggggtttacagatttaagtgaagaaacactccaatcaaactgatcagtatctatgcatcagttacaactagtgtattcgtgcttctgtctttctctgacaactacttttaactgtctctgcagcttatgtaattttgagagatatatggttcatatttattccaatatctagaactttcagtcttctattctcaccatatatctgtaatcgtagccttctgacattaattctgtctcatgaaatacttgaactagtagtttagtgaatgaactgaaattaacagcattattaccgatttgactcaaaatctgagttgaatatattacatttccacatttgaataaaaaataaatggggccacgagtaacatttaaccagattaaagatagttgctaacagttgcgtatttttgtgaataaaacatgactttttgtcccatacctgtggctttgtgagataagacctcaagctggggacaccaagaaacgattaggcccctctccttgcacttgtcacggagttcttctgatagcttgtgttcatcacaggacctcacgacccaaaggaacggtttaccggaattgcaaaatccattgcccagctcatctaactgagttgggtcaagatcagcaacagtcccataggaagcatagacaacagagcaagggggctgattatctagccacgccaagcaaggtgaagtgctgtcagaaatgttgaacccatagttcttgtttggttgtaagcgatcgtcatccaagtagaaggatggtacggtcggaccaatcgtcttaaaacgccatgctgatgccaagtaatctgcctcctgattaagtaacaacattgcagctatcaaatcttctaccttctccaattctctctggggcaaaacaacaaacagacgaggggcatgagcaggttgactcaccttcggctccaattcttggaaagaattgacgagcacgtcgtcggcgtcctccagcccgtcgaactggcccagcaccgcctccaggaacggcgggtacgactccggcgccttcacgaacgacggcacgtcctccggcccgagctccacgctcagcaacccccggagcgcgcccccgtccacgacgggcaacccaacgcgccccgcccagacctccccgtagatgacgtccacggcgcacggctgcgagaagaacgcggcggctggcaccccagcgccgcgcgccacgcgccccgcccacgggaggtgcgggtcgtacaccagcacgcggggcggcctccccgcggcggcctcggagcggaggaggacacccagggtctccgagcccacatccgccagccgccgggtgtactccctggcgtccccgcaggccgccatgccgccggagtcgaagccgtcggagatggcggcgacgcggaagggggcgagagggggcgggacggtggagagaacgtggcgggtggtgacgagcgtggggaggaagccgtggtgcgccgcgaggtggcggccgaactgcaggatcgggttgacgtggccttgcgcctcggggaaagcgaggaggaagacatggccgccggcgccgccgccgccgtcttgggtggaggaggtggtggtggccggtgcgttctccatctcggctgtttcgttttttcttctctgtgtcgcccgggaggccgggacatggaggagcatagtccaagactagtccatcctaccatttttggttttttcttctagcaaattattttacaaaattatggctatgattagttctcttcaaacttccaacttttccgtcacatcaaatatttgatatttgcatgaagtattaaatgtgaaaaaaaacaattgcacagtttgtatgtaaattatgagacgaatcttttgagcctaattacgtcatgatttgacaatgtggtgctgcagtaaacatttattaatgacggattaattaggcttaatagatttacctcgcagtttacaagcggaatctataatttattttgttatcggtgtacatttaatacttcaaatgtgtgtccgtatacttaaaaataaattttgaaatagaactaaacacggcatgtgttttcttttctgtgttagaaaagacaattttttaaaataattcttaacattttttaaattataccatctccaaaatatatatttgactatatttttcttattataatatataataaataaataaatttttattttttatagtatttcctaaaacaaatatatatatatttttatttagcatagattcttttaaatgtttagagaataaaattagctcgaagtctagataaaagaaaatctagatttatttttgattcataatgaaaaaaattgttgcaaaatttacatttagatgtcaaactaaatttacataattattatttgtgccatcttctctagtgtggttcattatttttccttgaccctctaatctttcccttaatttctattggtgtgctatgttatgagtttttaattttaaattaaaataaaagctctacgtattattatgaaaatcatcttagaatttagccttttcttttttcatgcacagttttttacatacaagtgtgctaacctatagaattaattgttgtaaccaatgctaatttaggttgcgttcaatctctttgttttgatatttttgacgcatgcaaaacgagaaatcacattagcacatgattaattaagtatcaataattataaacttgaaaattaggtttatttgattttttttaaataacttctatatataaattttttgcaaaaaaatatcatttaacagtttgaaaagcttgctaacggacaacgaggaagttgaagtttgaagttgagaaatagaactatgccttaatcatagggacttaaaaagtacaatgcatactttttttttgactaattttcagattataccaaaattaggtagtggttttgccttttgttttctgaattttgtaaatctttctacagtcatatgcagagtgggactgtagattgcttggaaagccttttatattttcatagttctattgctagttctattccctatgtatttttttttattttctttgctctcacacatgtgaggcaggcactggaaagttccagaaaaaatccagctttactatttttcattgatccaatcctacggcttcctgcttttttttctccatcagacggttcagctttcgttgctgacgtggatcaattgagtgctatttttggattcacagttcacctatagagatttcttctgaaaaatatacctataggctcggacattctctgtatacaattccgtattttcaatagcccaggatttagagaactcggattaatatctgtagcattactgctattaattagcattgctctgtttgtgtgcttggtgatgctctgttcgtgtattggtgttgccaaaggaagcggagaggaaatgggctccatgacggacagaaggctgcagagaaggggaaagagcaaggaagcagagaaggggctctgactttctcgcctgcaaacaacacactgccgctgcctcgaggctggttgattttcactaatactccaatcgttagggccgatgtgatacctctgcgtaattatgtgcctccgtaccaccaaaaaatccattccattctaagatggatttagtggcgataaaaaataactaaaatattcttaattaaaaaatagtaaaaattatatgtaggtaaaaaatattgaagggataaaacttctcgttttacgtgatgagggtaggtaggataatagaagttggttttagtgggataaaattcaaattatagaagttgagtttttttgggagtagaaattaatccctatatcatttgtttatcatcacgttgccacactttgtccccctgtttagttcccaaaatgttttccctaaaaacatcacatctaatctttggacacatgtacaaagcactaaatgtagatgaaaaaaaaactaattgcatagttaggggggaaatcgcgagatgaatcttttgagcctaattagtccatgattagtcataagtgctacagtaacccacatgtgcaaatagcggattaattaggctcaaaagattcgtctcgtggtttccaggcgagttatgaagttagttttttcattcgtgtccaaaaaccccttccgacatccggtcaaacgtccgatgtgacacccaaaaaattttatttcgcgaactaaacatgcccaaggctgagttcttatcccagttttcccaactcacctctctcattttccacgcgcacgtttttcaaactgctaaacggtgtgtttttttttaaaaaaaaattatatacgaaagtttgttttaaaaaatcatattaatctatttttttaaaaaagttaatacataattaattgtgcaataatacgtgctccgttttacgtaccggggaggaggggttcccaacacctcctcccgaaaacagcctaagccgatttactggcgccctcttactttaggctataagtttttttttgagaggctttaggctataagttgaaaaatcaaaaccaacagatatttttttttgtttggcttttataaagctgtcactcctaggctgtctttggtattaagggatggaaactaatcccttccgtatgaaaaaaatcccttccatataaaaaacggagtgatctattaacgtgtgattaattaagtattacctaccgtactttttttttaaaaaaaggatcaatataattttttaagcaactttcgtatataattttttttcaaaaaacacaccgtttaacaatttgaaaaacgtataagcgaaaaataaggagagtgggtttccaactctaggtgccaaacgcaaccttacactgttgagcaaaaagttgggttgaactagttttttttttcttatgtgaaatggagataagattttaccattaaacttaagccttaaaatcctttaacttattaacaaaaaacaaaaagtcgtcttaaaagcctaaccccaaataaagaggatcggttctttaagctaacctttttagcttttatatagttctattttgcttttattttatgtagtagttaataagcttgtgcccttttttaaggaaattctgtggctttcaagtctcgagggtaaggtgaagtcctatccgtaattcacaaaattgaaaggactactcgaacctggattaaattttggcttagtatagctaaaagaaaagtacgacgaacaaactgactatttgttggggcttaaactttttcgtttagctcatgagccccaaaaaaggcccatctgcgattcacatatgaaaagctactcaaatatggctgttgattttaatagtgcaggagtggtttatagctttaaatataacgaaccaaaatgttgatacaacacgtgcaacattaccctttacttgcaaatcaagtccaattcatgtttcatgccacgttcgccgtgccgattcccgacacggcgacaccccctgaaacagtgtacaccgcaaatttggaccatggagagagcaatcttggccgtcactccactgcactcctatttatccattaacaatccttgtgatgcaaaacacacacaccagccgccgcatggcagtaccagaaaccaacacaaaacaagatcatggggagcatgagcacaccggcggcgagcgccaacggcgggcaagtgctcctgttgccgttcccggcggcgcagggccacaccaacccgatgctccagttcgggcgccgcctcgcgtaccacggcctccgccccaccctcgtcaccacgcggtacgtgctctccaccacgccgccgccgggggaccccttccgcgtcgccgccatctccgacggcttcgacgacgccagcggcatggccgcgctcccggaccccggggagtacctccgcaccctggaggctcacggtgcacgcacgctggcggagctcctcctctccgaggcgcgcgcggggcggccggcgcgcgtgctggtgtacgacccgcacctgccgtgggcgcgccgcgtggcgcgcgccgccggcgtggccaccgctgcgttcctgtcgcagccgtgcgccgtcgacctcatctacggggaggtgtgcgcgcggcggctggcgctgccggtgacgccgacggacgcgagaggtctgtacgcgcggggtgtgcttggcgtcgagctggggcccgacgacgtgccgccgttcgttgcggcgccagagttgacaccagccttctgtgagcagtcgatcgagcagttcgccggactggaggacgacgacgacgtgctcgtcaactcattctctgacctcgagccaaaggtatagctgcgttcctttcactggcttgggaactcatttcctctgcacgaaaaacggaatgatccattagcacacgattaattaagtagtagctaatattttttcacaaatggattaatatggttcttttaagcacgttcgtatagaaactttctaaaaaaacattttaaaaagcgtgcgtgtggaacacgagagataggggttgggaacaaagagcaacgaatagtttagttcgtttctaggtgttcccaactctcccctctcgttttccgcgcgcacgctttttagacggttaaatggtatgtttttgcaaaaagtttcgatacgaaagttgcttaaaaatcatcttaatccatttttgaaaaaaacaattaactaatactcccttcgtttcacaatgtaagactttctaatattgtctacattcatatatatatatatatatatatatatatatatatatatatatatatatatatatatatatatatatatatatatatgttactgaatctagacaaataacacatatatttgtctagattcattaacatctatatgaatatgggcaaatgctagaaattcttacattatgaaacggatgaagtacttaattagtcacgtgctaatggatcgctccgttttccgtgcgggagggatcagttcccatcctcctaaaatgaagaagtgtgcttccatccaaacatactccattagtttcatattataaatcgtttgacttttttctagtcaaactttgttaaatttgatatagctcgtacaaaaattatcaacatataaaatatcaaaatagtttcattaactctaacattaaatatattttgataatatgtttgttttgtgttgaaattacttttatatttttctataaactcgaacaaacttaaataaatctgactagaataaagttaaacaacttataatatgaaacggagcgattaccatagatgatcattgtattgcaaaattgttacacatttttcttgggaaattaaaatgagcaggaggcagcatacatggagtcgacatggcgcgcgaagacgatcggcccgtcattgccttcgttctacctcgacgacggccggctgcggtcgaacacagcatacgggttcaatctcttcaggagcaccgtgccatgcatggaatggctggacaagcaacctcctcgctctgtcgtccttgtgtcgtacgggacagtctccaccttcgacgtagccaagctggaggagctcggcaatggcctttgcaactccggcaagccattcctttgggttgtcaggtccaatgaggagcacaagttatctgtccaactccgaaaaaagtgtgagaagagaggactaattgttcccttttgcccccagctggaggtgcttgctcacaaggccacaggtattggaactaaccaagaactcaaattatattaatcttgataacaaaaagtatacaaaagactagtgaataagtagtagacaacaatagctaaatgcaagtttttttttacctggcaccaaatatttatatgtaggttgtttcttgtcgcactgtggatggaactcgacattggaggcaattgttaatggcgtaccgcttgtggcaatgccacattgggctgaccaaccaaccatttcaaagtatgtggagagcttgtggggcatgggcgtgcgagtgcagctggacaagagcggcatcttacaaagggaagaggtagagagatgcatccgggaggtgatggatggtgacaggaaggaggactacaggaggaatgctacaaggttgatgaagaaagctaaggagtcaatgcaggaaggagggagctctgacaagaatattgctgaatttgctgcgaagtattcaaattgacaaaaattattgctgaaatctcaagcacctagctatcagagatattctagttctgacttctgaatacaattggtttttcttcctagagaagttcatggaggtcaaggtgctgatgttttccacgagtcagcagaagtaaattaagtttacagtgtgtgtaaaatggtaatttatactacttacaatttttattttataattgaagtgtcgttaacttatgtcctcgtcgagggcaacaagctaccttagagatatcacgataacaaatgaattatgtaagctttacatactttgagagtaccgggcatagcttgcttaccaaattacagaacatatatatgtgcatgcatcaatttcctctgataccggaaaaactgttatttatcctctcctctcaattctttctactaaaattcggcattacaacaatatatctctcttattaattacaagtttctatagtatataaagcaaaaaaaaaaataaagcgcaatgaaaaactcaagtaaataatatggttaaaaaggatgagacttcaatcctccatatcttccctatcgcacaaaaccatcaaccagagcactaccagtttatttaaaactgttactgaaattaatatcattctcagtttaatataacaatactaatatactattccaggtggtttattatatggtttagttaagatgaaattcactgtgggagttcacttagatatatatatttttagaaaatcatgagctgcagttaggagtccgattgtctcaagttagcatgcgattttttttaaacaaatttcttatatgattccttctatattaccaaaagtgaacggtcttaaaaaccgactcaaatacggatatgtattttcaaaagcaaacgaacttaaaaactgactcttacacggatgacgtaaaaaaaaccgataaaaatattttcaatttttataatagagatagtgattgtccactggtcggcccaagcacacctctaagagcaattgttttgtttgacagaaggacttcaagggcaggaatcccggtgagcaacttctcttcgaccacgcgaacacctatccattctgtgaggctgtgatagtcatagtccctggacaaagcgagtctccatttcgcctacaaacttgtcgtcgtcaagcgcgccagcacaaccaaaattaacttgcgcgccactctgcctctcaacccttcaaacacctagtataaagctcatcgtcgccgcgagcgagcttgctacctccaagtcaaatcaccaagtgattcgaacccatggcgagcatgaatgatcaacacggcggcgccaccgcccacgtcctgctcgtgccgttgccggcgcagggccacatgaacccgatgctccagttcggccgccgcctcgcctaccacggcctccgccccaccctcgtcgccacccgctacgtgctctccacgagccctcctcccggcgaccccttccgcgtcgccgccttctccgacggcttcgacgccggcggcatggcctcctgccccgaccccgtcgagtactgccgccgcctcgaggccgtcgggtcggagacgctggcgcgggtcatcgacgccgaggcgcgcgtggggagggccgcgaccgtgctcgtctacgacccccacatggcgtgggtgccgcgcgtggcgcgcgccgccggcgtccccacggccgcgttcctgtcgcagccgtgcgccgtggacgcgatctacggcgaggtgtgggccggccgcgttccgctgccgatggacgacgggggcgacctccggcggcgcggggtgctcagcgtcgacctcgcgacggcggacttgccgccattcgtggcggcgccggagctgtacccgaaatacctcgacgtctcgatccggcaattcgaggacctgctcgacgccgacgacgtgttcgtcaactcgttcaacgacctcgagccgatggaggccgagcacatggagtcgacatggcgagccaagaccgtcggcccgacgttgccgtccttcttcctcgacgacggccggctgccggcgaacaagaaccacggcatcgacatcttcaccggtgatgcgccgtgcatggaatggctggataagcaggcaccctgctcggttgttcttgcctcctatggcacggtctactctctcgacggcgccgagctcgaggagctcggcaatggcctctgcaattccggcaagccattcctctgggtggtgaggtcgagcgaggggcacaagttatctgaagagcttcgtggaaagtgcaaggagaaggggttaattgtgtcctggtgtccccagcttgaggtcctgaaacataaggcaacaggtatgaattgctaattaaaatgtcaattacaaagataaaaatgtttttttaatgatgtacttcctccgtttcatattataaaactttctaacattatccacactcatatatatgtgtttagattcattaatatctatataaatgtcgacaatgctagaaagtcttataatatgaaacggagggagtaataagtaaaggtaccacaccttgcagtgttaattggtaccctacgacaaatcatgagttagaaatagggtcgagttaatactttctctattttgaatatacagacactggtaaaagtactccatccgtccataaatatttgacgtatttgacttttttaaatatgtttgaccgctcgtgttattcaaaaacttttatgaaatatataaaactatatgtatacataaaagtatatttaacaataaatcaaacgatagaaaaagagttaataattatttaattttttaataagacgaatggtcaaacatatttaaaaaagtcaacggcattaaatatttatggacgaagggagtattatttattttattatgacttatcctctaatggtaacttacatttttttatatttatgcaatatttctaaataagataaatcattaaacttatatcgaaaagttgataggatcatatatttaaaaatagttgtattatgtttgcaatatttgattaaacctctgccacacaaattttttctgtgcaggttgtttcttgacgcattgtggatggaactcgacgatggaagcaattgctacggcggtgccaatggttgcgatgcctcagtcagcggaccaaccgactatagcgaagtacgtggaaaccgcatgggagattggtgtgagggcacaactagatgagaaaggctctgtcacgaaggaggaggtggagatatccatcaagaaagtgatggatgggaagagggcagtggagtacaagaggaatgcagctaagtggatgcaaaaagccaaggaagcagcacaagtaggcgggagctcagacaagaacattgctgaatttgtagcaaaatatttatcaaattagtatagctttgtatacatctggtttcttcatgtaaggatcttgtaacaccagcatgtaaaaaaaaattaaatagcagacgacaagatggagttagttttaatgtgtctacaaagattttggtagtataaaactaaatgagtggaaatttggtggtatgagacaaattttcccttcccaaagaccactaaaaatataaaaatataaagtaattaaacgagaaatcatcagtctacagatggtttgcgagttctacggaaaattaaaactcaatcggagatggattttcatctgtctaggagatattagctcgtttcttgcatgtcagcatgtcacttaaatagtttaaattttttaaaaagtaataaggtaggttaatataaaatatatcatttcataaagcatgttatgtaaaattcgacttccacaagttataaaaaataacaaattaaacagaaacttgttttcgtaccttcatagttatgtttgttatattttttttatctaaattcgtatttgtatagtgatatatcacatattaatctatatttattaatgttttgataacttaggtaataagtaattcaagaaacagggaattttccctcgacggaagaaaatcgttcccactacaatcttctgaaacatatacctacaggctcgaacattttctgtacgcaattccgtgcgttccatagcacaaaatttgtattgtttagattaacatgtgtagcattaccgctgtcaattagcattgttctgtctctgtgctctgttcttgcatgtatcggtgttgccaaaggaagcagagtggaagggggtcgccgtgagcccgtgactggaggggaaagggaaagagaaattttctttcacacccctaattttttagtcgatgctttctatgtccctaaattttcttcattccctttatgtttctcaattttgatttgcatcttttccataacattgccgaattggccattagttcgtttaataggtgtggagaagtctgttttaccattcaatatgtgagtaatatatagaaatttatcgactatattgatttggatcgatgttgaagtattgttgcactttgtctatattattcatcgaactttatcatatcattaatcatcatataatggtgttatgtggagtgtgatgatgtaagaatgaagttatagagttatattcatgcatagttaaatgtgtaattatgccacacacggttgtttttcatatgaagttccgatcaatattagtagattccatttcaatagtcccgtttccgatttaccgacgttaccgatatcgttaccgttttcgggtctacagttccgattccgttttcgagaaaaaaaatatgaaaataaaaatgccaaatggttttaatttccaaccttttccgaccgttttcatcctagatacgtgtctacatccacgggttttgtagagagccaaaaacaaacgtgtgatacaacacgtgcaacatgtcctttacttgcaaatcaagtccaattcctgtttcatgccaggttcgctgtcccgggccgacacatccctgaaacagtccaccgcaaattctgacccatacagaaagcaatcttgggcgccactcctacttatccgtctcgatcaaacacactcacatcagccagccagcagtaggcccagcacacacccacagtcctctatcacatcatggggagcatgagcacaccgccaccggcggcggtcacggtggcgaacgtccaacgtcggcgacgataaccatggcggcgggcgggtgctcctgttgccgttcccggcggcgcagggccacaccaacccgatgctccagttcgggcgccgcctcgcgtaccacggcctccgccccaccctcgtcaccacgcggtacgtgctctccaccacgccgccaccgggggaccccttccgcgtggccgccatctccgacggcttcgacgacgacgccggctgcatggccgcgcccccggactacggggagtaccaccgcagccttgaggctcacggtgcacggacgctggcggagctgctcgtctccgaggcccgtgcggggcggccggcgcgcgtgctggtgtacgacccgcacctgccgtgggcgcgccgcgtggcgcgcgacgacggcgtgggcgccgccgcgttcatgccgcagccctgcgccgtcgacctcatctacggggaggtgtgcgccgggcgcctcgcgctgccggtgacgccggcggacgtgagcggcctgtacacgcggggcgcgctcggcgtcgagctcgggcacgacgacctgccaccgttcgtcgcgacgccagagctgacaccggcgttctgtgagcagtcggtggcgcagttcgccgggctggaggacgccgacgacgtgctcgtcaactccttctccgacctcgagccaaaggtaatctagtgtatccagcttacattgcaacaaacaagatcatttcgtcccaaaattgttacacattttggctgtgaaatgagcaggaggcagcatacatggaggcgacatggcgcgcgaagacggtcggcccgttgttgccgtcgttctatatcggcgacggcccgctgccgtcgaacacggcgtacgggttcaacctcttcacgagcaccgtgccgtgcatggaatggctggacaagcagcctcctcgctctgtcgtgtttgtgtcgtatgggactttctccagctacgacgcagccaagctcgaggaggtcggcaatggcctttgcaattcaggcaagccattcctttgggttgtgaggtccaatgaggagcacaagttatctcgagaacttcgagagaagtgtgggaagagaggactaattgttcccttttgtccccagctggaggtgcttgctcacaaggccacaggtatgggaaccaacaaaaactcaaattaattattttgacaacaaaataattttcttccaggttgaaaataattgtcatttttataagacagatgtgaaactttaaaaatttgactataaataacatgtaaaatgttttttagaaatatgcaaaccatatgtataattaatctaaaaagtacttcaattcaataaaatcatatatttattggtgtttatatatatatgggaaatagaaaatattggtcaaagttatttttttttagcctggagggagtgtatag

SEQ ID NO: 32860 - DNA, 4233 bp, Oryza sativa
ggtgtaccgctagtggcaatgccatattgggctgaccaaccaaccatatcaaagtatatggagagcttgtggggcatgggtgtcagagtgtggcaggaaaagagtggcggcatacaaagggaagaagttgagaggtgcattcgggaggtgatggatggggataggaaggaggactataggaggagtgctgcaaggttttttttttttgagataatgcagcttctcatagattaattaagatcagacagcagtacctcccgaagagtctccgggattacagtacggtaggtattacaaactgtttgctcagaacattgagctaaaaggtgagccgcagcattagttacacgattaacatgaatgaaagagcagtccaaaaaaccagccgccaggaagtttatgtcagagacaagagcgccaaccattgaccggtcgcgtgttccagactgaatcttttggatgatagctaggcagtctaaagccaaaacaattttctggtgaccctcctccatcgccgtgcgcaacgcacagcgaatagccaaagcttctgccatttcaggttggatacaccccgagtgtcgctcattagcagcgaacaagcacagcccgctgtgatccagaaatagaaaccccaacccaaacgaattgactgactggaagacagcagcatctgtattaataagaatcgtaccttcaggcggaggcctccatctgggcactggccgaagagcatcacccctaaccgcttgcacagcacggcaacagtgttgttcaatcatctcgacataagccaagattttctggatgacctgtcttggatttgctaaggtaggattattcctggaatgatttctagcctcccatatatgctacaacgtgatagccagtgccgtcttttggatgcctgaacttctccccaggaaatcaaaaacccactgcttcatatttgacagctcagtcatgcatagcttcaaatcaaaatgttgcttagtgccatcccaaacacatacagcaaaagggcaaaggagaaagatgtgttcgattctgtcatccctttcgcaaaagcaacagccatcagtagcagggatatgccgccttctcagctggaaacctgaaggcaagcagtcatgcacaattttccaaagattgattaacattttccctggggcattgattctccaaagttccttccatctgtttgcactctcttgtaaacccgacgacattcccctgccattttcactttgcgcagccataaagatttctgatcttgcaaggttgtaagctgaacgcaccgagaaaacccctcttttgtcgtgtggctaggaaatgaaatcctctcctccatgtgcactaacaggaatttgtaggatctgttgggcagtagtttcgtcaaagaaagagaacaccttatcctcatcccactccccaatcgcatcattgactaagaagtccaccgtgacatcctcaggcaaagggaggagaggtctcaccatcgaaggtttgattcctggtatccaatgatccttgaggatttttaccgaagagccattcccaatgccccacctcacacctttcctaagcaaatcccttccaaagagaatactgggccaggtgaaggaagtggcagtgggtttgggagcattccagagatcagagttcgggaagtaccttcctttgagaaccctagcacagagcgaaacaagatcagtcacgattctccaaccctgtctagcaagcatagcttggttgaaaaggcccaggtctctgaaacccatcccccccagagatttcggcgtcgtcatccactcccaggaacgccaatgcattttcttcttcccgtcctcgaagccccaccaatggtcaaggatgcaggatttcattttctcacaagttgacacaggcagcttgaagcagctcataacataggtgggaatcgcctgcgcaacagctttgagcatcgtctccttcctggccctggacatcggcctatcgttccaaccattcactcttctccacactctttccgggaggaaatgaaaagagccagtggacgctcttccaatttcagttggcatgcctagatacgtgtcttggaggatctcaaccgaaacttggagtgtctccttcaccgagttctttatatcctcaagacagttctggccaaagaagatggaagatttctgaagattaattttctgtcctgaggccttgcagtatgcttggagtgcatctttcagtccttgaacactgtgcagatcgctcctagcaaagaagatgctgtcgtctgcaaagagcaggtgtgagattggtgggccaagacgaccgttcctaatgccctgaatcacccccattgattccttcttttgaaggatgctggatagcccttcagtgcagagcagaaagagataagggctgattggatccccttgtctcaaacccctcgacggagtaaccgggttcgttagctctccattgatcctaactgcataccttacagaggtgacacatcgcatgacagtttgaatccaaggatcagcgaagcccagcttcaaaagacatccatgcaggaaagaccactcaacacgatcataggctttcatcatatccacttttagagcaaagaaaggcttcttgcagtgttgcttcttaatggagtgaaggcactcatatgccactagggcgctatctattatcagtcgtcccagtacaaaagcactctggaactcagaaacccgagtgctgcaaggttgatgaagaaagctaaagaggcaatgcaggaaggaggaaggtctgacaagaatattgctgaatttgctgcgaagtattcgaaatgacaaaaatccagtgagaatggctattagcctagagatgttctagcttatgaataatttttttcctagaaaagttcatggaggtcgaggagctgatgttttccataattcagcagaagtaaattaagtttacggactgtgtaaaatggtactttatattacttacaatttttatttcataatgaaggtcatgtctagcataactccagaccccaaatcccttctgaatttgaagtttctatatcaaattatactgttttaaaatttcttatttcatctaaaataggaacaaatgattaatctaaatattatttacgtaatcaccgatccatagatttgcaggtacgaccatatttaagaaatctcgtatctagagctacgccaaacttgacctgaagtgtaattagcttatgtcttcgtcgaggacaacaagctagcatagacatatcgggataaaaaaaataattctttaaggtttccatactttgggagcacatggggttatgtctttctaaattacagaatacatgtgcattttattttcctccaccggacaaactgttatttatgttctccacttaatccatcctttctattagaactcgccattacaaaaatatctctctcctactaattactacctccatattttaatgtatgacgccgttgactttttatccaacgtttgaccattcgtcttattcaaagaatttatgcaattgtcatttattttattgtgactagattcatcatcaaatgttctttaagcatgatataaatattgtcatatttgcacgaaaattttgaataaaactaatggtcaaacgttagtcgaaaagtcaacggcgttatacattaaaatacggagggagtacaagtttccatactatacaaagctaaaaaatagcacaaggaaaaactcatgtaaataatatggttaaaaatgttgagacttcaatcttgcgtaactaccctatcgcacagaaccatcaaccggagcctcattgtcattgccggattatttaatgttgtttctggaaattatatcattctcagttttattaatgatactattcaggccggtttattaatgaattcattgtgatataaaaatactcctatttgttcatgataaaaaatagacagtggtgcttgttttcttaattaaccgatggtaaaaacagtcaaggcaggtcacaacgcgtgcatacataagtctaagcttggctcttgcgcagaagctatatatctctacatttcctctcacacgttgacacaacaatcctttcgctctccacagccattgatgtgaccgtttgcccaccgatatgcctccccctcctcacctccccaattctaccgcgtgcatgttattctgctctttcaaacatcgctgcat

SEQ ID NO: 32861 - DNA, 6324 bp, Oryza sativa
  unsure (1)..(6324): unsure at all n locations
cgctgcgagcttgaggcacgagaccttgctacctcacaagttagattatctcatattctctttttttcttattgttgtgttttctctttgcacagtttttcgtctgctgcttttcttagcttgattgctataaacaaattgtggcaatgtggatttttgaaagcgtatgatttgttgaatgttgaattataacattagtatttatgtacttttgtttccaaagctagtatcactactacagaaaagggaattagtgccggttgggaaacccccttcggtgccggttttctcaaccggcacaagggaggcggcactgatttgaaataaaaaggtgccggttcattagaaccttttaggttcgacgaataaaaaaaagccggctcgatgcgttagctcgatcgagccaacgcatcgagccgagcagtccctcgtcccacatccagaagaatagaaagaacaagaaaattttttttggcaacattcatcccacaacatgcaaagatggaatcatccacatatcaaattttggcaacattcatcccacgacacaaattttggcactcaaatcaaatttatgcaataaaaaaaatcacacctcttcagtcgtcaccgtcgcacggtcagccgttgcgccacctcccatcgcgccgtctcccttcggcgagcccgccgcttgccgccaccaacctccccgcgagcccgccacccctaccgccgcctcccctcccgctagatctagtggaggggagggctcctccccgccggcgagccctccgccacctccccttcttgagccaccccacccgccgccaacgccagatccggccacccccgcctgtcgctgacgcctcccctcctgccggatctggcggaggggagggcgcagttgccgctaccgcctccgctggctgcgggagagaagggaggggagagagagagagaagagagcgagagagaagggagggagagaagagataaatattattcaagtggtgaataatcaatatttctctttttaatttttactcaaataagtgggctcgtcacggattggaggtgattgccaacggtgtgcccctttggcaatgcacaatgggctgatcaaccaaccattgcatactatatggagaccttgtggggcataggtgcgcggaggtgcaatgggacaagaatggtgccttatggagggaagaggtgcatcagcgaggtgacgatggatggggatcggaaagagaaatacaggcgaaatgctgggagcttgttgaataaagctaagaaagcaatgcaggagttcaggagggagctctagtaaaaatattactgaattcgctgcaaaatatttgaaatgaatagaattctttgaatgcattcttaattaatgagaatatccagtccagatgttatggaaattacaatttttttttcacttgaaaattatatagggagagcaaactgctagattactcaggattcagcagacataaattaactttacatagcaggtctaaaatgagttctttttcttataactggtatatatcataatagggataagacattttacgaagaattttccaccttttaagttatttacatagaacgataattaatattataaaaaaacggtgacatgtttccaaaatgttagctttgtaataccatgcatcagtagtaattttaatggtacataagtacaccaagacattatctaacaaaatacaccaagaagcataaaaatataaattattataattataaattataacactacaacagaaaccttaataggaaacggctcatagtcataggtgccaaactgccaattcatttaaaaccggcatctattgaccattttccactttcatgggataaaaaaaaattaaaaaccggcatctttaagaacatacaggtgccgattctagaaaaaaatcgatacctatactgatattatatgtgcatgttctttaaaagaccgcctataattaaaaaaaccggccaaccgagccgactggcgttatcctctgccgcctcctccttctccccgctactgcccttcttcctcctcctcctcatcgtactgccacccctccttcctcttcctcctcctcctccttagccaccaccaccactcctccttcctcctcttcttctccatccaaccaacgccactgtcaacacagggactgatccaccgccacgaccacggggttggcccggtcgtcgatgtgatggtgtcattctttgtctgtttgtgatgatggtgatctcagtgatgattgtgattgtgtttgatgtgaatgatggtgatctcagtgatgacggagagttggtcgaggcatcaagccagttttttttcattcctaggacctcaaaggtgttgctttgctgggtgccgttcgaaaatatggcacctatggtcatctcccaaccagcacaaatttccttttctatactccctccgtttcatattataagacattctagtattgcccacattcatatagatattaatgaatatgtacatatatgtctagatttataatatgaaacagagaaagtagtagtgtatgtgattactagtgatttcaacaatttgaattataaattatgacagtacatgttatttgttctacttataaccttaccagccatcttaattaattgtagcaaaggctcacttgctcatggacaatatatacttgacctattttatcagatccaacacatgttatccatgcatctcgtagataagtgcattataaattatatcttttgaacaaacaaagtatgaaccacagcaacacattattcatcaatccctatacatcatccacatcacacttgagctttccctatgcagtagggtaggaaggctccatggcgaggccacacatgccccttttgtcagaaatgtccttctccatcctcaagaaaccattctcaccccaagtcgtgccccaggagttcttcagcaaccaatacttggtaccatcactagccttgccatagccaatggccacaataccatggtccaagtcagtgccacatgagccggtcatcacaccacctttgtagaactggaatgtcatgtcgcctccatcgacagccacagacacaggttggttagccaccgccttcataagggcagcctcattgttggctggcacatcctcatagcccttgatcgatgcgacgctgttggatacactcttgcacttgtcgtctgctgctgcgtatgggtagttagactcggtggtgaggccgccattcttgatgatgaatttgaaggcgtcatccatgagcccaccttcgcagccctggtcctcaccatggacatcacatcaacaagctcttgttcagagagtgagataagtttgcccgtgctcagcttgacaataccttccatggctgccacggccgaaaacgcccaacaacaacctgcaataatcattcatgttcaatgcattggacacaatagatgtcatcacaaaacgctatcataaaagatactgaagaatgtcatctgagtagcctgaattttcttaccacattggccttgatccttgatgggagtgaccgcgcccttggttctccagtccacggtcgccggcagcgcatcaatgttaacattctcatacctgaatccagtaggaaccctagtcgtgctaggaatgaatcccttgttggtcttcatccacctgaactcgtcattggtgaggtcggcgaactggttcacaccaagccagaaattgtggttaccagcattgaacgactcgatgaaggcgacattggccttgaacacctcgaaccggcgggccttctcggcatcgtccctgtacacgcgcccgtactgcgccatccacctctcgtgcctcgccgccatggccgcgtcatcgctcagctcacgagctgctagaacagcgctgcagaggcagaggcagccgaggatggcgaagagcagagccttggccatggccatggtcgatcaggctttgtgacctgtgatccagctgctgttggttgctgctctgctgctgcttctgtgaactctgcttttggtttggtgaattggaactaggatgcattggtatatatagtcagtggtacgaacttatgtaagcacatacggtgcgtgtacgatgttgtgtttctgtgtaaacggcagtctgcgtagccgtgaagtatatacgcgtataaataaattattgtgcataggacgtacgtttcctgcagaacacagacgcctacattttaaattatgctgtgggggtttgttgaatgggaatatgaatacaaaattggaatttgagtgctccaaatttgccttggtgaatgtgtggctaaatgagacgtggttcacacggaatgaatgtgtttatcataggtaatggaggattagagtgatgtgtttatcctatggagagttttgcacattggggcaatcgaatttaggataacataactgaaaatagttgtattgcatataatagatagaacatggagtacaatatattttgagtactcgtatttacggctaattatttttttcaattctaggcgacgtacttattaacaacgaggtgctagagataactttatcactctcaagatatacaagttcagtcttttcgaggtgctaataaaggttgggtgtatatgtgcgtttatatgggtgtatgtgtattgtgagtatctacgtttgtaatgttgtttctcaaattaaaaaaaatgtatttttggagtttttttacagagagaaaatacagtattttggttgctcttaatcgaaattaaccagattaacgttactcccaaccaaattactagagtacttttaactctacatgagtccaccaaatcgatgtaatcaaagagaatttctccttgccgtaataaaattaatgtagattttgttctctcgctgttggatatttgggccagcagcaggtggagggcatagagagcacatctgtcagtctctggtctatctatactaatataaaaagtataagttgtgtctagcaatcctacaggtgaaatcacctcctcccatctcatccgtccatctaccatctcatctcatctaattcgtttcgctatcctcctcgctccaccgattccaacgattatagcgaccttatcctctccaccgtccacgcgcgattactccgcatgcgccatctctgccgcgcacctcgcctccgccgcattcaatccgtcgcgcatcatcgccacaacgacaaatcctcatatccgacgctctctcccaagcgtcgtcgctgctacctccactccgcctcggtcctcctcgcctcctcgctcctccctgcgtggcgccgctccgccgtcgtccccttgcttcgctccccctctcctcctcctcgcctcctcactcctcctcgcgtggcgcacgccgccgtcgtccccttccgccgccgcccagacgccgccgtcgtacccttccaccgctgcccggacgccgccgcccatacgttgccatcgtccccttccacagccggagccgcggtcttccccatcggccacacaaatcgcgccatggcaactcacaaaattccccacgcgtggaccaccaaggctccatcgcgctaatcccgcggtggctcccctaatcatgataacgccgtcgccgcgcctttgaacgctgctgcaccatccgtcatcatccgcacttccgccgccgtcgtcaccgcaatcagtatcctggtggtccagggtttccaccagtgccgctaccccgtctcgccctggttgtgcatactcccaccagcgtcgcagctccgtcgtcgccctgcaatcggtgcctcagtggtccagggctccgctggcgatgccaccccgtcgagccacggtggtcaagccttccgccgacactgagcctccatctttgtcgctgctctgtgagtcctctagtgttgccgccattggaaggggatagactcagcagctaggcctcccagccgtgtgcctccctctcttatgttggtgatacctgattcaactcaaatcgactcttttcaatccccatttttcctctttgtgaattttccccattagttctctagctgaattttcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32862 - DNA, 13942 bp, Oryza sativa
cataacataaagtttgctccgccttgaaatccgctcggcttcatctttgtcttgagggagttcttgagaagtcaaaaatcgtatgaggggttctcgccagtcggtttcaaccacagcgacgtcatgagtgcccgcaacttgagtggtatctttgtgaggtactgtcggcgtataaaggtgttcaacgaaaacatcagagggcgccacctcgcgcttggatccaaagttggcaagtctatcggcggcttcattattatgtcgaagaacatgactgagctcgagtccatcgaacttatcttccaatttgcgtacctcttgtcgatatgccatcatgttgtcgtcaaggcaggaccactctttcatgacttggttgacaaccagctgtgaatcacctcgaactattagacgctttatccctagggaaattgcaatccgcagtccatgaaggagggcctcatactcggcgacgttgtgggacgccgaaaaatgtatccaaagcacatagcttaatctttctccagttggggaaatcaaaaccactcctgctccagtgcccgaaagtcgttttgatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttaaaagtagtgagatagcttcctggcagtaattaggataccatataacagcttctgaacctgagggtacctcgttttggagtcggctaggacctcgctgacaaaataaatcggtcgctggactttctggacatggccttcttcctcgcgctcgacggccaagactgtgctcacaacctgggaggtggctgatacgtacagcaacaacggctcctgcgggtgtggtgaggctaagactggtggctcggtgagaagtttcttgaaatcttcgaaggccttctgtgcttcgggtccccactggaagttatctgttttcttcagcagcttaaagaagggcatcccccgctcgccaagtcgcgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcatttttcagggttcaatttcatcctgaaagcacggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacgtagcagtatgccccaaaaggcgtgatgaatgaagtcttcaaacagtcggattccttcagtcggatctgatgataccccgagtagcaatccaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaactgggtttgccagccagtcgggatgaaggacttctttgatgaagcctgctgctaacagcttggtcaattcctccttgatcgcgtctttcctgtcttgtgcaaatcggcggagtcgttgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcagcgcctattacagcagttttagtaggatcagagggatctaggggaatcttcttagtcttggcttcgctttctccactttttgaagtcttggtaactggtatttctccttcgctcgccgtggctgcagccagtcggatatcctctcgggcagacgccatctcgtgagtgtgagccatgtcgcaactctccttgtcgcatgtgacggcttgcttgatgtcactccgtagggataggactcctcggggaccaggcatcttcatcatcatgtaagtgtagtgcgggacggccatgaacttggctaacgccgggcgtccgagtatggcatggtatgctgtctcgaaatcggcgacttcgaagctgatattctctgtgcgaaagttttcccgagtaccaaaagtgaccgggagggtgatctggccgagtggagttgcggataatcctggaatcactccgtgaaaaggcgcattgcttggttttaactcggagcgagggatctgcatatcatccagggtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaatcctgccggggcgtcgccatcgtccttcttccttgacgtgctttgttcttcgtcagagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagctttggcgtactcgttggctttttcaaacatgagcttgactgtcctgggaggcttacgcccaaacttgccaactagttcttcgtggcgaatccctttggtgaacgcggcgatgataacgtcgtcggtgatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtcacctcctgctgcgcggattgcgagaccgtagacggtaagccacgatccagggttagtggtgccgtcatacttctctattccagtcggtttgaagccggctggccaatccactcgacgcagatcgtcggtgaaggctgctacttcgtcaaggtcgtcgtcgtggcggttcggcgaatgatgatagcctcgagctgctcggcgctgtatgattgtgtcgcgaagatcgacggggcggcgacgaggtggtgagcgaggccgttccactcggcgctccttatgaaggtcgggaggtgagtgaacagaccgctcgtcgtgtcccctgctcctgcggttggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaacggcattctgttgaggggtgcggaaaaccggtgtcccttcgacatcctgttggccgatgagatcacgcgctcggcgcccagcttccaaagctcgctgacgtcgatcctcagcctccttcgcggtccgctcacggtcctgctgctcacgccgtagccgttcttgttcttgtggttgatgctcttcctccagtcggtgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggcgttgaagccgacttccgcctaggcctacgggatgaagacgctgtcgtggtgaagacggccgctaaatcgtcggggagcttcatcaggactggtgggtaagccccatcatcttgatctggtgtcgttgaagaagatgcgatctcggccgagtggtttgaagccgactcggttaagatggtcttgaagtagctttcagccgcgttcgggaatccaaacgggaccgaaatccggttctctcccgaccggtctgattccgagtcgaggagagaaatcttgccgaagttgttggtgatgaagtcgaggctgtcgaaccgaaacgtctgcccgggagggaaaacgaggtcgtcgatgccggagatggaacccattgcactgatcggcgaaaagcttgacgctacccctacccggcgcgccaactgtcgaaactagatttcggcaataatgaaagggggtggctatcaagctaggaaagtgtatgggtttgaagacaaaggatttatacaggttcaggccttcttataaaagaagtaataccctactcctgtccggggatgaatccgccgagtgtattattgattgtatgatttggagaaaatccaacctctgccactagaggcacccggaccccccttatatatggggaagagtccgttttacaaaagataatctatatccctaacggaatatgcaaatacagatgaaatatagtcgtaaccgactaagtctcagggtgtttccttgatacacaagttaagaaacaaacccgagatacaaataagatattctatctacattaggtatcctgtacctagtccaaataccgtcgccgtatagatatgggatatccataatctccacacacctcctcgtcagtcccccgccgtgagcgtcgcgactcgaaaccctaccgtctttcgcgatctcgcggcagcgacacgcatctgactaccgcgccgacgccgccggtggcgatgggcgaggatcgcggcgacgactacctgggcacgctgccggactacctcctccacaaggtcatgtcgttcctcccggcgcggcaggccgtgcagacgtgcgtgctgtcgcggcggtggcgcgacctgtggcgctccatgccgtgcatcgacatcgacggcgacgagttcggcggcggcatggccaaggtcaggtgggagaagctgatggacttcgccaacaatctactcgagttcggcgacgtgcacgtgatcgacttcaaccccccgtttcttgagaggtttcgtcttcatctcgcccactcttggaccgcaccatacatacgcgcatggaagggctctcggctgatcgagtgttgcatcctcggcggattccggcaccgacccgccgccgccgagatcgccgtcggcgtcggcgtgccgttgttcaggctgccctggctaccatctgtgtctacttcccgactaaaaagattgcatctctctggcctagttttggacggttgcttcgatgagtgcatctgttcatcctgcccaatcttggaagccatggagctcaaatcttgctcatgcgaattcaacaagatcgaatctgccacgctgaagagtttggccatccatggatgcagaagttgcctcctggagtgtactacattggctatcaagacgccaaggctcacctcccttctcctgagaattacagtttattatgaacttagagtacgcttggtcgatccaatggattccttgatcgaagcatcgatccgtgagaagtcctacgagccgattaactttgacaacgatctatgcttgtcacttggtgccctagccagcgtcagaaatctcaagttatcgtggtctcgatcaatggtatttatattatcctcttattatagtccttgaatatatatcctcgtgcttgaatatatatcctcttggtgcattcgtttattcatgcaaaagtatgtcatttgtttaatccatgtaagaaacgacctctagggcttaaaatccattcaagtaataatgagtaaattgtattggtggtagacaaacttgttaggtgggtgcaaattagtacataaacttataaaacactcgttttagtacatgaacttgtctacttcgtgtgaacaaggaccaaaataacttgtcaatgttaattttacgaagttgacgttgattagaatgtgacgtgcatacgtgtagtaagcatgcataagacatgtaatatttataaatttggtctctactttatccttcattatggaaatgatgaatttcatatatttctaacctttatatcattgctcgctttttaaaatttttctactatcactatatcctattctatttttttattaaagaggtgtatatctaatagcaaccttcttagatatatatttacacagtatcctaatcagccaataaatcaataagattagctatgtagtaattttgccttcctccgcacgcaccagataagttaatacaccaaaacgagcattttatatgttcgtgcactagattgcacccacctgacaagtttgtgtataggcgatgcaattatatttactcaataataatctacttctacttgttatattaaactctggaccgaaatatgcacccatatttttctacattcgacgacagttttttagaaaccgttggagatccatgtgtcattgtattaagaaggataagagaaacagctctatattctcagccattcgcacagagaaaccaagcaggaaaaaaaagaaaagaaaaacgtttaaccgaataacttattttcgaataacttatttttctccactgcccaaccaccctgcagattatatatctatatatcctatacagttggaaccaaacactgaacatgcattaagccacatcactatacaaatcttgaccattggatcatccgttagagggcaagtatcataggtgatgtgaaactaaaaagttaaatgacatttaattctgttatgaacaaaacactaaatatgcactaaaccacatcgctttagaaatctagatcattggatcatccgatccgttagagggtttaggatcctaggtcatatgaaactaaagagcaatacatttaattttattatattcacatgtatttcatcatttcaattacgatacatccatttagcttttaccttttacgaaaagactatattgatcttcccagatatgaagtgttcatcaattcgtttattttgtttccttctttttccttagcttgcacatttgttaaaatccatttatcattacatagtcattccgcagaaacacacggggggtattatctcatatctaacaatgtatgccaccttcaccagttaaccaaccttacaaaactcttaatttatatttggtgtacttttgtacactattattataaatttcatccacatataattttataaatttgtatatgtcaacaaaattaatgtaagatgtttatatgtaggagatcttgtctaaattcgtagtattatgatgtgtcacatctgatcaatctcttgtattttgagatggatagaggatatgatattgccatatttacttatttttgctccaatttgcttcaggattcacaccatggagaatttccaaattttccaacgtttcaaaagctaactaccctgcacctatataaatgtaatatgtgcctaaatttgaatatactgttgagttttctccagaaagctcctagcttggagagagttatattgcagaactgcaaggtatactacttgtatctttttcctattttccttcacttgttacactgccgtgttaatctgtcttctaattatactgatctctgtgatgcctgaatagtttccagtagctcccagaaagaggaaaagatcaacaaaggtggatagacacaagattcctcccgagtgcaaaggtctgataacttcggaatctcgcgccttgaaacgtatcgagatcacttatcaagatgatgatttctgcaatcttattaaacttttctcgtgcaattggagaaaactagaggaatatactatcacactgaccaaggtttgagtcgttttcattccatatatgtttttctagcaactttaaatttagagcatatatagcttaagtcttaagagctagtagtaccaaatattttaatttaattagttcattgtctccggtagacatccgcttgtttgctagtactgtctaattagaacttaaaatagttggagtgtagtaccttattatcttcacgattgctctcagcctctcagttatttcttcgagtcttctcacttatatactattgcgttttttttctcatgtatcgccaattcgccatgcattcggtttggacactatttggttaattggttttgccaaaaacaaatatatatgctacatagaatgcctctaacacaattgcatgcgcggctgttccaaacacccttttcattttcatcaaattcggcacaagcatcggtggtgatgtgtctgaaatatatgcacatcacgtgtagaattaatctagtatttcataaatatatcatgacatgaaacatgtaaactagcaaaaccactgctgttgatctagaaatgtatgctagacagctacacataagtaaatctatggaacataacggagacgccgatggttttggttctgcaatggaagaggatccgctaatgcggagcaacactcaccacacgaacaacgcacagtaccgggtgttgacgacgacgcgtaatgcccgagagtagagcaagacgagtcacggtggatgaacaactagcgagcgagtacacgaagcgcttcccaaaaacttttttagcgccttctcctagtgcaggatatcgaagccgaaggtttcggagacctaccctctcaattgctggtgcacaccagcagacgggatggagtagactacgagtgatgttgctttacagaggaggcaaatccttgactgttttcgtgtgtttcgtggagccaacagcttagtttataaagagataactagatgtgtcgttaagatgctcgtacaatcttgtcagctcctcgcaagggaggtggaaagtgtgtctcttgttgccattggtcgacgagtgctgtcagtgttgaacataggcattggcctctgagccatggtgatgaacgctagcaactttgcatctagtagacgagggatgtaccggttgtcaaacggcatcacgcctcccgtgtgcccttgaatccacaacgtcctcataacttgtataaagaacaacgttacaaaaagttaaatgcattgacaactctacaatatattcaataaataataagcaaagagtatgttacccctccctccatgatcctgtgagctcagtgcatctccttgtagtgcaggtgtagaactagggtctccaccatcgtacatattagaatcacaaattagagacgtgtacatatgagtgaatcaaagaaaaatataagtaaattgcgcattctaataacctgtctactagaaacgttgaccaccctacaagtatgccaatgtttttttggccgatccaaagatttgtcgtgcttagggcatgttgttttattatgactaccttcgtggcatatggaacacctgttaggtatcatatgctcggaataaccatcattcgacttctatgaccgaccaattcttatccatgtcattgatgaacctcttagttcttccgccaggagtatcgatcatcttcgacaagtcgggtatgaactcctcaccgtcatcacttggccattgagtgggatcttggcttggctcgaacctaggggagtacgagcattgcacagcttccttggtagcttcgaaacacatccgagggggcacttcctcatccatacatcgtagtctacaaaactgatcattgggagcatggcatgtgatgcaatgccagatattgacatgtacaagtgttagttgtcacaaccatgcaatagtgtcggccacccccattgtgctgcagctgatgtaactccaccctgcttagtcacctcgtactttgctgtagaaaagtagaaacaagtcgtatgttgtcccatagtacgtactttttgtatttcaaactccttaattcttttcggccacctctcacacttttgtattgcagccatcgtggccttgtacctatcagcgaaccacttattgcagttgttgaacgtgtatgccacgatggatgttactggtagcctatgaatgcctttgagcatattgttgaaactctctgccatattgctagtcatgaagccgaatctacgagctccaacatcacagggccgtgcccacttatgcctctatcacataatgtatagtagccacttctttagttgagactcaaggaaatcaatgagatgcttcacttccttctcaaactctatctactcatttatttaacaaatacactctagatccttcatccggcgttcggttgccccgcacggtagaagttagcacagaagtgtcgcgtgcaccatctatgatgtacattacggtgacctgagagatgacattgttgattttgtgtagaatgtctttgtgcctatgtgagattatgcacacttttctattgagtctaatcaagcgtctccaaaccatactaatgaaccagtcaagaaggtacctcaattgctatcatcggacacaaagtggttgaaagcctctacacactgcccaaagaaccatgcgtcatgcccaaatacatgccttgttaccccatccactgttctcgacctttcttggtgaggctcaacaacataacgcactgtggggttattagccttaataacatttagaatcgtcggtagccgaacatatctctcatcccaatctccccatatgttcttcatagccacctactttgcacgccaagctttaccataagattgatggtggtgccatatggcctccacgacctcaactatagcagcaggagtcaaggtcagatcagcttggacaaatggttgcaacctgttaccgatgaacttcgaagttagtttcaagtgcttgttcaatgccactacaacacgtgtgctctacacctacactggtaaccctccacctcccatccttagtcttccttgcacaaacctcccacattgttaatgatttaccaatgcatgccaccatgtacttcttagaagcgtttgggtgcttcacatggaacgggcgatgcacactgatcgagtaactctgcagtcatatttgtgtgtgtgagagagagagagaggcgctactgaggcgaggagagaaagagaccgccgtgtggggctaagtccactacctgtgggccccgccgatgcgggtggcgttgtctttcgttgcgtcggcatgtcggccccgccaaccattcgatggcatgtcgtggccatcacgacctcagtgccaatgcgtttggtgttgaggactgaaagctcagcgccgtcagcccttgtgctaaacccggggttcaatttttgtgatagttttagcaaggacctattttgaaataagttccaaaaaatggccaaattgtgaaattttcgggtggtgggtgcccgcggtctcgtgccccgttctggtgaggtggttgtcccggtctggtgaggtggttgttgattctcacctcatttacgtgaactggtgggcttgcgatctcctaaagtgggcggtgattttacacctctcttatgcaaagtgatggcctcaacacacctattttgttccctctcttttcttcctctcctagtcattttgtgtttgctattggacactgtatctccctctctcttcctttatatctgtcacctcctcgctggaacattttgtgtccgccacgcgacactctatctccctctctttccctatatatttgtcaccaagagggctctctctatgtgtcttctacattctttagttggtaaagtaaaatgacttaggaaaaaaaaggtgcatgtctatttagatgagatgacattgaaggagtggtcgtattaccttgcataatccataaactgcataaagcccagatcccttatcagcctgtttcaatggttttaatgcttgatgtgtccaaaatgccaccctaggctctccccatggcacattacatccaggtgcatctacataatctaaatacaatagttgcaattttaggggaaaaaagcagtgagatgttacaatactaaaaacaaggtataaaggagagattaagcatgtagataattaccccgagaaaatatgtggatgctgaaatccaatcaatatattcttcttaatcttgtcctacacctatagtgctgcatttcttatagttgaaagcatgtgctcagcccaattgtactttgcaatgttgttaacatccaagcaaatagtgacatattgcatactaggttggtttgatgttgttggggcaatgatcttgtacaaagtaatcaacataaaagttgtgatgaacttgttatctgacggagcttggggctcctcaccgggagaccgcgcaggcccccctttgccggttcggccgggggcgctaagtgaggttcttcgccctcgatctgaggaatgttcgcgagagagaatcgcacaagacacgggcgatgtagacaggttcgggccgctgagaagcgtaataccctactcctgtgttctggtggatctatgtgtgaaggaaattacagagagttgaagagctagagagttcaggctctccaaatcgaattgccagcctccttttcttcggtgggcaaggtcctccttttatatctcaaggggataccacatgcaccacttctacctactcttcttttgggtggggacccaccctatcttgaccaaaacttggctcgtgccttgagcctggaaactaaatcacagcctgtgcttgagtgaggctcagtgccgtcactcgcctgacaccggagatcaccctgtcattccttcattaataggcggagatttgcaatggccaccgtccgtatgaccctccgatgggatgggtcatacctacctccactccgccggacgcagacgcaatgtgggagcacggttgtctgccgatgacgcgaccggcgtcagaccagtcacaaaccggtcattcttgtccaccacgcgttagtttagcatgccacacgtcggcccttcttcatacaatgacttccttgcaatggttgcgatgaagcctggaatgtatctggccgggactgacgtacctactccaagagttagcacgccggctccggctaggaacgagcgcctggaggctctcatcataccgacgggacggggcgaggcgtgtgtcaggccgcctgttgccacctaacccgcgatctgaccggtctgtgaccggtcacacactgcga

SEQ ID NO: 32863 - DNA, 5973 bp, Oryza sativa
tcaataactatcacttggttatcctcccgcatgtcgcgaatgtcaagggaggaggagtgaagcagtactaggtgggggagaggggagggatggagggatagttgaatggcatttgcgggtaatttctctacaagtcaatgggtacttctgaaattgggacagagttggagttgtggagcgaccaaaataccgctccacatagctagttcactttgtaggagcgatctggtttactccgctccacttttttttttttggagctggaccgtttggttgggctccagctagatcagaggtgaatctaggagctgtagctgcaccaagcaggccctagaagaacatcgtaggagaaaatctcatttactatcccacaaattgacaaaaattctaatcccttatataaggaatttatgaactacataaataactaatcaagcatgtaaataagcatatgataacttacagatgcactaggttgactttgaccagacgatctagtctcctcttcaaccctcaactatgccaacactcttccctctgtctccttccggtgaaccgtttaaaccctataacaagatcgaagcaaagggaagagtaatggagatgcgatctggtacaaatcggattgatcactactgaaataacggataccagtgatttacttttttttttctcatggcatactgatctgcacaacaatatactgacagatggatgtttgtattcaattcatgtatagtgcccatgttttacaagttaattactccactgccatcatgttacaataattttgttccatacattgctcctctcctgattaaccgtacacgttgttccacctacaaatacctctaggtacctcgtaaacacagtaaaagatctcatgctttttcttactgttggtaaaagcaagtcatagtacaatggaaaatgacatgagaatgcaaatacaatacgcaaaggactcaatgttttgtgagtattgttgtgttgttctcaagttttctgcgactgtacagcaaaagttcaatactgtcactgatatcgtcatctttatacgtgatcatgataagcttcaagtcctgggactcgaacattatcacactttcacgcttggaaggaccgtgcaagattagccttgccattattttactctttcttgaattatctggaatctattggaacaccacacatgatggtagtgagaggatagaccaaaagcagagtaacaagatgaacataaaaaaaaatagaagtaccttgcagtttgccaatataactttctccagattaggagcattctataaaaatctcgacaatatataaaaattttggcccagatcacatgcacagaagcgcaaggttgtcagcttttgaaatgtcagaatatttatagatttgctacaatgcttctcctgtaataattggaaggagaattgagtttgacatgatcaacattataaattagtttggaagtcattatagatgcgatagaagaagtaatagtacaaatataaatagatgcacctgacaaaacaaaaggtcaataatgtaatgagtgccaggcccaaagtataatataatagatagaagctagctgtgagctgggacaaactatagtgcaaaagaaatgtactccctctgtcgttaggaaaaattaagtatttgcaactcttagatgtggtaattaaaaatgatttgtcacgtagacccacacatcattgacacatgatggtccacatgtcatgatatatgggttgcaaatagttgaatgccaaatttaagagcggcaaatagttaaatctccccgtaaaatataacatctcgtaaagtttaaatttgtacctaacgcgcctcaagaaagaaaacatgtttgtttgacccctcctttcaataaccatgctaaaagataaaacttgctaggacgaaaggaatacattataaaatgaacttggtcttatatatatttcagtccaaagattaataactattacattctggcatcgatattaaagcgaataagtaaggcttgtcgatttatcaattgacagagtttttcatattaataatcatttttttcagcactagaacaatatctaatgactgatagtatgttttttcttcttgttatgaaacaaagactctcaccttaaacttgtaaaaaatgtttttgttatttatcatcatcgacatggatgttttttatccatacaagcataatgaaacatttagattcgtttcgtcagttcgatgcttcgacaagggaatccatctcatccactaaaaatacaacgagaccaataactgaataccataggcgaaaggaggtgagctttggcgccgtgacagccaaagcatctcttccagagcagtcatgaatggccaaactcttgagtgtgccacaaacaatctgactgaactcgaaccgtacagttcttgagctccatggattccaggacggggcaccgagaacggatacactcacggaatctgccgtccaaaaccatgctggaaagcagggtttgaaatttcggtaattttgccccccaccagcaagctcacatctcacccaaattttttggtttttttttttgcgaattttttgaatttgatcaaattttgttcaaattcattcaaaacagtcacaatttcaaataatttcggccaaaaaaaaaacgaaatttctgaaatttcggttcccctgactgaaaaaccaagttcgaaattgaaaaccctgctggaaagatgcaaagttttcaggcggcaagcagagatggcgccgaggagaggcagcccgaaccggtgaatggcgacggtttcgccaatggttaatctcgagcaccacgggccggcaccggaagccactgatgatccatcttctcttgtgtcgaggcatatatatgtcgggttgtcctacgatgtcacggtagtttgggagatgcagctggaatctgtcgaggcagtacggggcgttgtgggcgatgagcaggttggtggtgaaatcctccagctaatttgtccagctcaaccagctcgccgtggagtttgcaatcgtggacctcaactcgtggccatcgatgacgacgcacggcatggagcgccacaggtcacgccaccgccgggacagcgcgtacgtctgcacggcctgccgcgccgggaggaaggacacatgatcgtgtggacgaggcagtccggcaacgcgctcaggcggtcgccatcctcgtcggccttcggctggtcgagctcatcgccggtgttggtgttgtcgtcgcaagatcgatcgcaaaagatggtagagcttggatgcccaggtcgcagggacgctaccggcatgcagtcgtatgccattcgatcgaattgtatgtaacagatgggcttggttgaggcccaatgcattgggaggcttgtgcagtagttcccctaaattcaaaatatcatgtgattccgaaaccatgtttcttttccagtctcaaatatggttgaaaacatggaatacttgtagccagagctggagtttgaaactccaccatcggttccggtgttgaatttgatcagaagggttcgcattgcaacagccgcaaacgcatacctgtgttactgttggcttggagcactattctccctcgtaatacaggacattttgacttttttttctagtccaatatctttaggtttgatcaagtttaatcaagtttatatgaaaaattaacatcatctaaatcaccaaattagttttattcaatctaacattaaacatattttgacactctctccatttcatattataagtcgctttgatttttcttatagttagatgatttaaatttgaccaaatttatagaaaaatattaaaatattttcaatataaaacaaatatgttaaccaaatatattaaatgttatttttaataaaacgaatatgatgttgtagatgttgctaaacttttttataaatttcatcaaacttctttaagttaaacaaagaaaaaaatttaaacgactaataatgtgaagtggagggagtactatattttttttagggaggagggagtaatatatttgtttcatgttgaaaattttatgttttcttataattttggtcaagcatacataagtgtgactagaaaaagaatgaaaaaaaagtaccaattttgccatttatttttggcaagagcaaatggttaccaaatactcccttcttttcatattataagtcgtttgtctttttttaatcaaatttctttatgtttgactaaatttatagaaaaatttagtaaattggggtgttgttaagaaggaaattggaaaattttgtaaagcttattctcgagatagaagcacctgaagtagtggatactatgatgatatgatcatggaaaaggctcatattatttttaagtcggaaaataatgaaaaaaacctttcacattggtgtatatgtggagagaactgaaagatcaaccaaaatggcgaaggttcttagaagaagataaaaagaataagagtactaagatatctaaatcaggtgcatacacatcataatccaatcaagcatacatatcatcatccaatcaagacacagaggaggagaccatccgcaaagagaagcgccatgagggatagaaaaatggcaaagccaagctaaaagggagaggtaaaaatgtcgcaccttctcctttgagggaccagccgtctcaggactttgttccttgcaatgaagctataaaaataaaagcagaagcaatgtatgggaatagagaggatgcctttatttaaacaatagttttataagcatccatgccttactgtttggatgcattaatttgaacagcgagattctcaacagacatgccttgctatgccttgctgtttggatgtattccatcaactatattttaagtagccatgtcttgcatttcatatatttaaacaatagttttataaacatccatgtcttcctttttatatatttaaacaactgttttataaacatccatgtcttattttacaactgttttaagctatcataactgcaagattataaataattgtgctaattattgccgctagcccgctacatatgtattttgcaggctgttgttatgatgaaatgctaagaaattattggctaacaaattcagataattaagactgtgggctacatattatcagtacataacctcttctgcaggtaaaaagatacatttatcattcactgaattcacaatagaacatttagttagcttacaaacttatcactgagttcacaagtctaataattgccgagtccaaatcctagaagccaattgaccatagaccacatagtggcacactaaatactagggatacaacatcacttggttatcatttattcatcaacagcttcatgtcccttcagttttgcatcactaaaatttgaagtgtctttgtccaacaattttaagtgtgtgtgatacttctccattcttgtttgctccttctttgtttcagctgatttcgatcttgcttctgcaaatttcacaatcgcttttgcttttactcttatagcttcatagtaagaaacaaagtcttgacatggctggtcccccaacggagaaggtgtaacatttttacatctcccttttaacttggctctgcctttttttctatccctcatggtgcttctctttgcggctggtctccacttccgtgtcttgattggatgatgatgtgtatgcacctgattcagagatattagttctcttattcttgttatcttcttctaagacccttcgccattttggttgatctttctgttctctccacatgtactcctatgtgaaaggttttttattatttgtcttaaaaataatatgaaccttttctatccgagtatccactactccaggtgcttctagctcgagaataagctccaaaaaatattccaatttccttcttaacagcaccccaatgtgtcttgcattgcatgactgtt

SEQ ID NO: 32864 - DNA, 1935 bp, Oryza sativa
agaatgcagaaaaaatgactgagttgtgcttgtatttgtagaggatgaagttgtagcgttgcggcagcaagtttgcaatgtctgcaaatgtaacggctataactgctactctattattttagtgcatgtgcctgaaatcactatacatatattgtattttatttctttcctgctggcagtagcactactgtattttatttctttcctgctggcagtagcactactgcttggttattgttgttatctatccccacaatggtttctactagattggatgagtgcatttattgcttattgactactttattagtacattgtggatgcccttaggacacacgaactttgtactaaagtggtgaccagatcacgtcaactaacaaaagtttcattgtttgttactctatctgtctcaaaatataaaatatgtcccatccaaccaaattcgcttatattttaggatgaagggagtatccaagtatgtcacattttatttggcacctatcacagtcacacctcactccacacagttcgtatgatttttttaactcatatccatgatgaaatgtggcaaacatggttcgaacccaagacctctatctttattcaaaaccttctttccatcttattggtatttcttaacggctttactagaaatataattcccagcaatggcacacaaatacttctggtatattatggttgcagagtttatccgcaagcacacggatataccattgtagcatttcacccgagagtattccaagggtatcgtatttattttatcccgtgggaagatcaagtagagagaactcgactaataatttatatattacttgtgataattatattctaagcaggggttaagataatccaagggtagagtgacacacaagcattaactactcattctcataatatattatctaagctaagtggaaagaaaagagaaagaaaatctattcctatacttctaatatacatagtatacatacattctagttaactgatatattcgctaataccctctatccgatgccctcctggtacttcgagaagccacccctgattgccgagttccttacgacagcccgtcatgagcatacaaccggggctaaatacggaggaataccctccccagggaattaacttaggattatataccggcgcggaggaatacccgtactgagctgtcaccatcagcggccgacctctcatccgcaatatataaccccaaataatgtaatcccgtaatctagacaccacgtctaaactaccagatactactctaatatcatcgtcatgacatagagtaattgcataagcaaacactacacccgcagcaaagcatctcaaagataagctagccgtatattcagtataacatgaacataatgtaaagtaggtactcatatactcggaaagtatttcaataccataaatgtataaagaagagtattctaataaaagtacaaagctgacaaaataaaagagaaaagctaatagagccatacccgaactcttccgaagacttccgaactcctgatttctactctattcctattccaccagctagatactacaaaactaaacttgagagaaatgagagagctattgcttgaggtgtgtgagtgaagtgaggatgagagctcctttttatagcctcccaatgacggttgtgacggttggaatggtcggtaataccctccaaccgtcattagggagccatctcagccgtccaggagaaccctggatcaaacgaagctgcggggcattcggccgaacccaattgttcggccgaaccatgggctgggccgacctggcacaatttcggcaggcagcctcctcttttgctctcatacgcagacttctgaattttggcccaattcatcgtgccaattctaagttcttggcccattcatacataagtctgattgt

SEQ ID NO: 32865 - DNA, 28390 bp, Oryza sativa
acagtgtttgttgatcaggagctgctactatgctatatatctctgcaaggtatatgtactctctctcagattaaataatctttggcacggtggcttacccttaccctgattcccacgaaacactgcttttccttgccttgagcgttttgaaagatagaacagtaattagagcaccagtcacccaatctttattcaactcttattccagaagttttcaaatgattttgcaaaagaaagctaagttcctcaaatgattcactcagtctctctaagtgtatcaaaatgaattcctcaccaattgttgcctttctgatgcctactctaaggttttaatatgtagagctcggtagggatcaaacatggcatacttgcattcacatttattactaagtcaaaaacttagactaaatatactcaagatcaagatcgtgcaatgtgtgtgtggtatatggtggaaatggtatatagaggaaaataaagaaaaagcttctcctttgtgcttactttcttctcccaaaaaaatccttcttttattgattaggagagggcatgattacatttcttttttttcaacataatgctcatgcttgatggagcataactttattttatttatttattatttttttttcataaccatgcctttccctcctttttttaaaaggatatttctttctttaggagaagaaaacacatgaaagcatggagaatttattttggtggtaatatggaaatggaatggaatattgcttagctcccagtgtaggagtttggcatgtgcatatatgtggatgtatgatcttgatcatagagcatgagaagtatctacacaagtcacaagagtttgacaaagttcagtggaatggcaagtaaccaaaatgtatatggtttaatcatgataacataattttggctctggtaggaatttatatcaaatgaggaactttcaattttatcattttgaaaaacaaaacatccgaaattcaagtcaaactagtatcaggatcatagcaactcatatttactatctcatatctcgcaacaacttagacttagatcaacaagcgcatctcatttacatcaggttcccggataattttttgctacttatatttgacctttgagagagcacctaccaagaacccatatatcagagatataaaacagagcaactatttattatttcaacaaagagaactagcttgtcttacctagcatgactcaaacctatcatatctttttggtattctctattttgcaaattttttatgctgttttcaagttttataagatacaattggaaagcaaatatgcaattggaaagggaaatatgcaatgtgatacaagttacctcagtggggggagagatatctccccccaagcttggcgtttgctcagggtccttgataaggattgaacccctgaaaacggaagtatgcttgaaggtcatcatgctattgctgcatcatgttgttgaagttggcgaactgagcatcagcagattgttgccattcttgcgtttgagctatgtgttccgtgaggttgtactggatctctctcgtctgcatatcaagggtgtccattctcctagtgatttcacccaagtcccaacgagaggaacttgagcgacattcacttggagatggaggcacaccacttgatctgggaggttgattgtccccccattggatgtcatgaggcgcatgccacaggtccacactggcacttacccaggttgagactctgatactgtgacgtggagcttgggtccatctgggtgcgtccccagttggctcccaacctacctcatacatctgcacggctgttgaggattatgaactttctcgttcgttccttgtcatgttgcacgtctccctgtatgctccacctgcatgagattcttttatgttctgcaggggaatggttagttcatggcagttgtacaaatgataccccgtatttggcaacgggatttcatttgtacaatcggggaataagtaaatcaaagatttatttactccatgtttcagaatgtgcccttgcactaaataagcctcatcaatacacggacaagcggctgagataaaagcaatttggtcgctaacgacccctagcccttttgctatccgagtaatcagagaagtgcactcaacaggagcagagaactttatactttctaaccattgccttatcatacatttcacaggagcaattttgatctttctaaccatggcaaatatgataatcaattcatctcccctaatgggcctcagatcacctctaggaaacaaggtcatagcaatccatttgtgcatgagcctaagtgtaggattatggatatcattcgttctagctttcttgcaaattggagcaccagaaatgtcttcccaaaacttatttttctcgaacccataaattcctttctggagatcgattttacaggaatcgtgaaaaccaagaagtgtacttaagcttttccatgtaagtgtgtactttttatggaaaaagcgaaaggaaattccatcttctatttctttcaaagtgcacagaaattgcaaagtaagcagacgagaaccaggctcatctaccacagcaaatctctgccaaccaacaactttccaaacagtacgaaattcaacatccatacctatctttttagcagctccggtgagtattcttgcgtgtgagcatactcccggtcgctcagcatgtagtaggcttgtctctcccgatcactgacaaagtcgaggtcggtgtcgtttaggagtcgttgcggagcttcagtgtcttccatcgagacatctgctgatgaacgagtactagactcgtcataacgacttgatgaagaaccggaccccttgaacagacgagacagtcgcctcctcattctgcacaacggagcaagaatggactaactcggcgggggttaggaatgacaagaatttcacccgccggttagtttcaccaaagcaacttgtatatatgcaactaagtgtttgaatttgagggaaactatcaaagcttgaatgaacttgagagcaaactttggagagggaatgaaaatgtgtcgaaatggggtggaattccctctctcggccggttggcttaagtagtgcacccaaaaaccgacctatggggcccactagcagttgcctcaaagaaggaggcagtcgaccgttggcctggctagttcggccgaacaagtgggttcggccgaacccacagtgggcccaagcggccccactttcggtcgttgggttccaacggtcagtgtggtcgtggcacagcgaattttcattgaaaattttattttggtttgctctgaaaaattcatttaaagaatttcctccaaattcaaaaatcctaaatgcaactttgaaattcaaacatgtgattatgcaaaaattcaaattgttgaaagcaaatatgcggatacataccaaattacctgttggcgaagatcacgtcatttaaagtccggcgtacaagactgtacctccatctagttcagttagtggattttccacccgtatcaggaggtgatggagcgggtgtctttggcttctccctccacaccttctttggttttggtgcagacggtggcttcttctaagccggcttctcttgcttcttagtcggtatgggtggttttaccggcgtcttccaataacggttcctgggcattgttgtgtccttctccaggaaattctgcatgaatttcaccaggctgtccgttttgggtggctccacttcgacctcttgaatattctgtcggttcggcccgtactttattctgaccatggagcattgttccgtcctcggttgaaactcaaaatatatggtgcaaacatcgtaacaaggtttacagtacatatttttcctcatgtgtcttggttcatctaacccatcgtgtgggtctaaaactaaaaaccgacacatataacaacttataagtgccgatctattaaaaaccgacactattagaaaaaccagaacttatatactagataaagtgtcgagccgaaccacatgcaaccgagctctcacccttatcctcttgtccccctcgcctgtctcctatcatcgctgtcacccctctctcgccatctctgtctccttggcacggcaagcggcagagctgcctcccttcacctaagccagcgaggggtagcctagaacccccaccagcctccaccagattcggttgttgcggatacttttctcgctagttgcgttgcctccacctcctcttaaccaagctagagagtgttggcctagatatccctgttagccttcgccagatccaatcaccatcgatggtggggaacgggacgctccaagcatcggctttagtttgaactgatgcatcgaactgagctaggtttatttctttcattcgtggaacctcaaaggtgtgccaattcctaaaccaacaccgaccttcttcccatcagtcctgctaatagggtcctggttgtgaaattcggcacctaagtaggattcccaaccagcagccatcgggtgagttacactgcaactacaatgtaattacattgtaactaacaatataagtacattataactatattgtaacctctatagaacttatttatgaagttacataaaattctttaatacttgtatatatacaggttatataaaagttataatgcaattacagtatagttacagtataattatattaccattataatataatagcatttgaaacatttccactaaaagacttgtggttgtttttttagatagtctcttcaaattattcgtggtaatctattgacaccaaatttaacttcaatatatggaaaaatttgctacaggacattgttcttcctatctttattcccattcttcttccttgcagcagagcagaggcgcgacggcgggtggcctgagccgggacggctcggccacggcggggcggaggcgggggcggccacggcggggcggcggcgggaagatgacgaagctggccgctgccgccgtcgagctcccgccgctcgccgatgtctccgccttctctacgacgacgtcggtggctcgcctcgccttgcgtgacaccacgcaaaccaccacgaccatggacaccagcagcgcggcggcgacggagagcatcacggcgagcaccagcctcggccagctttgtcatctacccaccgttgccccaccgccgccccaccgtggccgagccgtccaggctcgggccagccgccggcctcgatatggagcaaggacatgacgttctcctttggcaacatcctggcggcgatagagcacttcaacgacgcgtactgcatcggcaaggggagcttcgggactgtgtaccgcgccgacctcgacggcgggcgcgtcgtcgccgtgaagcggctcgacgcgtcggagaccggcgacgcgtgctgcggcagttgatgccggtgagcgtcatgacgtagaacgtcggcaccgaggggatgcggcgcatcagtgtgaacgagaagccggccgccgtgttgctgctgttgggcgcaccgagggccatgaaaagcgtcgcgttgctgtcgaacaagaagaacagagaaagagaggaagaagaatagagaaagagagattgacaagtgggcccatgggcaaacttgtctttaaccaaagtttctctctccgttttcatcaaaaataataaaatattgggaggagtgtccagcagctaattaccacttttttacagtgtccacgagcaaatacacgatcttcgagtgtctcacagtaaagaccacaatctttgagtgtcctgtagcaaattttgcctcaatatattcatggtagtatgtcacacctggagttttcccctttcccatagttccaattcaccaataaatcgtctaaagaaattactttggttaacaaggagaaaatcaaaattaacaatgtatttaacaacctgaattgtcagggagaattttttttgaattctctttgctttaaaatcactaacaggacttaaagaggaagttaaagagcatcggagttaatgtggttaattaaaaatttgtcaagttttgaagtaataatagtttttccccgcctttggtcgtgaatcgtgcccgattcactcccctctctgtccacggtttcgttttgcatggttcgccatgtccgttatcgttcgcgggaccgttttcgttcttttcctaaaacgacaccgcatttgttttcctttttgggaaagtcctaatcctattctccttctccaatttttttcctcccctccccctctcccactcggccgccgcccctccacctcggccgcgcgtgcctcccctctgccataccgagtcggtctcctctccctctcccctgccgactcccctcctctcccctccggccccacctattttatctccacccctatataagccaccataccccttcgtttttccctgttcttcattttgttggagtcctagctctagccgccagccacctcctgtagccgccgcctccccattgtcgccgtcgtcgcccttgcatcactggtaatccgtttcaccatctccgtgtcatggctatcgccattacctatccatttcttatttgttttcgtcctaggttttgatccaacgtcgttgtcgccttcgcgtgttgccgttggaccatcgtcgtcgtttccttctcgccgatcgcctcagtttggtgaggaacctatccgtaattctctgttttaggtgttgtttctttttagcgtcattgtggaaaccgtagttgtttagcccgagccgccgctgccgtccgtgccctggcgctgtcgtcgccttgccgccgctgccgcgccacctcctgttgccacgccgccgccttagccgccgccgtcgctgccgctagccgatcccaagccgagccgagccgccgccgccgttgttctaggcgccgccgccactctcccgcgtcgccgtcgtagtttgccgttgtgtcgtagctcggtagccgaatagcaaagccttaggtgcagccctaaactcataccggcctatcgtttgccgtaccgagtctctaccgtaaactgtgtctagttttttgttgtcattccaagccgccgattccgttcgccggttcggttgaccgttgggatggccccatggcacgataagttgactcgttgagtcactaattcttgaggctttcttaccggaggtataattccattgatctatttatctatgggcaataatgtgtaataattgactaaggttttttcggttattagtaataacgcagctcatcttttaaaattcagaacttaataatccgagctccgttttaatccattcaaattgcagtgaatccgttaaaaagtatagaatccattaaaatttgtttattttgctatttcagtagacttattgcttgtatcacctgtgtgctttgtttgtcgtttagattccgtcagttccggtgatccagtttatttcgaagtggttgccgaggttcagtcagctcaagagcaaggcaagtcatacatacatcattgattatattgagcctattttacaaaatcccctgctttctattaaaattgcattgttttagaatgtcatgtggtatggatgccttttattctcagcctgatgaatatcttgtgcctttgataacttgggttatatttgatttattataatttagtccttaattactttatgtacaccaccatggttatggtttaattaaattaaaatttgctttaatggtgggtcgtgggtacatgcatgattttctggaagtcgtgcccatgacaattaaggaccggtttctcgggaatccctagaagatatactcgtactcaccacaggccagatgagctccaggctaaatctagagtataacttaaactagataacataccatggcaagggtagaggcgatggtgcagttcagacctggattttggtctctactatagccagatttacctaggcacgagaggggactgcccgacttcgaataaggagggggtgaaacctgaggtgcatatgttcggttagggagggttatatgacgggttttgtcacgatttccccctttgcagtatctcggtggtacttcggggcatggtaacatgtatggaatcgtgtctagtgggtaaagttgtgcacctctgatcagagtaaaactattcgaatagccgtgcccgcggttattgggcggtcaaccagctcaccgtgattagtcccactataacaatttgacttatagaactggtgtagtttaggtggttttggttggccctgttgcgacgtgatttagcgttggacagtgatgatgttaatactccttaattacttatattgtttttacttctttcaaatcatgctttataaatgctgattttactgcaaactatcctatgagccattcatttgaatatccttgcatcataccttccccttggtatggcttgttgagtacagtggttggtacttagtcttgctttttttcccccaccccaggagcagaagttggttcagatggtgagttctctgaggattgagcttgttctggacatcgaggattgtatggagaaagcttcgctttggtcgtgaagattaagtttatttctttagttctttagattaaataaaaaaatgagggttataaatttattttgttattttttaagtcgtggaactgtatcaaattgtcgtttgtgtaccctgactggtcttggatagggatttaatacacatcctgcttgagattcgggttgtcgaatttctgggcgtgacatagcataaactgatatatgcaattatgcattgaacatgcatgatacatataattatttactacgtacatacatatgtggcattagaatacacatattgaaattacgcagttgggtatgaaggctccatggcaagcccacacatgcccctcttgtcggaaatgtctttctccattctcaggaagccattctcaccccatgttgtgccccaggagttcttcagcaaccaatattgtgtgccatcaccgtccttgccatagccaatggctacaatcccatggtctaagtcagtgccgcatgagccggtcatcacgccaccagagtagaactggaatgtcatgtcgcctccatccacggcaacagaaacaggttggtttgccacggccttcatgagtgcggcctcattgttagctggcacatcctcgtagcccttgattgttgcggcgctgttggatccaccattgcacttgccgtctgccgctgtgtatgggtacttagactcagtggtgaggccaccattcttgatgatgaatttgaaggcatcatccatgagccctccctcgcagccctgatcctcgccatgaacatcgcagtcaacaagctcttgctcagagagggagataagcttgcccgtgctcaacttgacaataccctccatggctgccacggccgaaaatgcccagcaacaacctacaataattattcatgtttacactttcgattcaatacattttacagatgatttgtaaaatgttgcagtggcaaagtggcttgaattttcttaccacactggccttggtccttgatgggtgtgacagcgcccttggttctccagtccacggttgctggaagcgtgtcaatgctaacattctcatacctgaatgtggtaggaaccctaaccgtgctaggaatgaatcccttgttggtcttcgtcgcccggaactcatagttggtgaggtcagcgaactggttaacgccgagccaaaacttgtggttgcctgcattgaacgactcgatgaatgcgacgttggctttgaatatctcaaatcgacgtgccttctcagtagcatccttgtacacccgcccatactgttccatccacctctcgtgcctcgccaccatggctgcgtggtcgctctgctcgcgagctgctagaacagcgctgcagaggcagaggcagctgaggatggcaaagagcagagccttggggatggccatggttgatcagactttgtcagtggttgctcactactgcttctgatctgtactcgtttggttgatggctttgggttgtgaagtggatatagcatggcatgggttaatatactagcttaggagagcttagattaagtaattaatttgtacatcccgtgcttgtgtgatgttgtagacagggatgtctgcgtagcagagaagttactctgtatgtaagctcgtcagtgaacgtacgctagcttcgtagtaagataatgtacgctttgctcaccatgttcacacttactaattactgatgatctcgtcgagcaaatgctaatacaatgaaattctgaacatagatacagtaatgttagagctgtttcccttattttatatctgtactagatcctcatgcatgtgacttatttattttataacagttacagtattggtatgaaaccggattgcatatctgaaatgttgtgaaaagatttcatcttcatcatgattcgtaaaacaagagttcctcatgtctcatggtagtgtcttttgcaatttacatgttaatctttattcccattacttggagttaacattatttttagtacggatatttaattacctagtttatgttatttcctatttgggttctacagcttgaatttacaaaattttagagacaagtttcacttgatttggactttatttgaattacctatgagttttcaaattttaattcatatttctcttcacagaaataatctctcaagtcattttaaactaattttccgaaattacccttctgggagacgttagaatcactgacagcaggggtctacgggttaatattcctatttgaaattattttctctaaggaaaagggcatgtggtattgacatgtggggccggggttatagttgaccatgccatggtggccatagagaccacacgtcagtgacaccatatcttaaacaagattttaatcagtttcttccacgggtatgggcccacatgtcatcgactgattagagagggattcgaggagggcttattgttgtggattagggaaggtgggaccggggtagcgctactggagaaaccatctttggtcggttggccaaatttcacaatagtccgggttgtattaaacaccgggactaaagagcatttttagtcccggttcaaaagagggcaggtagtggacccctatattttctttagtttcggttgtccaaccgggactaaatatctatttgggttgtttcttttttttttgaaaatttgttattcggatctgagatgtatttgatttgtgtgtgatgtgaatacgtgatatatttgtgatgaattttgtagaacatgtgatgtaatttttttaagattttgtgatgtatttggagatgatcgatttgaggatttggaggtgataattgatttgagattttacgattcggggatgattgatttgggattcggggatggggtgaaatcaatatattaaaaacaatgaagaaaagaaaaaaaataaaggagcaaccagatctagcccggctccatctttaatcccggttggtggtaccaaccgggactaaaagggctccatctttagtcccggttggtgttaaaaatgaatttttactcctggttatttcaccctggactaaagatagcaatctttagtcccggattcatagtctcggttggaaaaccggaactacagggggttaccaaccgggagtaaaaaccacttctccatcagtgtaggcccacatgtcggtccaaggaaacgcaaaattttatcccctttctcttctttcattccagcgggcgatcgcgatggcaaagcgacctatagtagtgatgattctccagcggattggaggaggtgaggtggccggcgctgggagtgctcaccatgcagcggccgcatagcggaggaaccgggctcggggaagaagtggtagcatctggctccagcgtcaggcggcgccttctcctccaagaagagaaaaaccaagtagctagatttgtttgcaaaaattgtatttaatttgcgtttatgcatgaattatggaagtattatgtaagctactctatgtgtaatgtgtttgaatagttatgatatgaactttattgatgtgcggaatatatcatgtgcacacaagatttacacattgtgcataccaactaacaaatgtcacaataaaacttagaaaataatattgtactatgtacttacaataatattacacttatgtgtaatgttttcacccccaaattcattatattttacccataacgaaaaagaaaaaattctgacagttttgaagtacaaatatgtcataatttgatattttttgtctctccctatacaattaatttaaagatgatactttacacggaattgtgtaaattgcacccacgatacaacaacttggcaggtgggtgcgatatagtgcaagaacttgagaattgaacgtccgagtgcaacaacttgataagtatgtgtgttctagtataagaacttgacaatttagtattttggtgcatcaacttggctaagcatatgctatgtgagtttttttcacgatgtaaatatgccattacacagtattcctacagatattaccttataatattgaatttaatctttaagaattatactgcacacacaatttacatccaattacctttaagatttttttattttcttcaccttctcaaatatcaaccgaaatataataatttctacatccagtttaattgactttaagttattagtaattaggataaaaaaatataaatatgcttatacaaatccgcgctagtatattgtcaaaataagtacttaaaaaattgaatttatataaaaaaatgctccaaataattaagttgtcatgtactttcttaatttattgtatcaaaatcgtacctaccttacaggttgttgcatttatactaaattgcaccttcctgccaagttgttgtactagaacgctcatttctcaatttattgtaccaaattgcacccacctgctaagttgttgcaccgtgggtgcaatttactcttgtaataatattaatagaaaaattttaaatattttttggttggtatgtgcagtgtgtacacaaaaagacttgtgtgtgttagtatgtggatgtggatgttgtatgtggaatttttgtgatggtatgatttgtatgggaaattggtaggtcctgtaatttttttttcttgccagcatcttggtgcaggtttttattttttcaaaggaaggtgcgggttttaattacaaaccggcacgtatattctttgccacgtgtgtaggtcagtcaacaacctgcacctatatgctatttatgtacaggtgccggttgttttaaagaaccggcatctatatggatagcaacgtggcacgttagtttagaaccgacacctataatgccatatatgtgttagttcttacctaaaatccaacacctatatgtcttataggtgcctgttctacatccatattctaaactatagctggttcccaaccaaagtcatcagtgtgctaggtactggttgagaaatctggctcctatgactagttcccaagcaacacctaacatgttttctctagtattgtggtttgatttgattgactaatgttataattgcttgctatttaatcagtcactgaacctaatcagcaacagaaaaatcttcattcggctaattgctcaattaataaccgagttaaaccaactagccagtcgctcgtgcggtgcgactggatcaagtatacgactttgggttatttgccgtagctcaactccattaacttggaagaaaacggggagaaaataaaaccacttttaaggataatggttggggcatgtactgcaattttagggtcaacataccccactaccaatgttttctatcattacatagtgagagttaagattgtattcaaggtggcacaacggtctagtaatgtatttttgaagaatatggctaatgcaatgttagagaaatttgataaatattgggacagcacaaacaatatcatggttattgctacagtccttgatcaaaatgagatacattaaattgttcttcggaaaaaattatgactgcataagagctagcatacagcttgatgccatcactggtgagttggataagctatgaaagacattcgagaagatctatcgccagaaagtaggtgacaataacccacacgatgctcattcagcctcatcttggaaggatgcatgcaactctttggcttctattgttccaagtggattccagtcctctttgcaatctaatgctactgaatcttcaaagtatgaataactcatctatgttgatgaagcaactgtgcccatagataataatgcattcaacttacttggttattggaaggtaaatgctcataggtctcctgttttgtcgagtatggcaacgaatttcttttttttggctattcaagctagcagtgttttatcacagttcacttttagcactggacgtagagttatcgatgactatatgagttcaggcattggtttgtgctcaagttggataagagaccctcaaaatgagaatagttatccaaatacttgtggtttgtgtcgacgggtgatacccgtagaccggatatagagggtattggggtacgctggtacaaggatctacgtagtacgacatcgagcaatcaaaagacaagaattttactggttcaggccccttgataggtaatagccctaatccagttgacatgggattatatggtggaaaacacaggttacaaaggaaaagatggaactcggggggtttggcgagattgtagtcgagttgattcgactagctctcgtcgacttggctcctcgcaggctccggcttcgtaggctgtgtgggttgtgttggctctgagattcgatgatccatggcctccccggggggttccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccacgtacgcatagatatgccatgtcgttacgtgacgtacaccgaagggtagagggtatgcctgacccgtaaccctgacagtagcccccgacttctgctcaacaatgaactcgtacgaccattcgcgacttcaggtgtcgagaacgttgtcattccaggtgcgagaaccacggagatgatgtgtagtcgagcataccatttgaacccaacggtcacgagtgaattttgaactgaagtcaaaaaactgccacacgtaacggacctagaaatttccagcggggatttctctccgttccttggaattcgcaccatcgggagtgcggttatttaaagggattttgggtgcgcgttttgaagtccgcccactttgtcaagcacacactgctcattaacgctcctcgccttcttcgctgtcgcaaaaaaccctagcttcgtcagttttcgttcatctccggcgatcttccagcgacgatggatcttggcaagtcggcttccaccagcgcaaccctgaagaagctccaagaggatggcgcccttcctggccgtgaaaaggcagagagggaagcaggaggtactaatccacagcccctcttaggtcgcatggttgcgatcgaagactatgttgtctgcgggtttcttcctcccccctctgaattccttctgctagtctttaatttctatgggctttcacttctgcacttgaaccccaactccattgctttccttagtgtctttgtgcatctttatgaggcctacattggggtagagccctttcttgacctgttccgcttctactacgagttgcgctggatggaatccaatagggtgtctggatgcgtcgggttccgacttcgtgacggaatgaagtcgcggtatgtccccttccagtgtccctcttctcgcagtaaatggcggaacaggtggttttatcttgaggtcaaggattcggatccagtccttgttgttcccgaggagcaaccggacaaaattccggtttggaccgccaagccccctttgaccccctctctcgaatcgtttatcgacatcatcgatgatctccgagaacggggcttatcgggatatgaagtcgttgcagacttcgtcgggaggcgaatccagccgctccaggctcgggcccacccggcttataactattccggggcagatgacgcgacccgggtttctcctcggggtatccttctcgcattcattttgatatgcttgtactcacattccttttcgacttatcaaaaattgattctttcttgacaggtctgagcggcgaagtcgtgggacggcgcgtgagtcaagtaatgatcagcggcccgacaacagcgagcgacatccccgcgcccctttgtgaaagggaagcagcggagcgcgacgaggcaatcaatgtgagttcatttgataagcgtccgcctcccttgcacaaaatcggcttatgacatgatttagcgtaggcccttcctttgactgatgtcatcggtccgctcgcggatcatcaggtggcggcgtctctgaaggagaaggtcatccaggaggcgtccgatgctgccaccactagtggtggcaaagctccgactaagacgaggaaattctcatctgtactcggaaatcgccgcaaggcagaaactcccttggtaatttcctccttgtcattaggttgtgtagcgaggaaagtttgttctcactctttatcggttgtcttgtaggcttccgacgtgtctcctccgcccgcgcgacgtcagcgtattgtgacgatccgcgagaagtaagtgaagaatttttagactctcatatcttctgtttgagcggagttttgattcatggcggttaacagggaggcgcggtcgaaagctgctcggggcaagtctggggaaacgtccggcgcgtcccctgtcacggcgtcaacagatgttgtgcccgtggtcgggagtcgggaggcgacaccgaacggccccgtgggagatcccgtcgagggctgcggtctgtcagaggccgtcctcacctgggaggagcgccacgtcgagatgaggcgccttctcaaagccggtgcttgcggcgtggggcgcgaggtctcggaggcgagggcggagacggcggcggccaatgcgcgtgcggagctcttggtgcgggaactggctgaagcccgcgaggacctcacgaagatgagggagctggtggccggcaacgagcgccagcgcaaagggctcgaggaccgcatgtcggaactcggggataacctctccgagatccgtggttcgctgcgggtcacctacaccggtctccaccaacttgctgaggagtgcggcgtcaagtcctcgatcccggcgaaccccgacgagttctcgttgacctcttctcttgcggagctggcgacggcgatgggggaaatcccctccaggcacgtggccaggatcgcggaggagacgtccaacggtatctataccggggcgtgtcacgtcctcgcatgcgtgaagttgtcgtgtcctgaactcgatctgcgcgagatcttggatcagggagcggcaagcgacgcgcgcaaggaggtgatggaggaagtcggtgacctgggggagtatgtcctccccctttttgaagagtaggatctcttgtatattttttttctgacttgtaaatcttaaactctggttgccttcgtgcgcatgattaccatctttgttcaccgttgatctcggaaatctctcttatcgactgtagagatgctgatgacgaggatgtccggcaacgtgggcagcctgagtcactggcgataattccggtactcgagtttgaactgcacgcctcacatgacgtcgaggaccaaactcctgatgcggaggttgaagtgacgacaactgcctcaagtgagtagcctatcaaccttatcgttgttttgggggtttccgggttgtcttagtggtcgttacgtttagcagatctcgaggatgcccttgcgacccaaaatcgtcgtatccaatactggaagacgaaatttgaagtggcggaactcgagagagcaatgctagccgtaaagaatgagaaagctgtggaaacgctccgaggccgcgaggtgtggttctcgtcttacttgcagagttgctgcaccacgatggctagggtgtgccgggagttcgggtagtccgcggtgatcctaaggaatcggcggccgggtacatctcgtggctcaacggggcctgtgcccaactcaatggcattggcaagcgaatcgacgaggccttgaagcaagagtgtcgtcgagcgagccgatatgccggaggacacatgctggcttgcctgcgagatcaccgcccgcgcttggatctcgaatttttacgtgaaggttttttacattctcggaggaacccggcggagatagatcaccttgcgaggtcgatgtcgccgttggccgagaagattttccaatcaatggactggcgttggccgtcttggtaatgtttgtatcctgcgaccaaatattttaggggaagatgtaatgcagcgaaatatctatgtataaactgtaaggaatgttttgtgaataaagaaattaatctttaacaaatgttttcttactctggatgttgtgcataagagtgtgttctcagttaacgactttggttagccgtttgagtcgtacactctccctagcccccagccttgtcgtcggagggatttcctcaggtggcaaggctcttagacccttggcatgtcttggttgaataagctctgatcctagcccccagtcgtgaaggtggaaagctcggttttcgattacacggcttggttaatacgcacggcgagaactcttacacgaccagatctgacatggtcttttgtctctgaaggatctgataaggccttatcggctctgggcgtccctagccgaagatcccttaggttcctcggaggccttgtcgagacggcgtaaagggacataaggacaggtttcaacgctaggtgtcgtcagagtaaggggtcattgggtgaaaacactttggtcgtcatatgagaccaaggaataggctttattgatactgtaagggtgcttacaggtatagcggtattgactcatacatagaatttacgtagttggtcaatgttccacgaatttgctagttcgcgaccgtcgccgtcggcgattttgaatgcgcctggccgcaagacttgtgtgatcgtgttgggtccttcccattttggtgagagtttgtttcgccccgcttgagtttgaactcgcctgaggacatagtcgccgatcgaaagtatgcgtgctcggatgcgcttctcatgataacggcggagggcttgttgatagctagctgctcggacggcaactcgctcacgatgctcctcgagaaggtttacatcgatatctcgctgattctcctggttctcgtcggaatgcttctgtactcgtgtgctttgatgccgtaactcgtcggggagcatggcttcagaaccgtacacgaggaagaagggtgtttccttattggacgttgtcggtgtagtgcgcacggcccatagtactgatgggagttcttcaacccattttttgtcgtgtgacatgagtctgtcgtagacgcgggttttaatcccttgtagtactatgccgttcgccctttcggcttgtccattgctttgagggtgagagaccgaggcgaaacatattttgactcccaagccgatgcagtaatcctggaaatcggcgctgatgaattgagagccgttgtcggttatgatgcggtgcggtagtccgtatctgcaaaatatccctctgacgaacttgatggcgttatcggccttgatttccccggtgggtactgcttcgatccacttggtgaacttgttgatcgccacaaataggaatctgtagccgccctgtcctcgtgggaatggaccaagtatgtctagcccccagcatgagaacggccaagtcagagggatagtctggagcgcttgtgcaggcagctttttgtgcttgctgtggaattgacaggcttcacatcgctggaccatgtcgcatgcatctttaagggctgttggccagaagaacccttgtcgaaaggctttgccgaccaatgttcgaccggcggcatgtgacccgcatatgccttcatgtatgtcgaggaggagttgtttgccgtcgtcggtagagacgcatttgagaaatatcccatttggcgctttttttgtataaatcgttgccgatcatacagtaaatctttgctttgcgggttattttctcagcctctgtatcgtcttcgggtaactcctcgctgccgatgaatttgattaatgggctgcgccagtcgtctgtagtttcgatgtcagcaacttcgcattctgcctcagtgacctctgagctgatgtcgggggtgctcgggccaacttcgccgctaacttctttcaccgatggctttgtcagaacgtcgagaaaagtgccgggctcgagcggctctcgtctggatgcgcgtcgtgctaggtcatctggctcgacgttgtccttgcggtagacgtgccgaacctcgatcccatcgaacctcctctctagctttctgacttctgagagatacttggataactcggggttggagcatttgtagtctttgtgcacctggtttgcgactagctcagagtcccctttgatgattagtcgcttggccccaagtgcggctgcagctcgtatcccggcgagtagtccttcgtattctgcagtgttattggttgccctgaagttgaggtggatcgcgtgtttgaattgatctccagaaggagatgttaagataaatcctgcccctgctccttggctgttgagtgcgccatcgaacgccattgtccatgtctcattttcgccttggctgtctgacttgttatctggtatggtccaatcggccacgaagtcggcaagcacatgagatttgatggctgtttgcggcacaaagtggatatcaaattggcttagctcgactacccattttgcgatgcggccgacaacgtctttgtttctcacaacttcgccgagtgggaaggaggagacaactgtgactctgtgggcttgaaagtagtggcgtagcttccttgatgtcatgattactgcgtagagcagtttttgaatctatggatatcttgtctttgcgtcatggagagcttcgctgacgtaataaactggtcgctgcactttctctctctcaacgacaatgacggtgctaacggaatatggcgtagcggcaatataaaggaataattcttcattaggttggggagcaacgagtacagggggttttgataggtagcgcttgagtgcaataaatgcctcctcagcttcctgtgtccatacgaatttgtcttgtttcttcagcaaggcgaagaaaggctgtcctcgttctcccatcctggcgacgaatctgcttaatgctgccatacatccggttagcttctgtacctccttaagtcttgtgggcgacttcatgttctcaattgctttgatcttctcgggattcgcctctattcctctgccagaaacgaggaatccgagtaacttgcccgacggtactccgaacgtgcacttctctgggttgagcatgaggcgatatcgtcgggggttgtcgaacgtttcccgcaggtcatcgatcaatgagtcgcttgtcttggttttgacaacgatatcgtcgacataagcctcgacattgttgccaagctggttgctaagtgcgccctggaccgtgcgctggaaggtattcccggcggttatcagtccgaaaggcatcttaacgtaacaaaataccccgaatggcgtgatgaacactgttttctcctcgtcctctttcaccatactgatttggtggtaaccggagtaagcgtcgaggaagcttaaaagctcgcatccggctgttgaatccaccaactggtctattcaagggagaggaaagtgatccttggggcaggccttgttgaggtctgtgaagtcgacacacattctccattttccgttggccttccgcaccatgactgggttggctagccactctggatgaagtacttctctgatgaagccggctttgagaagtttgtcgagctcttctcgtatggcttgttttcaatctggtgcaaatctccgcagtctttgctttactggcttggcatcaggtcgcaccattagtttgtgctcaatcacctccctggggacccccggcatgtcggacggctgccaagcgaacacatcggcattatcgcggaggaaggtgatgagcgcgagttcctatttctcatctagtgtaaccccgattttgacagtcttgtcggggttagcaataaagagtggaacgatcttgatggcgcggtctggcttcggcgtcttgtttagcttgctcactttcttgggtggctcaaacgtggcgggtggggtgggcatttgctcgaccatgtcgaggctccgcttgtcgcactgcaccgccagttttgcgttcccttgaatagtgattgttcccttcggtcccggtatcttgagcacttgatatgcgtagtgggatgcggccatgaacttcgcaagtgcagttctcccgatgatggcgctgtaagctgtatcgaattcagcgacatcgaaggtgatctactctgttcagaagttgttggcttggccgaaggtcacaggcaacgtaatcttgcccaaaggtctggacgatgattgcggagtaattccatggaagggctgagtggttggtgtcaactcactctgcggaactcccattgcatccagagtgctggcaaagaggaggttgatcgagctgcctccgttgatgagaacccttgctaccttgacgttccgaatggtgggtttgaccacgatcggataccgtcctgggataacagaggtctttgggtggtcttctgccgagaactctattctctgctcagaccacttcatcttgggtgcagccccctgccaagtcgaacagacttcgcgttccactttcttgtattctcacttggaggaatacgttgtggagccaccgaagatgtgtgagacatggaggtcggagtctgggtacgcagaatctgattcgtgaggaggtgactcctcgttcttctcgacaacacgtacccgcttgcctttttcaaacgccatgtgcttctcgagcgactttttaaaaacaaggcaatcctccagagaatgtctgtccgttttgtgtatagggcaccatgatttttttgtatcgctgccttgtgggtctgggcgcttgggagggttcgcgtactctgctgcgaggacttccgcttgagcttttctcttcccgtttttgtgatttttcttcttgcttgactcagatgcgtctgcggttggtttcttctctcccccggtcttcggcttgtcgttcttgcgtcttagcgcgtcatccacgtgggcgcaccgctcaacgatctcgaataacctttgagtagttgtgatgcgtcttgttgccaacacctgggtagtgtagtgatctctgacaccggacttgaaggcgcaaattacagaagcatcggtaatctcgggaattgtgtttctgcactcgttgaagcgtcgaacgtatcccctcaatgattcccccgagttatgtgttaacgcgtgtaagtcgtcttcgatcgcgtggcgcttgtttgttccttggaaattggcgacgaactgttgccataggtctgaccacgaagagattgagtaggaggggagatgcatcagccacgaacgtgcagaacccttccacgcggttggtaaatagttcgccaacgcattgtcatctgctccggcagcataaagcactgtcgagtagacttgaaggaattcttctgggtcggtgctcccatcatacttttcaatagctccgggtcggaatctctcaggccatcggacatcacgtagggaacgacttaaagccctacacccagcactgggagcggtgggttgtcggtggtcgcgtgaccttctggatgtctgtctgacgatgaagaggacgcggatgatgatgatgatgacgatgggtcgcttggttccggcgtacgattacgaggatgacgacctggatctcgggaatcctgtcgtcgtctctcgctgttgtcttgtcacatcttgatttttgtttcaggatttataaattatttaataaattaataatataatttatattaaatgttctttaatttacaagtgaagttaaatgtgggaaataaaatttcttaaatctaaagcatggatggatttaatttttattaaattctccatgattaagtcaactctctgaaatattctcggatttttcggagctcaattcctaaatgatacaaagaacagttcagtaattatttgatcattaatgatctaatgatatttgttaagagcttttcttgtttaaaatccttaaattataaattgttgtttaaaaggaataattagaaaagatcttaaaagcctaaaagagaagatctaattttaatttgctaaatctcaacataaaattgggctagataaaatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagtcggcccaaaaccgctccctctctctcctcggcccagtccggcccagtccgctgagccgccgctcttctctctcggtgtcgctgacaggcgggacccacctgtcagggtcgtcgtcctcctcgcgccgccgccgccgcccgaaaccctagcgcaagccgccgccgtctccttccaaattcggccgatcctttccttctccggccgaatcttttgaggggaaatgatctcctcgatctcctcttccttttctcttatagaaactccggtcaatttcgtttggaaatcgacggacttgagttcgattcggatcgatctctctcctccgaacccttgctttcctccgccgtcgctgaagaccgccggagcaccgtcgccgccgtcgacccgatcttctccggcgctttttcctcgtcgccggcgccgtccgttgcttctccgccgcttctttggtcaccggtgagttcgccgcgtcgcgctctacgtcctggtgctcttcgtttgcgccgccgcgccgtcgttcaccggcgagcatgcgttgccgagccaccgccggtgctgacgtcatcgctgacgtcgttgctgacgtcatcgtcgccgtctgccgtgagccggtcgtggaccaatcgatctcggccgtccgttttggatagggtcgatctcggccgttcgtttccgtgagccgccgccgtgcgcccagttcaccgtgaacccgacccgctgacgcaataatcctcttttccttttcaaaaataattcattattgcgtcataattccattaaaatccatataagtgttttaatccgatttaatctttgaaaattcataactaattcactgtaactcagtttaatgtggttcaagttgcaaaaaattatataaaataaagatctacatattaaaattgtccataaattgaattaaatttatttaattctttttaaatgggctttaattagatttaatcttgtaaaattcgtaataaattcatatgaagtcagaatgaggccgttcaagtctcataattcatctaaaattatgatctacatgtttgtttacttttcatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttacattgattactttattccttgataccttgggtgattataacttgactagttgagctatatatattggttcagctagatattagatatgattgcttagccatgcttagaaacattagcacactattgggataacttatgactcattatttaaggatggtttaatggtagctcatgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatggttcattgcggagcaccagactgagaagtggcggagataagcccacgggggtcgctggggagtccatgcctctggtttttgagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcacaataattatagatgttatacctggtaataatttgcttagctcctggtttggagattagatctgtacagccaggtatggttgcttcagaatggttgggcctgagcagcatgggcgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaataaagatcccgaaggagaagacgtttggcttataccccagttgagctgcctgtgggagtggagccggagcttcgctagattttattttccgctgcagttttcttcttggtgaggactaagtgcctcataagtaagtatttatcattttagttaatttgatgaatctgcatactaaattgtcagtttgtgtacctcggctgattcctggacgaggattatatgcacaaataagttcggaaattactagtgaatttctgggcgtgacatgtctcgacgccgatctccttcatcgtcgtcgttgcggcgacggccatgaccagtgttgtctggcccccgccggtcgcgatcgtcgtagtctcggtcctcgtttggacgatttcctcgatcatggcgtcgtgaggagacatgacgccgggaacggtttgcgtcatcccgtgtgcgtcgtgcttctcggcgaccgttgatttgatctcgaagatcgccagtgccacgaggtggaggggtagcttgttggggtgattccctccgttccggattttcaccattggcgtcgccgactggcgatcgattttgttgtgctgcggtggcggcttcttcgaacgcattgctaaggtcagtcaccgatgcccgtaatcgttccgtccaacgctcgaggtcgttgttcagaacgggatcgtaaggtgtttccctcagtatggcttgaacaaccctgatgtgctgggctggagtagtcgattgattcgccgtctccgcattggcttgtgctgacgtgccaacttcatcgatagccaataccttccgcgccgcgcctgacgtcgatgacccatagtcttcgaggagatgtaagacagatggttcgtggggatcgagatcgattaccccaacgaatcgatctgaggccggagtcgctccttgttccttgccgttatccctgacggggacgtatgacttaggagacggagttttcatggcgccgaggagaactttgcagcttgagaggtcgtgattctttgtcttatggataggacaatagtcgtcccgagttggagaagtacgctgaattccacgttctttgcaggcgcgaatttcagcacggacattgatgaatacccagcaatcttgaaaggtatgtttcttggttttgtggataggacaccaagacctggtagcttcggaagttatccttatcggcccgcgattcatgtcagaaggacaaagcttggccacatcagaatccttcacgagtttggacgtagtcggcaatccgttctccgtttcaacgggtggatttttcgacatggaggcgtcttggttcg

SEQ ID NO: 32866 - DNA, 4945 bp, Oryza sativa
  unsure (1)..(4945): unsure at all n locations
ttatatggtggaaaacacaggttacaaaggaaaagatggaactcggggggtttggcgagattgtagtcgagttgattcgactagctctcgtcgatttggctcctcgcaggctccggcttcgtaggctgtgtgggttgtgttggctctgagattcgatgatccatggcctccccagggggtcccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccgcgtacgcatagatataccatgtcgttacgtgacgtacaccgaagggtagtgggtatgcctgacccgtaaccctgacagtatgtattgctcatttggattgttttcgaatcagttttgtttttcttatgcatttgtatttgtgtacttgtatttagtgcaccaatgctaattattaaactcttttttcaaggggaagatgatgaagatgacactgagtttgtggagtttccacatggtgtggtggcgagcaacttgtaattctttgatggtcttgatgttgaggaggatggtgttgccttgatgctgcttgatagaagaaaggagaattgcttgcgtattttggtgctgatgttggcaatttggcacgaacttttgtgattctgtgaattgtgatggtttgatggacatgaaggactggattgtaatagtaatatttaatctaagctagttgcattgcatggcatagtagcatttttgcatatttgcacggacgatatggacatgttactatcatattatgtcaactatggagtatggatagatggacttatccgttgaagttttccccgttgcatatttgcatggatgatggattgatggacatgtaaataatcatgatcttcatcccctaacttgctggacatgcaatatgggcacgaatgttgatatggctcgtgacctaaaagccagcttgaactggctgtcgagctgagccgagccagcctcctagcacgttactataacgagacgagctgagccaactcggtatgctaacgagctagctaggctgagcccaaccgagctgagctggcttaatattcaccccctagctatgtaccacataatccgcgtgcttattattaggaatgaagagcgtcaataaaatcccaaatttacaaattcatagatggacttattacaaattccatgattggctccatgcatgcatggctctcttgtggagcaattttgttttcttgtttcattattccttctatgttcgcaacacaattacaataatttgaacactattagcagtaaaagggccactcacatttatttcgcagtcgaaaatgttgatggaaatttcttgacacatcaataattttatagtaagtaatacttcatatttaaaataccttctttctagctatatgcacctagactagcccaagtgcttagctagctagaaagatgatattttagagaccgagggagtactagcacaaactgcattgtcaatccaatgagagtactactaaaaattttgttactagaaatctctgatcacattgttaaatgcttttcactttttcagacaggtaattggattttaagaaaatcttttgagcgttgtatgatttcgtttgctactatgttctgtgttattaaattgtccgtacatttttgtttggagtcctttcctgtgttctaccaagggaagtacttctaagtctttgaatttttcatattctgaatggctgcagactatggaacacaaactagctaacccaccccatgtgtggatagaaaaaattgaagtaatagtttcagggtatatgatccttttccattgttcataaaaataattatgattttattcagtatcctattatacgtctttgtatcattaaatgattatgttggatgatacactactggagaaacccacaatagtcttggtttgcaaccccctttagtcccgggttacaaatcgagactaaagatgtcgatctttagtccctgttgttcctgttgaaataaccgggactaaagatttatctttagttccggttggttttttccattgtttgcatattgatttcgaaccaaactcaacaataaaatcattcacattcacataaacatcacaaaatcatcaacaaattcacaaatcgaatgaacatactcaaattgacatcacaaattcacaattcgcatcacaaatttacaaatccaaagacatcacaaatcaacaaattcagagataaatcaacaaataaataaataaatcatccactcgtcgacgccagagctaatgccgcgcgggctgctgccgcccccgcgcaggccgccttcgctcgctcctcgctactcccgcaaggataagagagaggaaagagaaagagaggagagagaggaggaaattaaagatgaggaaaagggaggaggagtggaggagaggataagtgtggaggagaggatatacagggggacccataggttcccggtatgcactggcatacccataagtttgaaaattttgctaggatcagctctgcaccaggaagtcaggaactatgcaggtgtatgcagtatgcagtaggctgcttgctcaatgctcctactgtactactagtagacttcctttctctctctcaatgcacgagctccaaagcaagcaagctagctagtactgtagtacgtacttcagctgtcagctactcagctgtcaagctactcagctgccaagctactcctgccaatgctttgatttggtttgaccttttatatatatctattgttaggttaatctactgtttgtattattctcctaaccatctattgcatcaagtctcgtagtactactttactaacagatttgaatcatctccaattcaccaattgtagcttaattttgaatatattaattgactttgagaaatcgacatcctaattgttttaaagaagattttgcatgatttgaatttagagtttagatagaatcaatatattgacattgttatcaattgaaaagatcgttttgatgaagaaaccaattaaattagttggttgtaatttctattttcattcaatacatatgagatgatggtttaatttctatagtaactttgcatgtataatttgatattgggattgcctttatttgtatcatgtaacttagatttccaattctacttatattattgtatgagagatatgtatatatgtattagtgcatacccagtgtagcttttctgggtccgccactgattatatataaagcaacaaaagatagtaggggccagatgctttttaaaccgagactgttggtattaaagatcataaagtggcgttgggcttttcaaccagatgctattggaaccggtactaatgtgatttttggccgatccacgaaagattagttctctagtagtgatagtgttgagtgtgattttgtataatgggacgatgcatacggttatctgtttacattgcttgatgaactattgaacttaagagcatttttatttgcaaagagtgacgtggactccatgtgcatagacagcatagtgacttggtataaggaagcaaaacgaactcctgaatataacaacacaaactggactgataacgaactgtatctgaccaacctgacagcagcctcgccatcaatccattagtggaaactagtggtctcactcacaaagatgcttggccgtgcataaacagcctatcagcaaacacataagttgaaacattgtgcttttttagtttttgaaggattgcggaccacaagtaatggatattagtgacatttccaatgtactgcactaacatgtcactcaagttaaaccagccaatggctgaaggtataggtggacgtatatttcatttgctgcaattcacaggacatacccaagttgttaggaagcaataataccgttgttggtactgtgtgtaaggctgagttgttttgagcaattcaaagtttcgttagcacatttttcaaactgttaacggatgtgttttatgaaaactcttatatattaagaaaataaaatagatctattttttatgtttaaaatatttaatagttcattagtcaccactaatgatctttctcgttttcggtgccatagaaaatctaaccggggttgctcaaaccggagtttaaaattttatgataaatataatactccctccgtcccaaaataagtgcagttttgcactattcatctccaacgtttgactgttcgtcttatttgaaatttttttataattattatttttattattattagatgataaaatatgaatagtactttatgtgtggctaatttttttaaaaaaaattataaatttttcaaataagacggacggtcaaacgttggacacgtatttccacggctgcaattattttgggacggaggtagtacatgtttaactaagtgcagcttatggagtctcgaattgaggaaactagtgcgcttgcttgtattcggtggccagtttaacttgagtgacagcattgttaaatcaggatatatgcactgcttaccaaggaaaatgaccttcaccaagtaagtcaaatcgccactcattagaacgttgtagaagaccatgcatatgggcagagcactacctgcttggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32867 - DNA, 655 bp, Oryza sativa
aaggttgtgtctgagccgttttttccttttgaggaatcttgacttgaaataatgtcactcgtgctcaaccccaccctcgggggctcggtcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcatatgtatagcaaaataaaactaacacaaaaattttttcatcatttcgtttctgattgcagattgagttaatttatacaaaaaagaggcatgaaggccttagaagaaagaaaaagaaaaaaagtaaagattggcgggggctcgggggctcattccgatgcgcccgggtagccggcctcgtcgccaccgtcatcctcaccgctggcgtcgccctcctcgtcggagctggagacgaacgcgagccgaggggccgacccctcgaagccgttgacgatgtggtcgggagcattcccgacccgcgcgcgc

SEQ ID NO: 32868 - DNA, 7497 bp, Oryza sativa
  unsure (1)..(7497): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcaagatgaagcaatcaatcaatcaacgagtcaactcggggagttattatcttcgtcttcgcttcagagccgacatctaatttcagcgactccgattattacaccagcaattttggcttcttcacgccgccacaatctattccaaatttctcaagtttgagatttaatttacatgtctgggagtttggagtcatcaaccaatcaactcagatcagattcaatgagttgaacaatagcatatactttcctctaagtggagcatctgcaacaactataacaccaagttctactgacgtctttataaatcaaggggcattgcatcagtcttcgttatgcacacgctcgcatcaaggaaactactcgagcttcaatatcttctcaacagtttgatggattattgtcactgacatcatcaccagcacctatatttcatcagccttgatgtctccgttgttgctaatgggtgactacgtcttcgcctctggttgctttcgtcattgccgacttgttatttcgccttcatggttggcctactacgcaactaccgatagaggatctcatcattatcgtcggctgctacaacgctattgactggatcaccgacatcgtcatcttcatcaacatcctgtcaaacctcttcaacatagcctattctactgttgtttgatgcgcaacttcgttatcatatttgatcatctctattgctgccaatcgtcattaccatcggttgcatttgtcgtcgccgactattttcttcatcttcatgattggtggacttcgtcatcgtctttgatgcgtgtctatatcttcaccgtcggcttgctttcgtcaccaccgactggtatcgtcgccttcacggatggcttattatgtcgccactagtaggcatcttcatcttcttcaccagctgccttgtctgtcaccgactaattatttcgctgccatggctacacaactttattgctgggcgccttcatcttcattgctggctgacctgactgctgccgactggtttctttgccttcacggttgtgcaacttcatcacttttgattggtatcactattttcactaccaccaatatttttgccacctctagtgggcaatattctctctatattggttgtcttgtctctatgccaactgcgtcagctaccatcaatggacaattgtgactacgacaaaaggacacgctatatgctcaggggcctactagctcaaacacaagtatcataccttcaatttggacttgttccggatacattcaacatggattcatggtcatgagttgatttatcctgctcaactactggaccactcattattccccgtaagggctatcaactgaatacttgcaccaatcaggatttaattgttatatctattttggagtatcccataaaggataatcactcagatcagaagctattcatatgagctacacttggtctatatcacccggaagatttattactcgggagcatgttacatgcgtcaccctttaaagggtgtcgaaggcatattttttgccctaggcctaatatgtctgcagcccatattatcaggtgtggcctgtcacgttcttttagggacttaggcactttttgcttaggccaaagtgcgcgtgatcaagtgcccaatacctcaaaatccttttataccgcagttactcaactttttaggagttggtacaatgcatcttaaaaggtgtcaaacagtaaagctttatatagctgctccgctgacttttttatatatagtcaaggcactgtttgggtttatcaagcaatttattggatacaatatcattgctttttgccacgtaactgtgcatttttattgaccaatattatggcttaggctgattatatatcttggtcatttttcaggcggttggtaaattctttatgagtttatttactcggattttacaccacgtatgccgtatatttctgggtgtggtgaaaccatgtgtcttttagggacttaagcacatctgttaaagcagtgtgcacatggcgtatgtccaatactttggaaatttctttattcacagcattcaagcttttttatagctgttttgctatatgacttttcaatgatgttgtcagctttaggttgcacgcattatattttacaaagctgtcggtatatcactcggatcatgttatttggagattcacaccgcatatgctgtatattgatatcaagtcacttggttgactataattatcgaaaaccactctgttggttggattatttattccttgactatatgcttggtttgttcaactaaccacatagtcgggagctacacctattaggtgcatctagtcgatgcacctaagtctacattcaatttttgttcagccctccgtagtcttcagatttggtaaaagtactcgggggaccatgaagaagatgattgaagcactcggctttggagtaatctagttcgagagaagattatcttttcaactgcgaaggtctcaggggctactgtggagattatgggtaccccatacccacacggcatggttatccgactgttataagggatagcttatatctatagaatttgtaacagatcatgacttggttattacgtttccatgtatattatggaacggcctaaagtcctgggttgataaaattataaagtagatttaggaaaccgatatcgtattggttaaggtttctatcttgtaatcctggcccccatcctatataaggtgggcaggaggccctctagggggcatgagacacaatcagatcgtcagatctataatacacccggcggattcaaatccccaaacaggagtagggtattacctctcattgagagggcctaaacctgtcgaaatcttttgtctccgtatccatccacttttaggtctcgtgcgctacccccttttattattgccgaattcatgtttcgacagatggcttttatatttttagtattagttttgaaccgctgagaacagacatatagtaatcgtagcttttttttttatttatgttgcatgcctttaacttataagtataagttagaaaatgaaaaaacttacaaggattcttcgtacccttttcctccagcctcccttatttatatgctgtgttctttcatttttgtctaccaaggccatgatcagtcattcgtcaattgcatgaaaccatgtaactgtcctccctatccaagcaatctgtcagcgtccatctgcttgccaaataaaatataaaacaatatcttctttctatctcttcccctcttgcattttcatgtttattaacttctacaggtactctctccgttcttaaaaaaaaaaaagctaatctaggattggatgacacaagattcgtcgttttttttataaagggaggatgtagcatcacatgttactagagttcattcatttgagaaatgagaataggcaataccggaaaagaaacgtggttcacctccatgctatccagcggattacgcgagaattccaggcaacccaaaggtagaggcatggaccgacgaccctggggtgccgccaagcagcgcgtactcactacatcactgcagatcgataggctgtcaggctgccatgacctgcatgaaattaggtagctctagcagggtacgagcatagtattgggcctgactggagttgttgacatatagccgatgcaatataggacattccatagacttaactgcaaattgttttcccaacatgcgaggccttatttcaatggagagaattcttggtaaattttgtgcaaactaaactaattcctaaaaaaaagtgttctaaaattcatacagtctagtttgcaattaatggggcctaaatctgtaacatatggcatgcattgcccccttggcatattaactcgaaacatagtaaatacttgaccgaagcggaggacttgtgcactattctgtatgaagatggttcttatccatatagtgcccatttttgcataatttggggttgggatacgttaaaatcgagaagttggacctgaggatatatcatattctatggttgtataagcgtgcgatactgttaacacaagtctaaaactagatgattataaatcattttatttttgcctataaacttatttatttactataagaaatcagaagttgcataaacatgccaaacaggtttcaaggggaatagatgcgatcctatacaagatcttaataaataagcacatcaatgtttattaagcatattttagcatgatggagcctgcgcgaggggcttggcccttttgttatttcatactaatacaaatagatataatacaattgagctgaaaatcatgagtaaagtgctactccttaaatgagccaggcctgcatataattgggcttagcccataaacaagttgctcactatagggaccttgataggccataagccattttgggatattctttgtcttagataatgatgaaactagatgacaccccgcgcgttgctgcgggatattcatgtacatattactatatattttaatatatagcagttgtaagtcttagtaaaaaaataactaagtaaatagaaaggaaaaaaaagactcaagtagggttggtcagatgtccagtgcactgccactcaggtagcaagacccacagcgctgaaccttaggcacaatatcttgtaatgtaatggaaaatgatgctagtgatcattgttcttttaccgaatacacgcatatttccatgcctggtcttacattctttaataataaaattcctctgacattgtaaaagataaactaaacagcaaaaaaaaaaagagagcggaggaacttaatttttgcagtccattcgatttctatagacatgtttcgtagacagttatttggaagcacgaatatcaaatcaaacaattaaagcaataagatttttctaaaaagaagtaaggatagactaactgtgctgatatatcgagaacacactccgctagagacttgtatatgtcaagaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagcgatgtaccgtggattgaatagaatgagtctacaatctataaagcttgcattcagtccctagaaccgccacagctgcgaccaattaggcaaaagtcataaagaaaaaagattgatcaatctctctattacttactgtgttgctgcaacagcagctccgtcagttcctgaagccaagacatgttcgctgaggtttcgccatagccagcggtgtgtatgcatccgccgcgggctgcttcagctcccatcgtggtgtttagcaaaaggtgatgtaacagatggaaagttaattagcgtgaaaaagaatgagcgatttactcagcatacaaatagctattgccgtcgattcgtatgccgtgttagatggcagccgttcctctaatacggagatgacgcagcagacgattggaagggttccgcatgacttggtgacgtctgcaggggaaggttgaaggtctccatgcctcattgcctggtgggctgagaagaatttccaatgctcctaatcaagtgaatgggccacggaaaggagcatattggagatgatcagatggttgagaataactccctcgaatgatctaacggttgatttttagtggatgacgtagcttcacagaatttgagctttatagcactaaatgatctttaatggataccaattatattggaagaaaagatgagcatcataaagttaataacgaaagaaggatcatcactaaattaatgatgagaaaaatacattttcggtacaaaacatgattagggacgcattttaggtgataaacgaatttccgttacatgaacttcatagattttgaaatgtgacataattctcagtttattgaagtaatgaaccatttcttatcataagaataacgctgatcctcattatatgacatacatattttattatcactactttataatatggtcttatatacactaccggtaagaatgattttgtaacaactttttgtaggaccgaatcacaagaactaagctaaccagagggggggtgaatggttggtatacccaaagacccaaaaacttttagcggaaaataaaagttaccctcgaatcgatggatcgcggtttgaccgaagatgttgtaccggtctgaccgtcgagatgcctccggtctgaccgaggtagaagctccagtcgaaccgccgagattgcctgccgcgcctgcctgacgccgccagtctgaccgttgtcgctccgccggtctgaccgccgccttgccgatgaaacacaaatcgaagaactctcgaagtagatgacaactttattacttctctctttgtttacaaagtgcaacaacagcactccttacaaaatctcgactaaactcgaaaccctaaaacacagcgctatgaaaagcaacacaaaagagataccaggaagcctcacgctccccctctatttatacatgaggtaagcagcccaaagccacgaaccaaactcatactagatgtcctaatccacctaggaaaccttctagtacaaaaaacaaacttaacataaccaatcataccaaatttggactccatccaaattcgactccgcatcccatacgcacacaatacctccatcgtatgccatatggaatcttcaccaaccacatgcatcaactctagcctgagtatcccgcatgatctctaaccaccacggacatcgtcttaccaccaagccgactcccggtccatcaccgcaaaatactatcccgaggcgtcgagtcacctacacatgaaccaaaaaagaaatcatattccgagaccaagctatcaccaacttgactcattgttagcaaacaacagtatcacatacgtatagtatccatctagaagtcataaatatgaaacaaactcggatatccaaagaaacaacccgaaaccgaaaccgaaaccgacacagcgtcggccggtctgactgcacggataccgccggtctgaccggaccacatatccagcaacacttgtaaatccaaacatctccaaaaccacttcgaagattaattccaaatatcaaaactaataatcaccgatgctaattgttcatcacagaataagaatcaaaacaccttgatctaacactttctaccttattagacaactgtactcccttcgttctattataagtaattgatttggtagtgtaaatagatatggttaattaaaaaatacgaactct

SEQ ID NO: 32869 - DNA, 2244 bp, Oryza sativa
ttgttttcatatacttcacctctcttctcatcttatatatatttatgttgatcaataagcaggggttgattcctatatctctctaccatataaaacaatacaactatctctacgattcttacagttatgtagcatgtctgcatgtacgctacacagagcatgttagaagatttttattttaagaatgggtggcgtcggaaaagtagcacagcagatatacacactatcatgcacatcaattcaccaatccacggaacaactgacccactatctgtgaacccgatcagtggctcgagacaatgagctcatcagaatgcagccatggaatgattgagttgcaattgaggtcaagggatggaaaggggctagggcatgtctttgacactgacatttcgcatggtctagcaccaaatttggcccagtgtgcagccactagcattttgtgcctgaagctggtgtgtggagaaagcgatctacggaatgatccttgaccatgatcagtcgaaagcataatcccaaacttgggcatgtgcggatgacacgaatgcccgcagaatttcgctagcttgcctgagtgcaagggcaattgtgcggacaatgatgccgttgcatgccttggaacaaatctggctattcgtacgtgaaggaacatactgcttcgattcgacaatccttcctctcttttttttgtttgctccatgggtcatagttagctaaatatacatcggtcacgcccagatgcactgctagaacttagattattcacgaccaaccttaacaaacatctgatcgttgatagtcaaagaagccgcggtaggccctccgacggccatgtaatcgctggtcgttactacgtgcgtgtatgtggtcgctaataaggcgtcagttcagaattttctatagataacgaaattggtggaccgatccccttccccgccggcttagatccgctgcactggtgcaccagcaccgacgccccctacatggtcaccactgccgctgcacccagcggtcgccggccatccctgcgcgcctgctcccgctccaggcttttcccgaggacaagatttggccgccaataagccccaagccctagcgcctgcccagttggggcagctctgactcgccgaaaacggcggcttagcagttgggcatggaacagcggcgaggcgtgaacggcagaactaggtcagatgatatcccttgtaactttttctctgccttgttttagcgttgtggcttgaggattatgatatgttcgttccatgatatcccttgtcgtcctgtaattctattttccaaattacggctgggtttaattgtttaacttgaggattatgatatgttccttccatgagatgaaggaatatataagacctgtagtacatagccattttttcttgctgatctgtcaggctagtttttcaaaggaacaatttgtaactatgcccaattgcccattgcagtttaatttaccagttatactgagtgagcttgtgatttgtactactcttgtagatttgaacttagaatttgttatagatggcagtgtgacctccattcatgctctcatgtccattcatccatgaagtctcaacaaggtatattttttttcaacatggcgcataacttcttttttctttctgaatgattttgagtttgatcataatacttgagaggaaagtcaatttttcttgcaggataatctagtcaatatacaatgattggtttatttatctaaaattacgggattcttcttctgtgaacacgcaaatttgtggaggcatcttggcatattgtttaatgtttacagttcagtaacaagatatagcatggccctgataccgctgacaaaacgataatttcattttcaatcaatcatttatcttcccgtactgcaattcatggcttcttgcaggcagttgatagtttatttaacatattctacttattggtatgaatttgccctgctctatgttatcagtagcagagcacacttgcttccatttggatttattaaaatgtgtttagtttctcatattacagctcccttctcttcatggacagattccagtgtgacatagctaaagtgcaaagaaacttattttgtgtgcccagatgttattatttccaatggttcctgcaggatgatttatatatgttgatcaacattcttggatttgatcaacatcaatatgatatgcactgatagtctggtatatggcttgccacttcctttttttt

SEQ ID NO: 32870 - DNA, 23229 bp, Oryza sativa
  unsure (1)..(23229): unsure at all n locations
atttatatctaaataccatgtttaaaaaaatattttcaacaacagtttctatatataccgcatgtccaattggtgaaattaaattatactactatgaactaaatttattagatacacatgtaaataatagcaccgccactaatttgttttactgaacctgatgcatggaagaaaattagaagctcagggccttggctggcagttgcaaacagtagaactgctagctgcggccgcctgccgatgtgggcatgtggccaactaaattagtaagggtaatttatgggcagaacaaatggtgctcaattagtggttactgctgttttcgtgtgagtatggcgttaattggtaaggtgcactggtgtcactcatcgtagactagaacaggttacatgcactactagaaaaattatttgttaccacgaaaaaaatcatggtatcaatactaaaattatggcaatagatatatgttaccacaattttaaaattgttgctagccgttgtaataaatagcgtggtaataggttattgcaacgatttttatttagtggtaataaatttcgatgttgccacggaatggatgtaacaaaaaatcatattgcaacacttcacatcgttataataaaagctattgccaccactccatatttggcattagttctacgtaccaaattaaaggttcaaatattaatttatcatcctatctatttatttttttgatattgtgtcttggctaggattcgaacccaagatctattcttcacgcgtgctttcctttaccaactcacacacgcatcaattcttttggaaaatacatatcgttccatttgaaccttacctaactgagatttgaatcatagatttaaatatctaaaagatttcaaatgaaaatgttgtcacctataaaattgtagatctcatcgacagctataattcccatataaaatttgtctcaatttgtgtccatatgaaaaaaataagttaaattatgagacgataatttttttattgcaacgaatttgttgatcgtggcaacaaaaaatagtgaaaagtaccatgtactatgtaaattgccacaaaaattaaaattgtggcgatagaacatgtttttttttgcaacagtaagactttttgtggcgatatctcattttttattgcaacaaaaatactaaataaaacaacgattgtagattgttgcaaaaaaatataattatttgccacagaaaaattatcattgcaatagtataatatattgctacgaattattttttgttgtaataatttggggggaatagctcaattatcttgtagtgatgggatggaccaaaaggtattggtgtcagctgacaccatagctaacatgatggatccgcccctggtggagaagagaagggaggagaggaaaaaggagcgccaacctgtatataactccaaaagagttaaaatcaacatagtagtggattagatggaaatgaataaatgaagatttattatattttggagcttgtgtattagaggtagtctattgtatatgttaccttttattggataagtagatgatgtacactaaattagagatagcaatcatctttacttttaaacatgcacttaatttcctttcatttgtgaatgatgggagtgtcaacctctgttttagctttcatagttggttaagagagtactagataataatactagtgcacctactatgtccgctccccgccccgcgtcttccctttgtttaagaagatccctttacctctcctaaatgtaagattctcatccataaatattgatccacgatctatttacttatttcatacattgcaacacagtttttagaggcaaggtattaaaaaaacattcattgtatcttaggacacaaatgccatctcttccttttagctttaattctccgaagacctagattgccataatatttttcaatctcgcataacctcaccctatttatatacttcgtagataggtcttctatgataggtcatctagttcatccatcacatgaaaccagagacagatgacgaaaagataatgaggtgtggccaaatggcccatggccatgcttgcaaatttaaaatgagttatctttaatggcattgatattgatattatagtttagtaattagactcaacaagtcaatatttaacaacccatttgtaaacatgcataagaagaagcaagcattcaaaaaatatcactatctaccactggaccatggctaaatttggtcttcaaatactatgcagttctgcacccacaaaacaagagcaaaaggtacaatattttcttagtaaatgcttgtctaaattgattaatgaggatggtgtttggcagtaaatgctctgaaggaaataactacataattagacaattactcaagtggttaaaaaaacaggtgactctcatttctagccgggtctaataaaagttaaaaataaatttctaggttttgaatcttttgtcctcaatgtagattttgggaggacaagtggattggaaactcttcttttaaagggtggtatctatctttatataatattgtgcgtcggaaaagtgcgtcagttgcaactatcatgaatacagttcctttgaatgtttctttccatagggaactagtgggccagaatatagttaattggcaaaattttgttgctcgaattgtacgtattaaccttaatgataataaatatatgtttaggtggaaccttcatcaaaatggtatcttttctgtttgatccatgtatcttgctatgatcaacagtgggtatattgataggaataaagtgttacggaaattgaagattcctatcaaacttaagattttcatgtgttatctagctaaagggtagttctaattaatcaatgataatttagtaagaagaaattagaatggtagtactagatgttgttttttatgtccaacatctattctttgattgtcaaatggctaatttttttagaaccatttttatgtcttttaatttggtttacaatactcatatgttttataattggctgattgggatttactcaaagaccaaaaaacatatttcaattagagcatctgccttttatgttggctatatggttaaataggaatgatatggtttttaataaaataccaactaaagtttatatgcatgtactcatcagagcactatactggttcggttttgacccaactacaaaggtgtgaagaggacattggtggttattcacgctgtatgtcgaaaattggagacaaccgctatgcaaatttttgttaactttggatggagatttaacaataggattgttcttgaataagtgtctctctttttttaccgtggcatttattattgtatcgtttctttatcctttattaaaaattattatacttggttttcagctaagaactatatatgtggttgtagcttccgttaaagtaaagctcagatattatccattatctaaaagaaacttagcacttagcaataagccagtgaaaaaactgtagatattgacatttattcaaactagctaattaaatgtccataccttgcaatcgtacgtaagttaaagaaagataacttaattatatattgtaaagcgtatattataatatacacgaagaatggatcaaaattatccatattatactactatcctattctctcatttctttcattctaatttgttgtactaacatatattatattaaactataagtggtggaggcagacactaccatcaccgctggcttttaaagtagcagagattcacagtgcagctgctatgtcaagggggccggtgcagcgcctgctttgcgtcttggatgcacgcgcgcaccgccgcttcctgctcctttgctcagctagctagggcaagtaatataatacttcatatattgcctctaagagtgtcacattggattgaatgatgagatggaggagagaagtgaggagagagatgatgagccacccctaaatcaagaggtaacctctacacaaatttcaagaagagtgtgagagtattagatatattggtatttttagtactagaggtgatacattgtataggttgtctcttattttatgagtgaataaaatagataaatttagaggtggtagtcacatctattatagcacttgcccttacctgatggatcgagttgaatcatcatttcagaatgtgtggcatcgggaaaggagcataatgcacccttcaagtcattatgtactttcaggtcattatgtgcactagtactgaagccagtatcagagcgatgatcaaatccatggagtggaggtgcctgcgtccgagcatgagcacaatactggataaggtttaatttgcgtgagttctgcatatggcaaataagcataactttgtttaagggtgtgcttttttgaattgtgctctgtatgtgatggctgccacaagagccacgcagtaacgatcggcagttgaaaatttgcagacacaccccatatatacattttggttaattattcacatgagctctccatgaagaatacgggttcgtcaatagctcgactttaagtaggttgtcagtatgactataaaagaaaaatatgttgatttctattttgaatccatatgtattccattatggccacttttataatggtctttaccgcaagtagaaacgattcgtggcattggttatgaggctcttgctttattgcacaactatatcctgttcactataatatttgttattaaattgatatggtttactaaataaaagagagatcaattgtcaatcatttctactactagtaaacaccaccataaaagtatagtaggcaggaagtaaaagcagctattgtattttactgacaattcttaatgcatctatgtagttctcctgtatatcgagaaaataaatttgttgacagattccatcttccagtttagttttctttctaggacatactttatcatttcaaataaatcaaaccggcccatgattgttggttccttagaacagtcactgatactactctgaaccagcagtgatacttgaatatcactcttggttcttgttatgaaccattactattgtatcactgctagttgttcttgttataaatcggcagtgataggaaacaagcatcactggttcttcataacatgaaccagcatttatactcaattgaccggacagttcggacctatccattgaatattggaaaaggccgacatattcaaatgatagttttttccttttatgaaaaactttatggcaaaatcgtagagttcgacgagttctacaacttccttggatccatttgtgtcagggttcaaaatttccgaacgaaatttcaaaagatttggtcatatcggaccccacccccaccgatacgattttattttttaaaaaaaattctcatgaattttagcaatatttgtttaaatttaactaaattttgtttgaaatttcggaccaaaatttcggaaatatcaccatatcggcacccctaatacaaataccgaaaacgaaagattgaaccatgtattttttttatttagatgttcaaagtgttgggatctatttccacggaagaatgtttaaaattttcaaatgacgtcgtatggggaaaagctatatatgaaatttggactgcccggcaatatctacaacattatagttaatgctttttttttcatttgaagttatatctacaatgccaaatatgaattacctgttttttatagtgagacatcagaataatattattttcatacagaaaggatgttacacgtcgacagatgggtcccaggtacgaatcatatatatacaacagaagcgtcgcatgaaaaattgcataatatatttttcaccaggttaacatcttacaaaaatgatactcccgaaatgatatatatatgctaccatgttttacagttcatcaaacatattaaggaaaaacatctcaagcaattaaacatataaaattaatagggcaaccatataaaatacaagaaataaaaaaaacacataaacaagatgttttacatttgaaaaaatatagtataaaggaaacatcatgcgaggtatattttgttagcaccttaatgtaactgccctaggattcgtgcaaggtgtatatatacatggtgtaactgtgggtacatgctctcgcgtgcaaaaaaaaaaaaatcaactcatatatatcagtctgccatataaaacaactcatgctatttacatgtaattttttagttctgaaacatgtaccttgtaaagagcttgctaaaagatttcattttaagaacgggtagcattggagaagaagaggactggatgttcactttaggatgcatgacagttcatgcaccagcagaaccaccagctggcgatcccgggcggtggctcgggagtcgggacactgagctcattgagttggaattaaggcaaaaggatgaaatatcgtggacctctctcttgatctcagtgactgaatttggctcagtgtgtagctggcagtacaattttgtccccgaagctggtagatagccaagtccctaacttgggcatgcgttgatgacaagaatgcgctgggattctcttacgagcttgcgagtgaagggcaactgtgcatgcaaacagtgatacaattccgatctgccgtaacgatcgtacttttttttttgggactagtaaacatgagaaatgattagtatcttctcaaaatgaaggtacttgacgactccatacagaccacaaagctttagagatgatctcttggtgacaaaaaagaaacaaagtggtaagagaaaatcactaataatatgtgctacaagtataaactacatattctacgtgcatatatatgttagtgagtgaaaaaaaaattggaggaaagatcagtaattaacattacttgaaaagaaaacatttgtggatgtaatagaaagaccataagatctcgtgtcgctctccacatgggcaacacgagaggtgacgccaccgccaactccctcctcccccttcttccttctctgcctcgccgccgcctgagcgggcgtaggcaaagccgcgtggccgcaaggacggcggcggcggggctgcgcccagcgtgcgtccggtggtcggggcaattgctcggggcggcggtggtggcaaccgtccagatccgcgccattctggccggatctcgtggggtggaggctggcggttgggctgagtggtggcagcggcggcggcagagcaccccgaccagatccgcgctgcgccggtcggatctggcggggatggcggctggcgatggcagccgggcttgagtggttttggtggcggcgaccagtggtgctggcggcagcgacggtggctgctagcagcggcgggcgcgaagccggctggagctgcgctggcatgcagggagatgggacacggccggcgcacgggaggaggatgcggtggactggcgtgtcgacgacggcgatagccagagaggaggcgaggaaggaggtgaccggcaatggggaagaaggagagcgacggccgcatgcgggcatggtgggttgtgggcgacagcgacggcgtgagcagtttgatggctgcggagcaaggccggaggctgacacggcgcgaggaggcgcggacgatggcgatggaggccgacacggcgcgaggagatgccaccggtggcaacggaggccggcgcagcacgtcgaggcgcggtcggcaggtggtggaggctggcgcggcacgcaaaggctaaccggtggggagagccggtgcagtgaagcccacgcgcctgtggaggcttgacggtggtggagcaacggggcatcatttgtagactcgcaggcggtaggcgacgggtaaaaacctagcccggccttggccttggccgggctagcaacgacggcattttcgaacgtctttacccttcttgagggcgttgtcgtgccgccccttcacctccagtggggctatcgggtgaaaacccagtcttggccctcttgaggccttgacggacaacggcggcggtgtatccatcgctcctctcgttagagatgccgtgtaggcacccccttgccaaaatctcccaagcaattggtgcaagctctctctaattcatattctcttatgtcggcatcctagcttccgcaagttggccacgttggagggcttagggggagaatggctgcattcttctctctcaccctctcaccctcaatcccaaagatttagatagagctgtgttttgtgtcagttgtaatggtcgggttttgggcgatgtcggctgtgttccgttgtacggcttagtggctgtcggttacacttagcggtggctggtctgatgctagccttctcctgagtctatgtgttggcgttgtgggtgtgtgagtggtagtatactttttttttctttttcctggttaccatcttcaagggttgtaattttgttattttttcctactctatcagtagaactttacactctctagtgcgattcgttaaaaaaaaacaaagaccatctcgttcagtttcctttatatggcctacatggtatatatagttatcaacttctgatcaacttaagtgtatttttgcaggtggacaacgatttcacctcacggttgtcattttcgcaggtggtcatttagctcggagaggcctacctacctgaaaaaaatgtcatcgtctggaaatttgcttttctagccgtgctttcttcaaagttaagaaagtactccctccgggttgataattcttgtcattttggacaagagcatggtctcaaaaaaacaactttgaccattatttttcattataatatgtataagaatgttaaaaaatatatgattttattaaagtactttttaagactaatctatacatgtaatcaccatatatgaaagataaatattttaaaaatgattcataatcaaagattgtaaagtttgacctcacccttatctaaaatgacaagtattatcagtctgaagggagtatacttactacaaccaccaaccgagtattgattcttcttatatgtcccgtggctacttccactctcgtattcataagctttttctatccatctacttcatcctttctatccatctacttcatcctttgcaggaagcaaactatcatcccatccaagtaagtgattttcctcctgtcgtacgtctgtccagactctagatctatccctggcaagtgataggtaatgctttctatttagcactgttcgtgtttgtaacatatacacgtactacagcaacactgttacatcagtttacttgagaatggatggcattggaaaagaaacatactgcatgatctgcctacctcttacgttactctagcaagcgtcggagccaatgtctgacgaccctgggcttcgggctagggccctgggctcactgtgtcaggcagccatggattatttgtgcgacgatggaggtggttgggcccaagcccttggactgagagtgcagctagctagctagttgttgccttccacagagacatggctgaatcatgaattaaattttcgcgtacgtggttacttatgtacttcttttttcatcatcgatcctctcgtcagagttcagacatgattcttattcagatatataagggctggtttttccatgtggatgcatcatgggtttagtagggcttccaaagctcaagcatacagccatggagacagggatacggatagtctgcttaaacattttctaccccagcgatcccagtttgtgcacttggatgaaaattggtagtgtgttttgcaggaaattagacatggatttgattcaatggaacattctcaattgaaaaaaatagcatccattcctccaagtttctcgattttacaagattttgtatgcattctatgcatccttctccaacgctaacatatcggcgcaacttgaaccgcggaaagctcgatctcttccaagttgtattaaatcagctctcctggtcgaattcaacacacacgtgaaactccaaaatgggggggggaaaaccccggaaacccaaatcaaattccaaaaaggttttggggttggtggccttgcccccccaaaaanacaattcgcagcgctcttctccgagattctctcgctgcatgcttacaaatccgaaacacattatcatgatgtggtcaagccaccctaaacacgtgtcatggtcatcactatccgtgccgtcccacagacgttcaggtcacgatcgacgagcacggcacgacgaagcaggaaaaacacaggcctgcgagcgtgtttccaacacaaacaggcgtgagcagcatcactactaagctcacatgaattcaaacttgtaaaggagaaaactagaagccaaggttgaacaagataggaccatcgtctaagattcgagtacaccacatatacaccatgccccagtccatagtgtccatgatctgttagcactaatcttgacaaggtttatgttagctagatatatgttatgggtgttcacgtattagacatctaataggattcatgtatgtcatgtactggactagcgtgcaagtgtagatggctcaattagtaactgcacgtgcgtgtgctgtatgtgttagtaggagtaagtctcaggctgttatagctagattatatataggatcagcaagtggtgcagtagaatccgtagctgcatgcatatatatgagtggagcacgtagcatgacttgcgaggatggctgatgcattcgtatgagttagccaagtcgttgaagctgcagaatgcatgtacacgaggctacttaggctttgttcggcaccctttgtttccaacccctctccttcgttttccacgtacacgcttttcaaactaataaacgttttgctttttgtaaaaaaaacattatataggaaagttgtttaaaaaatcatattaatccattttttaagttaattttagctaatccttaattaattatgtgctaataagctgttccgttttttatgccggagggataaactctcaaccggcacaaacgaacgcaaccttaagccgccgtgtatcacttggttgtcaccaagtgtgtgaattgcaataagaaaaagtgtgcgtggctggtgtttgtcatcatatcccgttgtgtgttaataatcctcaaaatttatttcttgtgtgcatgctctcgtgtgagttttcgccggaggtagttcattgctccccggcaatttaaagtgttgtccacactactacaaaaagggttattggggccggttgggaatcgactataagtaccggttttccaaccggcacctattggtcggcaccaataatataaaccggcacctttagctttgctcgagaaaaaaaaaagagccggctcgaatcgagccgaactcactgagcaccgtagccatgtgcccaaacccaaatccccaaattatccacaaatcgtcaccaaaattgattgacatcacatataatcattcacaaaccgtcaccaaaattgatcaaaacatctaatcaaaaatctacaaagaagagatgagggaggaagaggggctggccgccggtgggcccctcttgtgccgccgcccgccgcctcccctccggccagatccggtggagggaagggcgctgccgctgcccgccgcctccctcccgccagatccggcggaggggagggcgccgctgccggccatcgcccggtgcctcccatcacgccgccgcccgccgcctcccctctggctagatcctgtggaggggagggcgctgccaccgcccgccgcctcccatcacgccgccggccgttgcccgccgccttccatcacgccgccgccgaagcccgtcgcccgccgcagagagaagacgagagagagacgagaaccaagagaggaggcgagagaaggcgagagagagggagatagagatgaggccgataagtttgactcatatagggcgtcggcatggattggctcggctcggctcggcttggtttagaaaggtgccttttttttaaataagtcgaaacctataacttattataggtgttggttctaaagaagaaccgatacctatggtataggtgtcggttttctttaaaaaaccggcacctatattatattaaagaaaactggcacttatattataggtgtaggttcttctttagaacgggcacctattgttgtttaaaggtgtcggttttatgtattttcagtctatagaggagggaaaagcattataggtgccggttttagctggtccggcacctacagtgccgatctctatgagctttttttgtagtagtgccactaggcatttggtactacgggctaacggaaaccccaagtattataagcataaaaggataacaatgtttaagtataaacatatatgtgtgaactcacaaagacagcaaattataaatggaacaaaaaactgaacgagacaacttttgtatttcaagtttatatattgcatacgagttgggttgtacatttgtaagttcaaacgagggaaacgtaaggaaatccaacctcactagaacgggatcgcttatctctaacgggctgaaagcctcatcactatcgggtaaggcccccgtcagtgggcacaggtcactgatgtgagaaaatatctcaatcgggctaaagcccgtcacggatggatgctatctcaatcgggctgacaaccaagcccgtcatagatgagtatgaccagtcaaaccaccatagttaggaacccgtcatggataactaatctcaatcgggcacaccactaagcccgtcacggataagtagtcatctccatcgggcatttagccagagctcgtcaccgataggtttgaccctacgtgttgagtcaaactagtcccggttcggatgacttatctctatcgggtgtattctaaaagcccgtcacggatgactaatctctaacaggcttgactctatagcccgtcacggatgagttatctctttcgggcattagctaaatgcccgtcagggatgagtttagaaccaaaaaataaataaaatttgtctttttggctagcctcaggcctttgctagccatgcccgctgcaaaaatgacagaagcatatatatacatagtcccattcccagcaaccccattcccagcatcaattcacatataccatcacagccaattcacagccaattcatatagatccattcccagcatcacatcagccaattcacattcatattccatcacagcatagccaattcacaaaatcaaacacatatacattcacatccacaacccattcacatatatatgtcattcacatccatttttctctccaaaccgccgacatgcatcaaaacctgcaaaactaagttataaattggaacaattttatatgtaagtagaaatgcaagtatatacagagacgagctacctaggacattactctaaagaatataatcgtattacaaagaatatttacaaaaatcaaatgtttgtcgcatatgcattgcaaatgttctgccattccgagacgagctacctaggacttcactctaaacatccctttcggtgacaagatatcatctagtatgaattgtgctatctcctctctaatgatttcgatgttgatttccgaaatccttgaaataaattcctgaatgttcagcgccaagttagtctacatacttgtaaatttgtcatcctatgtgtgtataaacaattgaattacacacctcagggtcgagcaatgtcactttgtctgcaaagctcctcatgttatggcagacatgaaacccgcactggtcgccaacttgttggcgtattgggaagtctttcttgtgaccgagtttgggatgcccatccttatgcctcccgcctcttgccacgtattggtcccatgcctcattcaaggtagattcgatggccgaccaatcgtatatttctggcttgatattggagttaagctagtgtatcaaactccacttcggcgttattaccagaagaatccaatattgcctgcgaaattattaaattgccagttacatactacagttgtacgcgtcgagtatttgagtataagtacggtacacgcttactgttgattgtaggcacacatagtgaagtccttgtcttgatgggcaaataagcagtccttgatatagcccactatgtttgctcgatcgtttttcagcgttgtctcattgatgacagctggatcgagtaaggcaacatggggtgctttacgatggacatgcttccaggttaacctacgagcaagacaagagtcacggtaagtgtaatttatggacagtcactaccatatcgcgtaccaagaaatacttacaaggagtagcacttaaggaggttggtatcgatcgctcgcaccctatagaggtctcatagatctttgaagtctacggcgatgaaggcagtaggcctgaggaacggctgaccaccgtgctggcctaccatggaggtctctctattattcctccttgcgttggacttctccatgtagtacccatgcaactccttgcatgaaaggcccatctagaataaggcatcgtctccgaccaatggcatgcccaatgtgaattcggctggaggctttggaggagctcctgacgccttgccaagatcaagcttatttggggctaatggcacctttacttttcctctccccgttccagcagcttttctgcgtgtgtcaagcttgggtggagaagatttcgccctcttgcttggagttatattgatctcaatgttgtgcttgggccattgaataaaggtcccacgtgcagccccaagggtcagaatctcatcattaggtgggtgtgggatagtgtagccaacccaattgggcttcactaagtccacctgaacttcggcattgctggctagcagctgcgccccatgcactcaggtctccggggtaggcttgaatgcttgaccctctgcggcaggaattgcaaatcctggtgtcatcctaatgactagggtacacgatgtgggttcctgcgatagattcattagtgtccttagtatatgttgcaatgtattgtggtgctaatacagtatatgcgttattaagttgtttttaccattatgtggaccaccgcggcagggccttcaagctgttctgcaggagcctcagttgatgtgcagctgctacgcctctgcgtggggctcacttgtactatgggaccgggagtggcatcggtcgacctatccctgatgcgtgcctccatccgagcctccatacctaacagctcggcagtgagctcttctctaagctcttctttaagctcctcccgaagttgggccttaatgcgtgcagctttctacgccttggaaagcttgtgcttcttgtactgccacacgtattggggaaacccaaactttcatggaacattggagccaatgccccttgttcgtccacggtgttcttcgtttcccaacgctttcgtgaagatgtcatcctcgcgtttttgtgagcagacctcttgggaggcctgtctctcagcattcagttcgacctgcggtacagttaggacgcgttaaacgaagaatacgatacaacataatgaaacttattctatgtgttcaacttacaattttctggtacaccgcttgatcttcgggatttgggaacgaaagagtttcgtcactattcttcttcacccatgcccttgcccagttccttgcccgctggaccgggatatcagcaagcacttgcggggtgttagattccgctgcagcttcatcctccttgtcctattcagactgtttccccgcgtagcctccggtgccaagccggtgcgggtgaaggttccttgcctgcagatcacggtaggcctggctttttgcccgagactctttcgttgatttggaggcatggaactcatcccacatgggtcgggtgatgaatgggtatttcccaaatggttttggctgggcggggttgaggacgtactccatgaccaacgttgtcttgaaatttttccaacaattccccatcttgcggatagtctgccgcttgagtcctgcctcggcctctgtagggtatcggaagctttccttgaactgcctccaggcctcttcttcttcttcttgagggaccagatcgatgtggtccttcagaatagtgaagtttcgcctccctaggactccgcatatcgtagggaactttttgacagctttcgtcggagccgtcggatatcaaacatcatccacctctgttatggtgtagacttccttaggaatcttattctgggtcctaggattccggctcgaagtagtcccagtagtggtcgtcgacattggttcgccttgctacaacatgtcctatgtcactgttgtacggggagaaagtactttttaaacacaaaattgcatctacacacattctctgatggtttgatatacctctatctcctacctgtgttcgcctcgtcgacggaaccatagcatccatgctcaataaggccggagcagccgaaaactcgacctcgacatcagtatcccactcgaacttgctatcaatgtcactaccataagatagtggcaacggtagcaagttctagtgggatatggatgtccaggtcgagatcccgtctggtccggccctaaggaacatggatgctacatatctgctgacgaggcggacgcagatagaatacacaggcaaccaaaacctttcctatccaagatccctaacgttattatcagcaaactcctagattgcgtccaagatcatttcgttagggaacccttattcccatagatacaacaaccatctttggatactgaatttatgggaatggggtttcctaaagaaatgaccttgaaagcaatctaggatattggtaacgataacagatttctagaaatgttgtatttgaatgaaatgttctgtttaccaatttgtcttggtcagtaccgtgcaggcagtaacccgaccaaaccagatttggcaactgggacacttcgtattctcctaaatgccataatttcagtaacttcatttgataacagatttctatgcatatccatcccatttccctcaaaatcacccaaaacagcccatactacacaagtcacatatatattattttttgtacctaaaaaaacaaaagtcatgacatataataagtttggcctcagttttgctaagaaattatgcatcaattaccatcatttgcaactgcccccacccccaaaagaaattaagaacaattgtagatggtctatcctcatgcaaaaaagaaacatccatataaaaacagccataataattcaaccatcacagccgacatcaattcatccatcccattggacccaaaatatcccaaaaattttgcaaagaactatataagaacaagtctagagggtctgttcttatgaaaaaaaaaacagtcatataaaaatagccataaaaaacacaggtcacataccaaaattcacatttcccccaaaataagtcaaccatcacagcccacaccaattcatccatcccattagacccaaaatatcccaaaaattttgcaaacaaccatataagaacaagtgtagagggtctgtcatgcaaaaaaaaacagccatataaaaacagccataaaaaacacaggtcacataccaaaactcacatttcccccaaaataattcaaccatcatagcccacatcaattcatccatcccattggacccaaaataccctaaatattttgcaaacaactatataagaacaagtctgtccttatgcagtaaaaaaatagacatagaaaaacagcccacaacaattcatcccaaaaatggtatgttcttgagcaatcatcactggccattcatccatcatagcccacaatatttcatcatcacagcccacatctaaacatttttcccaacatcccattctcccccaaattcatccatcacagccatataaaaattcatcactagctaacacatataaaaatgcacaagtcatcacagccatataaaaattcaccactagctaacacatataaaaatgcacaagtcatcacagccatataaaaattcatcattagctaacacatataaaaatgcacaagtcatcacagccatacaaaaattcatcactagcacaattcatatgtagacattagcatctaaacattgaatcaacaaataatcgcactatcacattatcgaatttaaacattatcatcgaatcatcaaatcatcacatataacatgtacacagcaaatcatcacattatgcatcatcatcggtgaggagtacctacctcgcttggggacggcggtcttgggcggcgccgggctcagggacgccgtggagggaggcgtcgggctcggggacgctggtcttgggcggtgccgggctcggggacggcgtggagggaggcggtggccgtcggggaggccggatcttgagcggccccggcctcgggaacggcggtcttgcgcaacggcggcggtcggcaatcagtagagggaggcagcggcgtgaaggaggtcgacgcggcggctaggacgaggtcgacggccgctgggcgtagatctagagaggaggatatgaggcggccgtggtcagtgaggccggatcttcgagggaggaggaggcggcagcgttgaggacgaggaggcggcggcggtcggtgaaacggccacggcgtcggtcttgaggactaggcggagaggaagccggcggcgggatcttgggcatggaggacacggacttggagaagaggccggcggcggcggcggtcttgggtgcggaggaggcgctggcggtcggggaggccagatcttgaaccgggagacggcggcggcagtcggggaggcggtatccacgacgagggaggaggcagcggtggatgttgaaccgggaggaggtggcggcgtcgaggaggaggaggcggcggtggatcttgaaccgggaggcgtggagggaggcgccgacggcggtggatctgagagagtgagagtgtgagagagtgagaggcggcgtcgggatgaggattgactaaataaaccctagtcaatcctcatctctatcgggcagactactatgcccgatgcggatgacactcatccgtgacgggcgttagtactctgcccgataaggatgaaagtcatctgtgacgggcattagcactaagcccgatagagatggaataatctctatcgggcatagtactaaagcccatcacagatgacttattaaaatatttttaagttataaaaatcatttataattaacttctacccgatttaaaatttctattacattttatttatcacatataattaacaaatgtcttatttacatagtttaaaattcctattaattttttaaaatcatataatctacaattgcctttctcacatatagtttaaaattcctattaattttttaaaatcatctaattgacaaatgcctttctcacatatagtttaaaattcatattacttttttaaattcatacaattaacaattggctttctcacatatagtttaaaataacaagtataattttttaaaaccatataattaacaaatccatttcttcaaagagttttaactagaatggcatgaaacatatgcaattcattcattaaggctccaatacaaattaaatacatcattcacagtgatatgccttccgaatggtctgaacgaacgtaagccacttcgtctttgggatcatcgtcaaggtcgatttgaggtctgacatgaagattcttgttgtattcttcttcatcgacgatgttgtccacccccacaattcttctcttgccatccctaacgatgtgcatcttcttgtttgcggggtcttttatgtagaaaatttgttcaacctgcttcgttagtacgaatggttcgtctgcgtatccaaccttggccaggtccactaatgtgaagccttccttgtcgaccttgacacctgtgcggatattcacccaactgcaatgaaacaaagggactttgaagtttagatagttcagctcccatatctgctctatgcggccgtagtatgtgctcgatccagcctgatcctgatatgcatctatacggactccactgttttgcactgtgcttttctcatcttatgtgacggtgtaaaatgtgtatccattgatatcgtacccatgccatgtgtcaacatcccaagatggaccccttgccaacctttgtaatatctcacttgggccatcggtcgaccgtactacacgatccttgaaccattcgttgaaacgagcaccatgttctctgttgatccaaatatctgatcgaccaatattgtcctgtcggaccttcgctaaatgctcctcaaagtatggggttacttcagccatatgttgcagcactgcgaaatgagcctgcgcgtaggaagcttgatctagaacaattctttttctgccagttgtgccgacacctgccaaccttcctttgtggcgagacgaaggaactccaataggatcagtctcggccatgtaatcgatacagaactcaatggcttcctcggtcatgtaaccttcaatgatgctcccctctggttttgctctgttccgaacgtaggacttcagaattccaatgtacctctcgaatggccacatttctctcataaaagctggcccacatatttttgtttgcttcactaggtgaacagtgagatgaaccatgatatcgaagaaagccagtggaaaatacatctccaagtgacacagggtactgacaatatcggcctgcaaaccatctaggtcttctggatctataatcttctgaccaattgtattgaagaaggcacaaagccgttggatcatgtgatggacttgtggtggtagaatgcctctgatagcaactggcaagatctgtgtgattagcacgtggcaatcgtgagacttcattccaaccagctttagatcctccaatttaacgtacttacttattctcgcgcaatagcccgaaggaactttaatatctaccagacatgatagcattgcgatcttctcatccttcgacaatgtatggctagctggtgggaggtacactcttcctgtcttctcatctgtaacaggctgaagttcactgcgaatgttcatctcctgtagatcgagacgcgcattcaacccgtcctttgtcttgccaggcatattcagtaatagccccagcaagctatcgcacacattcttctctacgtggatcagatcaatgcaatgacggaccttaagaacttcctagtgaggtagccgccaaaatatggattttttcttccacatcctcttcttgtcctccttgctacgttttcttttcttcccaaactcattagtaatgtccttcaccatgttgtgtacctgatctccggacaaatccgcaggggcagaccctagttctttcttaccattgaaaattttcttcgttcttctaaaggcgtgccgtagggggagccatctcctatgacccatgtaaaccatctttcttgatttcttcagccacctactgcgtgtatgttccatacagtcagagcatgccttctttcctttcacggtttgtccagaaagattacccagcgcgggataatcattaatggtgcagaacaatagaactcgtagcgtgaagttctcctgaccatatgcatcccaagtttccacaccctctttctacaaaatctcaaggtcatcaataacaggctccaagaacacatcgatatcattgccgggttgtctcggaccttggattaacaagcacaacataatatatttccttttgaagcacaaccatggcgggaagttatagttcgcaataagaactggccaagtgctgtgagaactgctcatgtctccgaaaggattcatgccatccgtacacaaacatatcctcatgtttctggggtcgacagcaaagtctttgtgctttcgatcaatattcctccattggatcgaatccgcaaggtgtcttagcaaaccgtcattccttctctctatggcatgctaacgtactaacttttcttcattggggttggcaaatattctcttgaaacgatcaatgattggtagataccacacaaccttcgccagaccaccccgctttgacttctttccctcccccgcgctcttttttcgcttgtatcgagaagctttgcagacaggacaaacatctaagtccgcctattgcttgtggtacaatatgcaatcgtttggacatgcgtgaattctccggacctctaaccctaggagacacagaacctgttttgcttcatatgtcgtctcgggcaatgtgttctcctgaggaagcatgtccttcagtattcccaaaagttctgtaaaactcttgtctgaccatccactactagccttcaacttcattaggtctaatgttgctgataatttggtgtgcttcaacttcattgagtctccgagtcactgaccaacctgctgaacttcatggaatctctctcgttcatagctgggtcatcaacgtcacgtaatatgtcttgcagcatatcagttccacatcaaccatttcaccgcccaatggagatgggacaaacatgtcatgctcttcttcatgtccttcttcatgattgtctgcaccacttccgtctgcagctgcaccatcagtacccagatcttgctctccatgcttcacccaacatgtgtatctctccatgaatccccggcgtatcaagtgagcgtgtacttccttttcatcgtccaaccaaatctcattcctgcaatcgttacatggacaacacatgtacttgtcatttcttcttatcctatcctccactgcggctttcataaaacttaatacgccatctctatactccttgtactgacacctcaagccagtcgtgtacatccaacttctatccatcgttgaacaatgaacaaaatattagttaacatctcataacataagtactactaaattaataggaaatgattagtacccttttacttacttttatgattttcctgtttttgtttgcaaaaaaattcaccccttcaacctcccaccaaaatagtgaacagtgggataactacagacaacagactgctggagtatatatagtgtgcaaagtatatcacaatcgggccaaaaaaatgtcatctctaacgggcgcacactaatctctaacgggcagaaatagaagcccgacaccgataagagtcatcggtgacgggcattaaggccatctcaatcgggccttctttggagcccgtcaccgatgacactcatcggtgacgggct

SEQ ID NO: 32871 - DNA, 42001 bp, Oryza sativa
  unsure (1)..(42001): unsure at all n locations
tcccccgcgggcacaaccactatttatatatgcttcctggataggttttgttcattttgcaatccatgatcgctcatctggttcatccactgcacaaaaatcatgcaaccatcgtgcctcccattgtaggttttaccaaatgcaacgatagatggtaaattcatacacatgctgcagggcctgcagcatcacttgctaccaaagttgatttatctgagaatgggtggcgtcggaaaaaaggcacacagtcctaaagagattcatagagaacacaattccaagggaaaacaatgtgggggaaattgaaagtgccctacgttttctcctgtaaaatcctagggatagaaaggttccctaggaattgggatattagggaacattgtgcacatggcatggccatcctacatgctccctccatcccgtaatataagggattttgattttttgctttgcactgtttaaccactcgtcttatttaaaaaaaattgtccaaatattaaaaaatgaaaagttgtgcttaaagtactttggataataaagtaagtcacaaataaaataaataataattccaaatttttttaataagacgagtggtctaacagtgcaagaaaaagtcaaaatccattatatttttctttaccagaaaacagtgagggatgcccccacggtatattaatttccatagagtatatgtatagaagacaaacgagaagaagaaaacggaaaactaaacaaaaattacagttgctctatccatgagcctaattaaatgtatactcaagtcatccttcaagtttcttaaccagttacgcactgaaggatggatacctaaatgtatactcaagtcatccttcaagtttcttaaccagttacgcactgaaggttggataccctgaaagataagcccattcctctccttccaaatattccaagctgcaattaagaacaattccatgaagcattggtgcgataccactgccagttgggcttgaatcatttgatgaaactgcagagtagtatcacagcaccaacccaacttattccaacaggctgagctgaaagggcaaagaaaaaacaggtgctccctgttttctctagcattggttgagcaagaagggcagatgtctgaggcattcaaaggagcacagtgtttcctctccagcagatccctagtattcactctgtccaaaaacaacagccagccgaaaacctttattttcatattaaccttactctgctagatccatttaaaattgatgggaggggataaagaccagaaactgagtttatagcagagtcttgaagtgtactttgccgatccccatatataagtccaagagtcagttgtatcctgaagagaaaagtcctagagttctctcttcatatcattgtactcatcaaaggcttgttgggagagagggaggaagaactgatcttgtggatctcgagccagatgctgggctacggagtcatctttgtgcttagcataggaaaataatcttggatatttagaggaccgaatcactccttcccataaatcatcccaataaagcacgtcatttcccgaatccaagacaggtttggcaattcctctgaataagacatcatattagaaaacatccttccaccaaaaggagccatgtcacacccagaaatttagcccaaatttccagactaaatctctgtccaggaccagccagggtacacaaaacgataagtaatatacagttccaaacgtaaataaagcgtaaaatacttacagaagaggcgcttagtccacacaccgaaacgaaagcagcagcagtggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaatgatgcagacgtgcatgggaatacaaggacggtttgtggctatttgcataaaggcggttgtaaaacattttattgagcaaacagtaaaacaatagagtaattaaggtaatattaaatctccactgatcaacgctataccacattgaacaggcccaactaacccacctgaactacggtgcattgagttgatttattaaggtgggactaatcacggtgaatctagtcgaccgcccataaccgcgggcacggctattcgaatagttttactctgattagaggtgtacaactgtacccacaagacacagccccacgacacatttccgtgtgccgacatgccaccacaacataccggaaagaggccgtgacatgacccttcgcataaccccctctaaccgatcgcaccacacctcagggttcgcccccgtccccagcaggcaacgggcagcccctctctcgtgccacggtgaatctaaaagccgatcaaccgaacaccccggccgacccaactccataacgcccacccttacctgggtacatcagctagaggaaagctacactacaagcccagccgttgcccacgctggtttgtggtaagtacaataagttcttctagggcatcccgcgaaccagtccttaattgccatgggtgtgactagcaaaaccatgcacccacagcccaccatttagtcgcattttagttggataattatgaccatgaagcatggccagatgtctcgagcacgcagctcattctaatactaaaaaggtctaatactgtaattatcccatcaactgagctagtggtaattaagcatagctaagcatatagttctagctaggtcacataagtaacatgagctagtcgatttattacccaatgttgacaaaggacagacatcaagtaaacatggcacaagcgagcagataggtgaaaccctgatcccatgtaattagcaaaacatgcatatttatttgcaaacagtaaaacatttgtaaagtaggctcaatatgctcaaggggaatatgtgacttgccttgcttcttcacaacaaccttctgaactcttatccttgcgaccgcggacttccgaaacgacggattctacacgctggcacgcaaaacgaggaaaaactctaataaaaaccaagcaaacagtacataaaaagtaaacaaacatgtagatctcaattttagatgaattttgcaagttgaatggctcaattcggagttcgaatgaattagatatgaattttagaagttttgagccattttaatagatttctagaattattattgatttattgcgcaattattgattgtttttccaaagaaaaaaagacatgctgacgtcatcaaagagggggccggcaccgacaggtgggccccaggcatcagcggctcaagggggcggcccacggtggacacggtccaccgcggcctcaggcgcgccgtggaccaggaccacgccggtccacgggcggccacagtgcagggcgggcgcagccgagaccggccggccaagcggcggcgaacggcggcgacagcggcctagccggatggccaccggcggcggcggtgcaacgcgggcggccggcgaaggggagatagagggagagggagggatgctcaccgagctcgcgcaacggagaggagacaacgggaacgcggcggcgacgggctccacggggaggcacggcaacggtgggactccggcgacgtccggcgaaggaggagcggccggggcacaacacagcctgggagagagagtagaggggttaggaagggaggaggaggcgcggtaccaagggaaattgcagccagaggcagcaatgggggaggtggctcgggtacgcggtgaaggggtggtttcggtggtggcgaggagaaaagaagcggtggccgggcttgggattgctgcggcgaagccagtggtggcggtgacacagtgcggcggaggttccagccacggggaacgacggccggagctcgcaaaggcgatggcggctcgggttgacagtggggtagtgttttggtgggagattggggaaaagaggggatgccgagatagggcttggctcggtgatgccgaacgtggcggcggggcagtgtggcggcggccctagcgacgggaaatggcggccggagctcgctggaggtgggcggtgatggggagcagcgtggggagagcagtacggggcgcgagaagctcaggaaaaatggagaaatggaagaggactcgcggagcatttttatagcgcggggagctcgagatcgaggccgggaggggcggaatcgccggccggagtgggggagaggcgtggggtcgtgggggccgatccggcgccagttttgcgtgggaaggagtggggtaggagagtgaggacatgggcggcgaggtcccacggccaggctggagcacgcggggtggaggaggtgggcgggggaagcggcgacgtggggcggctcgggtggccatggtggttgggagtggggagccggaggtaggagatgacaggtgggttccacaggtcccacctgtcggggagagagtgagagagggatgggagagggaggcaaaacggacttgcgaagggagaggcgagctggacttgcgagggaggaaaaacgggccgacggcccaagaaacgagggggaaggccagccgagagagggcgcgcgggccgcaggagggaaagggggattgggccgaaaggggcccaaagagaggaaggatgattttaattagttttcttttttatttaaattagtttaatgaactttgtgactttaaaattatttcttgagctccgaaaattcatggaaaaatccagagagtgtattagggcacaaagaatattctcaattgttctagacaacttagagatagcttggctccatttcttaagagagcaacgcaacctcttaaatttagcagaaatcagttttgcttgatcagttatgtgaagaatgtctgtccatgcagaagtgatatgatccaaaaacccaggctgcttcaaccagtaattctcaaatctgaaaacgttggacttaggtatggaggtagcaatctgaattttaataggagcatgatcagaggtattcctggccataactagggcttgcgtgttagggaaggcactgatccaattagccgaagtaaaaacccagtccagttattcaagaagggggtctgcttgcatattactcaatgtgtaagatcttccacttagagggatttctagcaggcccaaggaactgattacatcattgaatataaaaatatcattcatgttgtcccccggtttatttctattgtcaatagacccgtaggagttgaaatctcctaggatcgtccaataatcattggcaatatcaagatcgtgtaaccactgtacaaactcatctctctggggaccacaggagggaccataaacattgatcaaaacccaattctgaccatttgactttgaagtgaaactgaccactaaaacatgttgggtttgttgcaggagcacaccaaaaaacatagagcttcactagccaatgaaaacaccccccgaggctccaacagaaggagaaaaaaggaaattatcaaatcttttaggggctagcgtcttaacgaacttggcgccaaatgatccttttttgtttcttgcaaacaaaaaatcgagcaagaactttcatctatcttttgctttacagcctgacaacgagaggaagagttgagacccctgacattccaacacaaaatattccagtttctattgtgtgaattcattgtcaaacaaagagcaataagatagagtcctatgcataacataggagcgaagagtaacagatgaaacgatccaggcagaagtcccattcatcataatagcacagcttttaaaggcaaattcattattacaaatcttggagagacccaacatagggcaacaaaataacaaaataggactgttcattggggcagaatttagggagcagcagcacagtgactcccatttccagcatgggcagtcaaagcttcagcagataccatctccctgctcatcccacagacatcagtgccaatctgttgaagctgtatagaacaatcagcaggggggcatcaatctcatcatcttaagcaatacgatcattaagttccaaaggcaaagggttgagagagagcaagataccactttcttgagccagcattttaagcttcttggagctctttgccctagcctttccccttggctttcccacacccaaatttgggtcaggggacataaatccatcagaaagcttgttaattctttcacttctccgtatttctgaatccaacaaaatcaacttcccagtcctccttttgggccttgggggtagagcaggagagacatcttgttggaatgggtccaggagaagattcaacactgaaactgtgtgttgaggatggatagcttgaatcggttggactgaaataacttgttggctgacccagttttctttggcccatatcaatgcagaagctagcatggcaaattgaaaaacatgatggacaggcagctggtatgggactacatcagatgacatgggctgaggcccaagcaatcttggcccacacaggagagtcctacaaatgctgagcagtttccaaaactgagggtaaacaatgaatgaaggcacaacttcctcagtctggctgaccagtggccccattgcaacatccaaagaaatagtaggtgccacttgatgggcagggaaaatttgccattcccctgagtcctgctgggagacagcactgacattgtgagaaagttcttcctagatctgtgcattcacttcatcattctcacctatgtcttcatctgcatttccccaaacattagcttgttgaggaacaggagatggttctggcaagggaatgtggttcacaagtggcagatcctcatctgcaggctggacatctgcaaagtccccattaagcacaaacacagaaactgtctaggagcggccaacacctccaaagcttgagtacttcttaatcaccaccttagagagggacctcctcaaccatggagtaaatgaccttcgcaagaaccctgcctctgaaccttggtccactggaccaacaaagcaaccaaccaaaagtaccaactggtttgtccacaattctgtcggtttgtaggtctagagggaaatctaagaacatcacccaaccctctctaattggaggggaattgtggcaagtggaggtgttatcatggttgacaaatcttagggtaatctgttcattgacatcatatggccctcccaatactagagcatctctaagcacagccgaggcaatgtgaataaaagcaaactcagatgcatgcctactggtgtccaacacatgataacccagagtgttttgaacgtagtaaaccacaaggacaaaatgctcttgcttcttgggagggggttcaagaatggcaactgcgataccttcatgcttcttgggaggttcatccatgatgatcaaatctgcacgagggagacagtgaagccaagcatcattgatcgccatcgtcggcgggacgaatggagtaggatccggattgatgttggccattggggtttttggagcactatagattggatttgggcggagagcgagaggaagagaggaagaagaagcgtcaggctgcaactgcctataattaaggcacgaaacgatgccaactaaaatattatgctcttcctccagcgacttccacgaaacaaccaaactatcagttgcgggcctccgactagaagaagcaataactgaaccaatgggctttttagccttgggcttgcgaacccagactttcttttcagacttttggttccagcacactgaagcccgatgatcaagtttagagcaagctgcacagcggactctatttatggagttagattccaaatgacctggcttctgacatctagggcaactaggcctactaacagaagaggctttaacagacagaggcgatgattcagccttagattttgaatttgaaatcctagaagacctagctaaaataccgcccccacattaactggattcttatccatcttacctccggtgatcgccagaagaaagaagacaaccgatggaacaccaattttacaggcactagagcattgttggcacgaggaactgatttgcggctgctagagatagtcttggaaacaatcttagactttttcttgtgacgaacaattgtccaatcagcctcttgagctgccgaccagatatcatattccttatgccagttagggcccccatctctctagaggaaaaaccgagcaacataatccttgcaagtgaaggatctaagattatagatccaaaggccaactttcttagaacaaactgtaaaactgtaacaccttccagagagatgagagacatggagatcaccagaagaaccaccaatgcaagccctgagggcgagagccgccgaagagcaacaaagccaaaaagaggagtgaggaaagtctaccaccagggtgaacggacgattagagaaaaagagagaagtgaacaggagagcggaacctgagtagggtttcatccctgatgtgatccccagggagaaatcccagcctcccaaaggagcaggagtcaccattgccgacccaagagaggatcaaaacccagagacacattagtaaagtaatcaccactctcattgcaaatagtttgggaagcgtgcgcatggaaaacgaaacaaactttctcacaatcttctgctgcattttttccattaaatttagacaagactgaacgcatagtttagggctgtcatttaggattgttataaggttggtagaagaaacgtaactctagaagttggagccttggagctgagaacactctatggttttaagggcaaaacatcttctttacaattaataatattataattgaaatagtaaaccattttatctcggcaaataatcattttttacaacaagaagttggagcctccacaaaaatatacctttaatcgaatacgaacattatgaaagaactggagcaacttcatgcaaaataaaaacattacattctagtagcatagtttggaccacctgtatatctccaccgcagttactatgtattttcttcctctcaaacctcggttacctgctcctgaccttcaccggtattgacccctgggcacaagctcgactgcttgggcttcagatcgatcagagaacgtgtctacatggagtctgaacatcttcatacacgtgcttacttgtcttaatttgtggttattttgttgagttttgcttgcagcatctatttttagggttaattggattcatgtcattataaattttacagttttaaaaaatgccactactattcatctatttggaataactactctttgaaatatgtcactgtctacccttttaatataataaaatttctttttggaccaaattttccatgtcatcttcctcaatctccttctctctctactcctcttcttcccatccctcttcggatttggagctacacccggttggcttgattcagtggtggccggcggccttagaactaccggcgaccagactgaaagcagcagctgcaactagcatcctcctcccctcctccggctgcagcgaagcaccgcgcaggcgaggcgaggagcgtgacgacctcggctgctccaagatcaccttccgccgatatgttcttgtcttcttaaagctcgttttacattgattgtgcataggactatcagcaacagatatgtgttctttcatccgtgcattgttttctcttttttacttctttatcttttttttctcaaaattgatttgggcgtggcgtttcgcggctcacacgataacacgacactgcggcagtacgatctcacagcgccggcaacatcactttgactccttcggggctgctcgccgggcctctccaccacgcttacaccgggaactcagatccagaaagagaatgggaggaggggatggaggaaaaaagactcaggtaatttggtccaaaaataaatttcagtgtgttggaggggtatgtggtggcatttcttaaatatctactaaatggcacgacttcaaatagttaaatagtaatggcatatttcaaaactataaaggttataatggcatgaatctaattaacccatatctttatggtaaaatgtattcagtgcacacacactatttgaccttatccaaacatctttcgtaagccgtccgatcagttgtaatggctaagatatgaacacgtggatgttgtactgatcaagtgatagagaaatgagatcacttgccagaaaaagaggaccacatggtatctgctggttgttacatagattcacgtgcatgctactgagtctaacatatagttacactaatatatattcttttttaatagaatctttgatgatgtatatctcttaaactgtatattttttttaaatccgtttgaaccatcatactctactcaaaatatatgacaaaacaagtctaatattgaatatatttaaattatttaacctttcttcttaactatgtcagaggatgaactcctctagcgggggaccgtgagaccccccctctctttgtgagttcggccgggggcagcggttgagattcgaggatccctgtgatggatgagagaaagagaggggtcaggcccctcgaagacatagagacaaaaaaggtttatgcaagttcgggctgctgagaagcgtaataccctactcctgtgcttggctgaatctgtgaagattgtagatgcttgagatagtgaatctgaagtgtgtgttagaaaatgggctcatcctctcccttagtaggcatggacctccttttatacctcaaggggttaccacatgggcccaagaacctgtctatgggtgaaggagtacaatctttgcattgaatgcatgtcttgttccttgacttggaagtcacgtgcacgtcatctcggtcgtgggaccggtcaaatcgaaccggctgacataggggacgcccgtttcattcatcatttaatgggtgaagacttctgggttcctgtttgcaccgggaaatgggaaccctgcttgactagagcggatgaaccaactccggctgggaaagcctctcatcatcatgacgtgacggggcatggcaggctgcacaccgcctgacacatggtcaatgcgtaggcgcactaccccagtcccatcagtcattcgaccgttcatagactggttaggcgcgcagcacgccgcattaaatgcggcgtgacacgcccgttcggtctgatttaaatgcggttaggtgggcggtgggcgcgcccacccaactcgcaggagtaggctgatgcgccgagggggtcgggacggcccgacccccaagcgaggaggggtcggccgccactccaccctaggctcgaccctactcggggaagtgcaacgtgggtctaagggcagcctcctccctccaatctcggtaccccaagctggagaggggcagccgccgctccaccccaggcccgatctccctggagggggggcatgtgggttcgggggtagcctcctccctgtaaagatgatatccccaggtccatatcaccgataaacttcactagcagtgtagctattttcaataacgtgaagagttacttttgtataacagttactttccttatagcagtgtagttgccgtgaaaacttaattctatctagtagtagagttagttatttatatattatctttttatagtcacttccctttaggagtgtatttattatgaagagttacttataaaaattacttttctctaataatgaagttatttctaatatcgtgaagagttaatttctatatgatgcaaaatttttgttttcaaaaataatatagtgattactttgaaaatataatacatgtatttacttgaaaatcttgtgtaaactttacttgaaaatttactccacatattttttatttgaattcggtcctaatgtaattacttctaatagtacaaagagttaattctaagttacttttaaatttaatatattttcctgtaatctattttctttttctttctttctttctttttctttgtatatgtcgatcccttatttaatatattatcgcagtaggagcctctcctgcggtttcccgtcaaaaaaataacttttaaatttaagtaaattacttttaaattaataaaatatctgaatatacgaattgtattacgaacaccgtacctaaaataattccaccgttagaaatagtaaaaagggcaaacgaaaagagggttgccttgtgttgaagacgagtatgggcaagaagagtcaaacagaagacgggagagagaaagaaagaaagagcagagtgtcgagaggttgaagacgaagcagccttggaacagagcgaaggaagaagcgaggagaggcgaggcgatggggatccggttcgtgctgttcgtgaacaagcaggggcagacgcggctggcccagtactacgagcacctctccatcgacgagcgccgcgccctcgagggcgagatcgtccgcaagtgcctcgcccgcaccgaccagcaggttttggttaaccccccaattcccgatcccccctccgattcctcctcgttttcttggatccaatattgcccagcgcggaaacttgggctccggattggtgggtgggggagcggggaaaggaagcctcctgttcttggatctggatctgtgcaggttcttgggtgttcgttctcttcctcgtgatgatgtgatttgtatgatccgtgcgattgcagtgttcgttcgtggagcaccggaactacaaggtggtgtaccggcggtacgcttccctcttcttcctcgtcggcgtcgacaacgacgaggtattgattcctccgccttccaattttcattagacaaaaggcaccctgcctccctttgttgaacaattcggatgatttaccaaattttgccattaaattccattttatggcaccgaaatgctcctgcagttgcagttagctcatagtttctgaacatgtccttgctactaaaaatgatattactacttagtagttgagggtttggggttgttatcagttctgaagatatacggtttaatggtttctattaggaactagaaatttcacatgagaagtttaatttactcaataatcatgaagtatcccgcatcgcaacagaggcttacatcttgttcatctgttttcttctttcgatgaatatatgcacaagtcggatttgctaattgatagtaatgtgaaaatgcattatcattgtctttgatggaactataagatatacgctattactatttatttatcattagatagaactctttagtaagaaaatttgttatattggtgattctgtgtggtaacactatttcatacttacatctctgcatacgaatctcagtatctccatcttatgcctgttgactgcagttcattgtttgctgcctggtttctcaatgaattttgtagcaattgccgaagtcaaatcttccttcaacttgttttggttgcaatttgcattgtagttttcctctgggatgtcaatcataactacagcctgcaccatgttttccttgattcatattaaaatgcctcaattttcttttgtttggcagaatgagctagctattctcgaattcattcatctttttgtggaaactatggaccgccacttcggaaatgtggtatttttcagtaatcccaacaattatttttcttgtgactgtaaatacgctcacatatatcacatgggacaagctgatggtaattatccttttggccagtgtgaactcgacatcatgttccatctagagaaggtgcacttcatgctggaagagatggtgatgaatggctgcatagtagagacaagtaaacagaacatcttagcaccaatccagcttatggagaaaacttcttagaatagcattctctaactatctagtttttaatccttttgtctctgtggtgctttatctttcatctactggggagtataaaaaatttctgtttgcacatattattgatatgagctgactggagatgattatatgctgaatacaaagatgcgatgtacttttcttcatgttatttcattttgattttttacacatgatttgtgaagattacaaagccactgattgtgagatcataataagtgctacggcttaaattgtcagagggtgcaattgatgtgaatcatgttaactcgaattgatgtgtgctccaatttgatcaccatttttttactctaactactatacttcatacggagtactataatgctgtagaactgttaaattagagggagcatcttgtctaggtaattgaagggaaaaggaacgtttggactgttgtaagcaggcatgatcctatctctgaccatatagatatcgtgatatctaactttagatgaggtagtggggcaaacagaggaaatgtgtagattgggtcaacactatcgaccatgatataattcccaaatctcacgaggctgcaatgtcattttcatcttcctgatcttgattgatgaactacatttatcctagcacgatcggttgttgcctgttgttttcatctatatttccatgttcttccgctgaatgttaccttctttccactggtcaagtacttttgacgacttgtgcaggctctatacgtgtttaatcttttcataattccactcattcccagttaagtttgggtatcactcattcccagttaagtttgggtagcctcaaccctttttacaaaagggcctttcatctatctacgcttgagtcacaggctttgcaatatataaagacaaagcgaggacactttaaaggaagtgagtgattggtagcgaaaatatagtcacaggctttgcaatatataaagacatggcgaggacactttaaaagaagtgagtgattggtagagaaaatatattccgtatccttggcaactaagttgtaaatggcttattagattgttatcttcaataactttttttttagaattaaacagtacaacgcagacacttacaatagccagcaaatccttatcctcgagattgacaaagtctacacttgagtcataggctttgcaatatgtaaagacacggcgatgacactttaaaggaagtgagtgattgatagcaaaaatatattccgtatcctcggcaactaagttgtaaatggcttattagattgttatcattaatgacttttttttaagaattacaccgtaccgaggacactttaaaggaagtgagtgattgatagcgaaaatatattctatatcctcggcaactaagttgtaaatggcttactagattgttatatttaactagaaaggaagcccgcgcagatgcgcgggcattttatttgttgttttatgaaaataatgattaaaaaaagtcacatttcactgtttctaccatatatatattaatatatttaaatgataaggatgtcttctaaattaaaaaaaacactttgttccggtttcatataaacttccctattgtcactacaatttattatcactttctaaagttgagtacctattaataaatgaaactgcatatgtacgaataaaataagtctaatatattattaatacactaaaaatatccactatacctaagtgtttttgtctcacttatttccaattccatataaaaacattctaaaaataccacttgtaccaattaataggatacatcttaaaattaaacataaatgcccctataaagtgtgaagctcattgtagccagcaagactttatttctttgtgccttgaaacatgggtcctgcattgatgtagctgtgcccatctagaccagtctggagtataattttaatgtctaattcactatcataccctcatatagtattgcatcactaagtagtaagttgggcactattggcgacggtggcctccactagggccgtctcaattcagctatatgtatgcccgtactaattacgatatcgtagcaaactctgttatcgatgcttggtgcccttcaaggaaggacaaagatgaaatggagatgatcaaaatatttttttttatttttttatgctatagatagagtactcacttttgaaaataagcgattttaatcattcgatagaataaaaaaattataactaaagagacataccaccaggataatcttcgtagcactatattatttttatattttgacaaatatctatagcgtagcaattggtttattttcaacacctatttttgataatcatatgagacacctttaagaatttctttttcaaacttgtataataactaattcgtaggagcatactttagtcatgtcggtggggtgtatgatataaatctattaattatgtttgatatgttggaattcctcaattataagaaaaatatatcatgagtagtttattttacatattattttattgttatcaaactatttgaccagataaacaaaatatacatatataaccatatatctcatgatagattaaaggattgtgttatagcaggatcattggttgaaatattttttataatatttttcacatccatgtaccatctgtgctgctcacttctctaataacaattaagtagttctggaaaatttcaaaaaaacactttgagattaaaaaaattaaaattaaatcatatctacttaaaaaacttttcaagtgatatttgacaccctaaaatatgatgcaaaatcatttaaaaaattatcataacattaattactatttatcggctctatgtgtcgtgatgtatttagtaggactataatataacttttataatatgtcaatagttgatttagataaaaggaatacaacaagatccaattaaatatataattttaatttttttttgcgacggcatatttttttatggtgcttacgttttttttttcttttggcgaaccgtacatacgcaagcttttctgttttccacaaagtagtacctactttacgtacttttgctttttttttttcagccaactgttacatctaaatttcctctcgtgtatgtatatatcggaggaaggtattacacttacatatctaatctaaaacaacggtctggaaatcaacgtgtatggattttccttttccatagtacgaacagtaaatacttttgccttttttttcggccaactgttggcatctatatattctcatatatatgtaatctaaaataatggtctagcaactaaattataagtgaaaattaactgtgtagatctaatctaacgatctaaaataacgggtccaccaatataagtgaaaatcgatgttaagattagatagtgccacgtggcggtttagaagcgtttatatgagtgccacatgacgatttagaagcgtttgtaggaagtttcatggacttttagtataaaatagatagaagatagatagatagatagatagatagatagatagatagatagatagatagatagatagatgactttttttagaattaaacagtacaatacaaacacttacaatagccgctatccttcagattgacaaagtcatcacaggcgtcttgcccagaacctcaagtgatacttagactcttgtaaccactaggctacaggccctttcgcatctttaatgactttgtgacaatttgagaagcactgatggtttagtcattttgtttgtgaaggttgttttcctttgtcacctaaaaacctctgaaatgttgtattttttatgcaagaaatattatctttttatcttgcaaaacaatgttgataatatttttttttggaaaggacaaaaaatttcacgtgcacataattaagaaataatggtaaaaatgtgctcaccaagcatgcacgtcatcacggtttttgtcccaaaaaataaaaagaaaagaagaaaaaaaatcatccaattctgtggcatgaaaaagaaaagaagaaaaaatcgatccaatctctcccgtcgcacatatgaaaagaagcaactcagcaagttgtgactagatcagagaatgggagggaaggagaggatgaaaatggagcggatttagacggataatagctctatcatatcctaaactatttcttaagtggatacggagcgggtacggatgacgtgcggatgtggagtggattatttcggacgttggattcggtgcggaatcggtgcggactcaattcgaaaaaggataaaaagttatcggatgtcaagtttgtattcagtccatataataagagggcagcattacaattagccgcaatacgatagcaaaacaacatctgaacatgatctcagctctttaggaaaaaccaaccaaaacccatcaataatataattttgcttaatataacacatccaataaattatcaataatataagtgttcagttcagtagttcaatggtcactgcgttgcttaaaatttaaaaatataagtcatcactgccacacaggcatacagcacacactgcacacaggcatataggcacactgccacacaggacacattacaatagttcggtagttccataggcatacaggagcggccgacgcgtgttggggagagcaaaagactgaggaggagcggccgccatgctgggtcaccgtcgcgccgccactctcagactcctcgacctcgtgacggctgagggctgacggcagagagagagagggatctgggggaggagtgaattaggttagggttataatagatgggctagatgggtctgaaagttgttgtgtggcctgaaagttgtgaattatccgccaaacagtacatcggataatccgattaaaatatcggataatccgcatccatcggatatcattgataccatatccgcatgacaaaatccgcatccgtatccggccggatactaaaaacccttaccatatccttacatcggacggattcggagcggatcggataatatccgctccgtttatacccctaatatttagtggcaatcgcaattagagttgagattcgtaatctctgctacttaaaaattccgtagtggtagcggtgactccaatcctgatagacacgcgtaatactaaacgtaggatcgtgaaatccaatggctcagatcgcttccgcaatgctctgatcctgccgagtgcagacgcgcacgcgttcccctctctcccgagcggtgcctttgatccttcttcctcctcgataccctccgtatcaacagcggtcaccgatccatcgtccagacgccgccgccttcatcctccttcctccccatcccccatcccccagcgcccgcattccacctccccctgcggacggcttctccaccgcgccggcgccggatcggcgaggcgggagcacgtggccgcgggaagagcagcaaccggtcaccccgccgccgcagaacgaggtcgcctggacggccgccgccgaggcctcccgctcctccatcatgttcgggtcagcgggcaggccgtgctacatgttctatgcttcaccggcaatggcggccaagcaggtactcatccattgcttcccccttcctcttctttaactgaatgaaaaatccttgcgtttttggcggttgagtaaggtcgtgtgcatcggtgagtgcatcaaaccgctgaattccatgtgtgatgaaagggggagggatgtgagcagattggattgtgatgattttttaacagcgtgcgtatagatgaattggggagggatgtgagctgattggattgtgatgatttttcaccatgcatattgggcattgtgatgatttttcaacagcgtacctagagattagctgtcaggctctcaggcaaagcatagtaataacttcatctgcgtcttcaggatcattggcatgcataacaactgtgattatgcatgatctcaaaaaggggcagtaaattattaatgatgaactactgcgggactattctctctttttttccctgttttccttgagtgattgatatgagaagatattattttttctgttttttgcatatgctggaatttagaataaaaacaattgctctcgttcatcacaaatctttatctattaagatatcatgcttcagaatttatcatggtttggttgttagaggggtttcaaactattaatccgttagccattctaacgggttagaagcactacaatgttgtgtagttgcctggagaacatgacctaaaattgataaaatgatgagaaaatgaagggcatttcctttatccagaccatcatccctttatctgaataactctggtttttttaattttttgaatccattcttgacatttggtatggtttgtggagttgttcagataacaggtcaaatctggactctgctcttcttctttttttaaaaaaatgtaataagtttgaagttctgatgttatatccccaatccatgcatgttgtgttgcttgcatcactaggcatcctagcatcatggattgagtaactacaattttggttgcggcaagtatttctgaaataacctattaccctgaataggatttatctgtacaatttaattaggtagcaaagatacagaatgcagtctactactactaacttgaaggcctgcacttcttaacctgtacattcttggatctgcaaatcttgcactaatttgcctaaggacactcaaacaacattataatttgttgcacaacaccatggacattaaaactgaatactattataagaatggtatcttgaatattttgtagtattgaaaaccacattctgaacattagttcaagttcagaaatccgcattcttgcaatgtatcttacctatttcagtacatgcaccatgttttttttttcattttctgcagtacagtctactcatctactttgctggtagcttttgcatgtcattatccccacatcatgatgtacgattttcagttttaggtgccagttttggtgtgaagaactaaattgaaaccgaacaatgattttctagagttgcggttaacttctaatcaagttagttctgcaatggataacaatggtggcggttcagcaccaacatcgtccaaaagatcatgtaattgtttcatccatccagccatggtcatatccattactcaattgatatatttttgcttcctaattttacatacactcttcctttaggtccttttgtgaatataactaatgtgattaatgccaagttgacaaacaagcgtgccgcgcggttatcccaagtgaaatcaatgttccaaaagaccgtgagaactgtcaacagatcaacaagaactctacatataagattcagagaacctcaactattggatttggtatcatacttatattggctttatttttttaatatatgagatatttgttttaggctaacatcagcattctgattttgcggtgcaggctatgaaaataacgcttctgtcattaggcatgtgcggctaccatgcacagacaaagctgaactgtcgtacggtacacccaacatgcatgaagatgttactaatcccagtacggctgaactaaaaaggaagtgtgctagagagaggtacccattattgacaaaagagctaaaggaagatagaaacaagaagagacgtgattccagaaagcggaggaaggatgaatcaattggtttttataaattaacacatctattgttatcaaaatttggactttttgaacacaacaccttattattattgaattaattcaactctttcatatcatggatctcaagattccacgaccaaaatggctactcctacatcctcatctgtttcaggttgatgtgtaatatttcacatgtagaaatttgttaggtgttttgtaccaaatacgttctaatctatttggatatgagcagccccgcttggagatattacaaatgtacgtgttgactgcttgcttctggtagtttaacaaattttcactcaatttctttaaacttaataaaatttcccgttgcaacgcacgggcatcttacttgtatttatttaatctgaatttcgtggtagtacttgggtagtactgggctcatactgtccttagtaatgcttcagtccttgtgcttgaaatttgagctgttatagctctattgcaattgacctgcggtgatatgtattgtcctcactgaatcatattttcttgcgtctacctgagtttgaagtaagataaattttgcaacaggacacttcgacttcgtggctttagtcgtggggcactgcccgaactcacttttgaggaaaaacactacataaacataaggtgatttgccaatagacaccgtgttgattaaaataataattttcggttgaagaggatttgccaatagacaccgtgttgattaaaataataattttcggttgaagaggagtgagaaatcgtatgaaatatcaaaaatatacccttgggcccacatgtcagttttcctctctctcttctaatctctctctatcttctctcccatagggggagtcgatcgccgggaccgaagacncncggcgaggttatattactggcggcgtcatggtaggcacagcagcacatggtcccgtcgtcgaagacagtgacggtgaacacggtggcgccgtcctagcggaagacgaggaggtccccgtcgcgcaggtcgtgggcgcgggcgaaccgcagccagccacggcccaggtacacgccgccgtccccgtcgccgtcgccacgtcggcgaccaccttcacgtcccacatgcggccgcgccgctgccccgcgccagcgacccgcagcttcgtgtcccggagctcccgctcctccgcttcgccacgtctttgccgtcctagcagaagacgaggaggtccccgtcgcgcaggtcgtgggcgcgggcgaaccgcagccagccacgacccaggtacacgccgccgtccccatcgccgtcgccacgtcggcgaccaccttcacgtcccacatgcggccgcgccgccaccccacgccggcgacccacagcttcgcgtcccggtgctcccgctcctccgcttcgccatgtccttgccgtcctccgctgctcccgccgcaagcccgcggcggccgctcctaccgtcctcgccgtcctccgccccggcgaccgatgccccctctgggagagaagatagagagaagagagataggagagctgacgtgttggcccaaaggcatttttggtatttcacgtgatttctctctcctcttcaaccagaaattattattctaataggtgcggtgtccattgacaaattaccatatttatggagtgttttcctctaaaaatgagttcaggcggtatcccacggctaactccacgaagtcgaagcgtcctgtagcaaaatttacctcgaagtacacacttattatcactaaaaatgcacctggctaccttgcagatcatgcacttttctggtcagtcttttctaaggttgttcggtacaaacatatatatttagtgaatttattttgttgccacagtttatagggataattgaaactattgtttagatgctgtgttgggtactccaagttctcaacactcacctctccttttccacgcgcacgctttttaaactgctaaacagtgtgatttttgcaaaaaaaatttatatacaaaaattgctttaaaaaatcatattatcattttctttaaaaaaatagctaataattaattaatcacgcgctaattgatcacttcgtttttcgtgcgcactgtttgaagttaggaactgcatctgaacacagcctaaacaattctttcaccatctgatcgatgtcatctcgatccgagcatcaccccacagcaacagccactttcatttttttaaagttctattaaaacactatataaataatattatttatctcttcttcaccggtagtaatataccggtaatagatattatcaccagattttaattcttcgccactctcacagagcttgctaccggataggaaaagagcatttaatgcttcttaccggcagctaaaaagtaacattgttgatgcccttactgatcgatgccaatctcgatcctacacagtttccgaacatcgcggctggatacgtatacaaaagaagtaacgtaaacaagtatctctctgtttctttttgtttgatgccggttagttcaaaattacactaatcaatactatttatttgaaaacagaggtagtaataaacatggtgaatatttgtttctcattgtttatttgtttctcattattccatatcgatcgagcttacacacatatttaatggactaaccatattgttgatcctaatcggtgcctccattatttattcccgcgtgcatgcatttgccgtcgttgacacatcacggcttggccgatgttgcggccgacgatgatcgtttgcagatacgtaaaactcggcagatctttgttacgctcgacggcgggacgctaggcttttcctccgtgacatctgcgtggcctgtcgattgctccatcacgcatgcgaatggaaacagttaattaatgtacgtaggagtatgtgttacttcaaaaaaaaatccaatatatataaaaaaatatatactaaaccagaaaacgttcaaagtaattcctcctcgataaatttaaatctgaggcaattattatattttaaatagagaaagtatgtagacatagctagctatacttaattaaggctttgtttcgcaatgaaggtcttgggcacatgcaaaaatggagggactcgtaaccatatgattaattaagtattagcttatcaaaattagaagaaaaaattaatattttttaaaaatagtttttttatatacataactttttaaaaaaattatcgtttaatagttcgagaaacatgcaagtagaaataagagagtagaggttaaaaaggggagggccaaacacacgctagaagaaagaaccgcaactccaaatgttcaaagagatgtagtggttagtttctccacatgatatttcacaaaacatatacagatggaactggtaattaacactgatgttattcttaccggcggcagtgttcgtgggcatcggaaccaactggcgggcgaatgccgaaggcagcagagcttgctgctggctactcaggaccagcaggattgcaaggctaaacagcaagtacttggcagaaggagaacccatatttgcttgtgtagtcaattagtgcgcgcgcagtagctacgagtataactaatttgcaattgcaagatagcaagagatatgctgaatgttttgatgcagttgcagtcgatcatcgagccaattatagtcaggcaggcctacgcctctttgtattactcaggcggcgtttttagtgataaggatgaagtcaagtcgtcgtcgactgggtgtgtgcttccgagaagcaacgtcggtaaagcaggaagtacaagccagcaggctaaaaaacaatttctgctatatcatcacgttcctagagagaatctataattgaggagagagagagcacaacagatatatatcctttcgattaaaaaaattgtaggaatatgagtccagataattatttgtttgtccaaattgatctttgcaaattagtttttttttaaacggaggatgagatatttgtttctagttttttgaattgttggtagtagggtggacacactttttattactgtcagtcaatttttagattttttttctgaaaaataaagaggaatctattcccaacccaaaatccgattagcaatcttgaggttgtaattttgatgatggattatgttgaacggtcccacatttgttgttgaaggataaaaaaacaatgtataagagagaaagcccttaccttattggttagcttttaaggtagaaaagatattttaagattttacaattggcattaggtcttatctagtttaacatctttgtcctaagggacatagtgaagttctaatagaccataggtgctgcggtaccaatataccttagatacttgtcataagtgacatccgttggaataacgctattagccctttagaagaagatgctttggaagtgctttttattttcaacgagaaaggtagcccgcgcattcgcgtgggcatgtattatagtttgtgtttcaaactctataacgacggaatataagttgtagaacatttccggaatataaatcagaaaagaattttgcatagatgcacaggcatcttatttgttattaaaaaaagaatgctaaaaggaatcatacatcactatatatataatcactatatatatagtgtaagagaatttagatcatcctacaataaaaaaaggaatatatttaccataaaatagatggtagattttaatatactactaatgtgataagaatgtctcttagatttaaataaaaatccctttatcctggtcatatataaactggttgtttgtcatcactacttactataattgttttaagagttagatgacttttaataaatgaatctgtattagcaccacttaaacaaatgatacattattaatacactaaaaaattcatctacacaacataacccggtgttcatcacttttttcaatcatatgtacaattagtataaatatatcatatctaccgaataatatgataacaccattaaaaataaacatgaatgcctctctaatggatgaagtatgtaatggcttaaaacatataggtcccgcatttcgatgtagccatgcccctaaaaaccatcatacaatacaatttcaacacttagtacactattggtacacttacaaatgattatattgataactatgtcactttagttacattgcctatgatggtctttcacagacaccaccttaactcaaccatgtagatgcccatacaatatatatgacagcgtagcaagtactgcaccctgcattaaatgtcaaagagggatagaaagaaggaggaggtgatgaaaacaatttttttcaaaaaaatttgagtcgatttttggtagagaatagacaaaatgtgtatatgaagttagtaataagtacttatcaaattttaatggaatacatacaatatcatatttttcaaatgagtggggttaatcattcgacactacttaaaaaaatatagctaaagagatgtactaccacgaaaatctgtaaaacaccgtatcattatttatattttgataaagatttatactttagcgccaaatttgtttccaccatatgttatttataattatatgagactcatttaataattctaagaatgtacttattttcacaaacttatttacactaaccaattcgctagagtgcatttatagttgggttctgtggtgtataacattcgtcaattatatacccagtatattagaatttctatcaactacaaaaaatataatataagtagttttatgcgtattttattggattattcatgttttgccaatactacttggcaaagataatacatacttctcgtgatgaattaagagttgtattctagcaaaataactgtctaaaatcttatttatttttttttcacatctatctatcatgtatgcttctcactcctcaaataacaatcaaaaagttttgaaaaatttcagatacctttagaatctcaatatcacccaaaataaacctaaaaagatccacttaaaaaccaaagctaaattctattgttttattatcactggctaaaatttaatttatgttttctcatcaatctattaattgtgcttctcacacctcaaataagaaaagttttgaaaaattcctaatactttgagaatctcaatctcttccaaaattaaataaacctaaatagatgtactcaaaaaacaatgctataggttttgttattttaattttttacatatgtagattcaaattaacgttgtatatttgtcacgtgatatttgacaccataaaatacgatatgaaattatttggaacattattatcgcattaactattacatgttggcgtcatttgtcatgatatatttatcactacaataagtttacgattaagtttagctgtgcatatttgtgtagtattatttataataaaatcgtagattaaaggatgttgacaacaaatcagtgctgacgctgatgatttttcatgattagaatttctttccgatactactatgtacgtgtgcatgttttctttttatttttttggctttatcttttttcgatcatatatggtgtaggtatttaagtttttttccccgagtaggagacgatcgtacgacgtaagcaagttatgtttttttccgggatagagattagcagcacggaaattttaagagctctaatccaatgtttaaaatagtgggtccactaatttaagtgaaaattaaaggttggatggttttctttttctactctaaatttttaggatttctctaattttattagagcatcacgtgacaatgttggagtgtttaatagacttttagtgtataatagatttttagtgtttctctaatttatttgagagaaagtttaatgtactttttttatataatagatagatttagaagatggtttaaaagaacattgataggatatttattatagatcttaatttaactaaatatatttatatgtgtgaagtaatatattttatctttatatagtagaaaatcatattttaaataccgttgatttttatgaatgtatgttttttctgtcatttttatgtacatgtatatgttttttttccagcgaagattaggaaagttttgttttcaattatgtacaacgtttgtacgtatggaaagaaagcagtggcatttgtaacgtataaactcaaactcatacgtacatgaggatattattttttaataatagatctaatctaatagtgtaaaataacaggtctatcaatttaagtgaaaatgaacggtgagattagattgtaccatgtggcgacttaggagcgtttgtaggagtgccacgtgacggcttaagagcgtttgtaggaagtttaatggacttttagtatataatagatagatatattttgggtttttttttccttgctcggagagtgggacagcaactccttgcaccaaattaccagcacaccttatgattaacaaaactctattgtggtatcagattttatcgtgtccacatccaaattaccagcaccgcttataattaacaaaactgtccaaatcatactttttggctgtgtttagtgtctgaaatggggagaaatttggagaaatttggtagtttaaaaaaaaaagttgagagttaatgttagtagaaaagttttggatgtgatatgatgtgataaaaagttgagagtttggataaaatttagtgtgaactaaacagggtatgttggatatatatgctcaatggcgtggaatcgtggatccggagcatttgataatgcgtccagagtagcatggacacacagctaaggccgcacgtggtctgtcgcgcatggaatgccaagacaagagtcgtcaagtcgtcgcgtcgggccatgcaacggcccaatcgaaacgatatgctccctccgtaaaaaaaatagtagtcaaattcatagtacatacatccatccagtgtattagattggttttttattggatggagggagtatatatttacaaataaaaagtatctgtgaataaatttttatatatgtgtttttagcgttttaaaagtaaaaactgaaaaataaattttgatgagaaaaaccttaaaatcagtttcaaaattaaggtggaaaatttaaattttagctgataaacatgaaaaaaaggtcacgttcaaatagttttgggtgcaattggaaaagatgcatgtgtactgtttggcatgtcataaacttgtcgtatccatatgcaaatgtagcagtaggaagcacacgggagctttcccggtctccaatagtgcaatgtgctgttttggttcaactcaagccatcgggttggcctttgcaaatactgcatgcaatgtacggcgtcgctaagttttcagagaacattggaccattcttaatttcttattatttaaaaatttaatgtgtatatgtaaaattatttgctaagattatattttattttataaaaaacaagtcaaaaaaagaataatatttatacaaattttcttaataagataaatgattaaatgttatgtgaaagtcaatgacgtcacatattttaaaacaaggtaatatagtgttgctaattggtacacttttattttgttttttttaaaactagctagttggtgcttttttcttgaaggggagctactcggtacttttggtagtacaggccatgtggttcgcaatatcataacgatctgctatagctgttgatgattggagggccacttctttttttttttcgaccgcgcgtgctcagtcgtactagaaccaaatcacactctatttgttactccatactccctccgtccgttgtacaatataaattattataacattttttacatttatattgatgtaagattcattaacatgtgagaaatgataaaatttcttacattgtgaaacggataagttagtaagtaatttcttccctcctaatttaagctctagaatgatatgttcatgagtcatcatctcatcttatatgagtcatgaccgcatgccatatatggctgcctcgatactcgatcgctagctcatctgccgcagtgcaagccgtggtgttcatccgtcgtcagacctgttaccagatctggacttccctgagatattgattactactcttgtcgtccgggaccgattgagttcatcagacaccatgtttcgtccggaaattctgcggttgagcgtggaaatgacgggtttgtcgaattccgcggactctgctccggcttcacccaacagtacgtacgtttctcagattcacgttgttcgagaaactcatccatatttggttatagttaattttattttcccctcgagatttagtttcttattatttccatttgtgattaatttaactagtaattgtttgatccagatggaactgaaccgccgatgatgaggacgaacggcggggagcagatgggtggcagtgaggcggcgcacattcgcatcgacgaaatcatccgacgtctcgacgccgcggagaaagaagcacaagcacaagtcgtggaggcaaggcgcgagatcttccgcgtcccggggaggcatcggctggccgacgaggacgcttaccagccgagcttgttctcggttgggccttaccaccgccacggcacggaggagatgggcaggaacgagctcaccaaggttcggttgatgaagctccaactcggcgccgacgccgatcaggcggcgtcgctgcagagagagtgcctgctgtccatggcgtcgctggagcaggaggcgaggcgctgctacgacggcgatgtcgccatggattcgggggaattctgcatgatgctgctggtggacggggccttcctgatcgcgatgctcaccgcgtttggcatccaggaacaggatgacgcgcctgctaataaagaagaagaagaggattctggaccgggcactggcagcaggacgcagaagagggtgctcgtcgacgggtttctcgacttggtgctgctggagaatcagatcccgttcttcgttgtgcacagcatcttcggcttgctcgtcgatcatgctggtacaactctagccaaaacggcctggaatgcggtgaggaacttcatgcaacacatcccaacggcttccaacgccgacgacgtcaaggaggactgcaagcatctggtcgacctgtgccacacctacctgaggccagccgggtggcagcaggcagcggcggcgggtggtggtcacatccagcggttcaggacggcgacggagtacagtgaatcgggcgtccggttcagggtcaggtcagattcagagcctgcccctcgtttcgggctcctcgacgtggacttctcgtggggcgtggtgaccatgtcgcgccacgtgatcgacgagaagatgagctgcgtgttccgcaacgtgctggcgttcgagcaggacagcggcgccggcgtggagcgcgacgcgtacgtgacggcgtacgtggtgttcatgtcgcagctgctggggagcgctggggacgtggcggtgctgtcccggtcgggcgtcatggagcactcgctcgggaacgacggcgacgcgtgcgccctgttccgggggctcgcgaggggcctcgccttcgacaccgacggcgatcactacctgcgaggggtggggctggagctcaacaggcaccacggacgccgcctcaaccgctggctcgcgtgggtggcgcgccgccacttcgacaacccgtggctcatattggcctggctcgccgccgccgtcctcctcctctgcacgctcgtgcagacggtgttcgcggtgatgtcctacaggccaagtgcaaaactcaactcctagctagttagctatactctaaccggccctgtcggtccgtcctgtgattcaatttgctgggcaattaattactgcttgcgttttgttatatatgttcttgttgtctccaatttcataattgatcttagcctaacacgatcaccttcttgcttatgtggaatttgatataatactgactgttttgagatgccatgtagccggatttcacttcttctttcgcttatagatttgccatggagggtggagtttaccaatacgaacatcttccaacgcctaatatcgattgcctctcgcttatgattttatagttggcgatatgatagaaaaattagcgtaacatctaaatcaagaagcctctcgttttaatcttatcgcacgacgcacctcaaagccattcgaccacgcacatacacaaagcaagagccgctgagggaaaaaaaactgctacatctacacatgcatgtccttttttattccttcttattaaattttctcataaattacttatccgatttatgagaaaattttctcatatatatatatatatatattactttcatatttgaataaattacttcttatacattcataatgctctaagttgcttacttttattattgtttttagtcaatttcataatttgtgctaagtaagtttaatttcttgataaacttatgtttttatccatacaacggatttacttctaatgttgtaacaacttacttccattttgtgcaaagttacttttatgatttatgtaaattattttttgactttatgtaacttactttcataaatgtatttacttgaaaatcttctgtacacattgcttgtgaatttactcgacatattttcttgctacaactcacttatattataattacttctaatgtaatagagagttatttctattgcatatctgagttacttctacaatttaaataaattacttttaaattaataaaatgtttgaatatattccgcatggatctcgttttgtcacaaattttgagtagaatatatgatgtaaatagattttaaaaagtaatatgtgatttaaaatatataagccattaaaaacctggttggtacagctccaactcttaaatttagcttcaggagttaggtctgaagtggagttgtggagctgcctaaacccagctccacacaactccagttcattttgtgagagagctccgcacagctccgcttccattttgggtggagctgaaactgtttggttgagagctgaagctgagccaaacagatcctaaatagagatttatatgatctgaatctgtgctggttcttgggtgttcgttctcttcctcgtgatgatgtgatttgtatgattcgtgcggttgcagtgttcgttcgtggagcaccggaactacaaggtggtgtaccggcggtacgcttccctcttcttcctcgtcggcgtcgacaacgatgaggtattgattcctccgcctcgcaattttctttagacgatggctgaatgtcaattttgtcagacaaaaggcaccctccctcccctatgttaagaattctgatgatttaccaaattcaactaaaaatatcctcaagatgtccttgctactaaaaatgaaatttccacttagtagttgagggtttggggttattatcagttctgaagatatacgatttaatggtttatattagaaactaggaatttcacatgagaagtttaatttcctcaagaatcatgaagtatcctgcatagcaaacagaggcttagatcttgttcatctgttttcttccatcgatgaacgtactcggatttgatagtaatgtgtaaatgtattatcgttgtctttgatggtactataagatattactaatgatttatccttagatggaactataaggtacaaggtattacttttgatttatccttagaatgatttatcccagcacgatcggttgttgcctgttgttttcatccatgtttccatcttctgctgaatgttaccttctttccaccacttgagcactgttgtcaactcgtgcaggctctatacgtctacaatcttttcccaattccactcattcccagttaggaatccaaatcctttaaaattcctccaaaacgaaaaggccctaagtttgggtagcctcagccctttttacaacagggccttcgatctatctacaaagtttcggttgcctcagccctttttacaacagggcctttgatctatctgcacctgtgagagtcacaggcttgacatggcaaggatatttttaaggaagcgagtgaatggtagcgaaaatatattccatatcttcggcaattaaggaaaatagtggtgctcagtaactgaaccgtactcctacctgctttccatatactacaaattagctaatagaataatttcactggtggccatgttgggatacgcgtaggctacgatagcataactcaaaattttatatcgtgtaaaccaggaaccatgcaattattatatcatagatcgttactactcgacgcgctgcgcagcggaagaagacgctgagaagtcgaaggaactctcgcgaagtatcgcgcgttgatgtagaggaagtagtcgatcacatcggctcgaccttctcctcctcgtgcgatctcctcgccatactcccacgccgatcagcaccgcaaaccagcgacgcctctaccggtatccacacgtacaaggacggaacgccacgcacagatgtgctagcacccgtgcgcggctagggtcttgctcagggagggaagtgacggctacggtttctcacgtgatgcaatgcctccgccgatcacacccctcacgaatatataagatccattactcgggcctccatggcccgtaggactcctattcggatccctatccgaattaagctcatattggatctccatccaatccccctattccggtccattaagcgtgcgaccctgtaggttcatgtatactcggctgtaacccgaaaactcctttttggtccacgcgtcaacagcggcccctagcagaatgtattgacccaccgggcatacataaagatcatatcggctgaacctctagtgtataattgtatgaacccctttgcgccacgatatcgattaagctcaaggttagatatgtgccgtcctctaatagctcaatcattcactcgaacctattgatatattatataacttgtgattgactcctcaatcacctttggtatggccatgcacttccataatctacaacatcgaggggcccagagatatctctccataggaggggcaaatcccatcttgattatttatatcctactacatgtttcatagcatacccgaaaactacttttattactacccaattacggagtagcgtttagcagtccctaagtaagctactacacatgttgggaaccatgagaatctcaggtctaaggattcaacaccaacactaaatgagatcactgatgacacaacacatatggctcatgcagtgtctcatgttgggtctatccaacaatatgttcaccaacatgtgtccacattattaatttggtatctctataccatgatccatgagacatgatcatcaattaatacatgtgctgatcatataaacatatttgttccacatatgatatttgatcagggatcttttagaaatagtaacaaacaacataaagagtctcatgaaagaatcacatatttattaaccaataatgagttatctatttcaaggaacaatgtcggataaatatgtaaatatagtatgtgatacaatcatctctatgattgcctttagggcatatgccagacgtaaggctctgaagactctaagctagcagcacacaagaacaacctcgacgtaagattaaacatgagaagatatcgattgattatgatgtaaaatcaaaggtgtttttgattattattctgtgatgaacaattggcattggagattattagttttgatatttggaatttatttacgaagtggttttggagatgattggatttacatgtgaatcacaggtactgttattttatgtgaccggtcagaccgggcatgtgctgtcggtcagaccggcgtgtatcacgcggtcagaccggcgcagcccgcggtctgaccggccgacgctgtgtcggttttggtttcgggttgttagtttggatatccgtgattgtttcatgattatggcttctagatggatactatacgtatgtaattctattgtttgctactaatgagtcaagttggagatagcttggtctcggaatatggtttctttgtttatttcatgtgtaggtgactcgatgcctcgggtgagtatttgcggtgatggaccgggagtcgtcttggggataagacgacgtccgtggtggtcagagttgatgcacgtggttgatgtaaattccatatggcatacgatagaggtactgtgtgcgtatgggatgcggagtcgaatttggaaggagtccaaatttggtatgattggttatgtaatgtttgtgtcttgtactagagggtttcctaaagtgtttaggacttctagtatgagtttggtttgtggctttaggctgcctacctcggtataaatagagggggagcgtgaggcttctcgatatcactttagagagcaattgagttgagttttgagttagggtttcgagtttagtcaaaatttttataaagagtgctattggtgcactttgtaaacacagagagaatcaataaagtcgtcatctactttaagagttcttcgatttgtgtttcaccgggtttcggcggtctaaccgacgactcaccggcggtcagaccagcggcaaggcggcggtcagaccggtgggagcgaggcggtcggactggcggcggcaacagacgcggcaggcaatctcggcggttcgaccggagttcgatctcggtcagaccgacgttcattaggcggtcagaccggtgcaacaccttcggtcagaccgtgatccatcgatttcgagggtaacttttatttctgctaaaagttttcggtttttgggtataacaaccattcacccccctctggttggcttagttattatgattcgatcctacgtatgaaaccgtttgtacatatagcagcgagacttcaatcttatctatctcagaatctggaaaggatgacgaactatcattctaacactcagcactcggtagcacatagtatctgatatatcaagatgctttgtgatacgatcagtctgtgtttatatccttccggacactgtgtgttgtctctactgatctcacaaaagaaaatcaccacaaatgtaatcaataacatgattcctgttgctgtttatttcagctgtggccccaatgtgatccagtcttgacagttgtaacggctggaggaataaaatccgtttggagtttgttatgcatgcacgaagttggcagcgaggctgcggaaggtggcgacgattgcgtcaggcgtgcggagtggcattttgcatctgcatggagtccaggagaaactgagtcgtgggatggcacgattttaggcctaggattcctctttctgtttctagagtataagtagcaatcagttcatttttcccttgtaaggttttacaattcagttgaatgaaaaaccctagaaaattgccccacatttgttcgtgatttcgctaagttctgaaattccttgatactctgttcttgctctgttttcattttcgttagttagctgtgcttggagtttctgtgccggacggctacagttcgcccggaaggtgttcgatcggagttcagcgctagcgctaacaattcctagatgaattcctttccaacttgacataacccggtaatctcaaaatagactaaactttgtgccggaccttgactgggaacagaggaagcaatgtctgccatcacaacgtacactacatattcggctagctgatctgctctctttctgatgttgccattggatacataattggtgatatgactaagatggacaaacttctttagtaacaaaaagtttagtgagacaagcaaagtttgatgattttgaaggcctacactttgtgcgtgcatattaccacagctgccaagttctatctcatttcctgatgccgcccactcctaagcagaacaaggttgaatagtggcatcatacttgcagtacgaacaacaatatatagattttgaaggaatgtggatacctagatagtattttgataaactttatatatatatatatatagagagagagagagacacacacacgcgacctctgtacttcaagtcacagtggttggttttgcattctgtgttgtgttgggtcttgatttggagttcaatatatctagtgggtaggtgtacagagagaagcagataggatgaagcttggactgcaatttgatcttatattacagttcaatctgttggtataaattggtgtagaaggacgtcggctgaaatgtatgataccttctagttcatggtagctgaaaaaaaatattttccaagagaatctcaatggcctacatcatcacacaatcattgattactcatgatgtaaggatttatttatttaccctaaaaaaagataaaatgtatcaacatacgcccctgtgtcaaaaaaaaccaatcatagctatgaacctggacttatgcgtgtttaggttcgtagctagagtttgtctttttttttttgagatagactagtaccaactatttcatggtatatatttacatgattaaattgtgaatatctttcatcatgttcttggccaaaccttgatatcactacttaaaaaaatcgtttttcaaaaagtccagcttcattttacaagtgggtcaaaagaacatccacttgtcataatgacaagagggaccaatggtctaaaaccgcatgtggaaaaaaaatttcataggagaaccgtcactgcctcttaaaatgtaaactgtttcatatgaagtccgttgggaacaaattttatatacacgttataagatcaactttgtggttgatgattttttttcattttaaattgattagagtatcaatttttgtctccttttctgcttggggcttaccaaactgcttggaaatgcgaagtggccaggaaaggataaaacagacaaataagtaagaactagaaaaatcatcagcacgccagttggcgtgcttcaaaatttatagcctgtgacatgatcagaataattttgcaagtctttacataattaatttaattatcaaaggttgagagtggaaatacaatagtaatatatgccttattatgttacctacttgttatttaaaaatgcatgttcagtaagaaattacgtgtagctttcataaattggaaaattttgtttgcgagctgttggattttcaattattatcatagtcaatcgaccacatctagcatctgaaatcgtcagagctatacagtgcaactgatatccatgggtgctttctttttcttttacattgtgatttttttaaggaacacagtagaggaggcaccgctgttaaattttacattttggattttggtttgtttctctattttttagctcccttttttttacatattttgattttcagttgtgttatctttattttttggagcttcaattttagagatctattttttttacattttaattttccattgttttctctatttattttttgagctccagtttcaaagacccgctcaaaattagggtgcaagcaggtcacccgcgaacccacttataggtcaaaactagatggtagccgacggaggtgttgcttgcggtccaacatcgacttccttggatttggccggttcaacaggtccgcaccgttgagacgggcgaatccggtggaagaaggggaagaaagagaggggatggcgtcgctagcgaaggtcgtcggctgaccagatctgccattgtccttctcttcccatcctaagaagctagaattgaggcggctctccttgcctggtgatggctggcgatggcgtctcgtgggatgggagatggcggcggctcgcgggctggtaagattggctcttttatttttatccctattttttcttcacaatctgcaacaccttttcgtattttcgctttgtattaattccagatttatctttaatggagacaaagattcaaatatattaattccagattttctctctagattgcaatgggtctccactctagatttcttttttctcatgcatagtactatgttttctggatttttttctaacaagatttttaatcaaatggctatgcttagggacaaaaatatggaattaggccacttggggggctaaccactcgttgatttttttattagattctttttataggatttttttggtccactcctgactgttctagaccgttttagatgagatcacacattttgtaaaaaaaaaaaccatctcaaacttgcaatatatatttacgtccgttggacctttttctcaccgttgatatgctatcgtatggctgcaggagatgtgggatacgtgtcacgcttctccagccgagaatccggctggtgttctatgcgtggtgccacgtggcccaatccctggccagggttagaaccctgaaatcggtttataagataagcgagttcggaggttagtttagcctataagtgggtttttgtaggtagccgcttgtacccttagctcaaaagcatctaggctctagacttgagttgttgatttttctcaaaagaaagtcttggccttattatttcttttgacaactattttttcactataacatgtcattatttattttccaatttatggtatttcttctagtttttcctaaattttgtgctgtatcgtttttcgctgtgtaatgtttattctagggttaatatttttgagatcgtccaaacgatctaggtgttcttaatttaatttattgactatacttctacgagcttggaagtatctagaggattgtaaccatgaaagcagagcgtagctagcaggctagctgcaggctgcatcttgtctttgttccatgtgtcaacattttgtaagtccatgtggaccaatcaggtaggagaagacaggccagctcgagaagttactgatctgactatctgagattgcacagggacacgtggctgattttcagatgaactaaccctaaataatcagtgagccacgtggccaaatcacacgcctcatttccacccctgaaatcgtatataaagattgcgtgtgcacatgtcaaacagctccaagcaccgatgtttgagctgtgcattaccaaatggcacattctagataacgagaaaggtagcccgcgcattcgtgtgggcatgtattatattttgtgtttcaaactctataacgacggaatataagttgtagaacatttccggaatataaatcagaaaagaattttgcatagatgcacaggcatcttatttgttattaaaaaaagaatgctaaaaggaatcatacatcactatatatataatcactatatatatagtgtaagagaatttagatcatcctacaataaaaaaaggaatatatttaccataaaatagatggtagattttaatatactactaatgtgataagaatgtctcttagatttaa

SEQ ID NO: 32872 - DNA, 8131 bp, Oryza sativa
tctgagcactgaggagagagatcgagctattcttctccaactccggccgccgagctccatctttgattcttctttctccggtgagctccaagtcgattccatgcatttcctaggacctctttaacaccagagacatacatgcatggcacttcttgtagtgagtcaagccgacgccgttcatcgagaaggagcgccgtcgccgagccgttccgaacgccgtcgtcgacgaccaagcttcgccaacctcatccaatactactgtgagcaccctggagcttctagagttgcatgcatgcattttatccacctagatccggcctctaacgtgacatgcatcactaccccgagacccaaagccactcgtgctgccgtcgccattgattccggtaaccacagatcacgataagaccaccattggcttcgaaaagaacccctattccttttatattttggtttcatgccgagatctgccaccgttcgccgccagaaagctcgagaacgagctcagccatggctagctctgtttcagctcgaaccagggacctctgtggagaagaaacaaaactgtagatactactttgtaaaaactaccacacacatggaacagtcataggactgcggattgatttcctgaaaagccagggaccttttgcatattggtctctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagaaggatgaaatttaatatggaaacataaaacttggcacttgcagtataaatttcacctctaaaatttgtctaagaaaaactatacataaagcatgcacaaatttacaaaatgtatagagaattcatttcaacttaaattgaagcaaactcaacttccacagattcatcaacttactctctaaggtaaaataaaataaaaagatgcacttgctttacaccaaatacctctaaatgtatgttatacaaaataactaattttagacaagctgaactttaaaaatttatataaaattcatcttacttcctttttgagtaaactcaagttctgtagaatcatcaagtttagcactttagatatataaaataaaaatatatacttacagtgcaataaaagcccctaaatatttatataaggaataaacaacttagagcacccttcaacttctaaaatttgtagagaattcatctttagtccaaatggaatgaaccaaatttctttagaactagcaagtaatgaactttaattaggtaaaataaaatgtggcaccttctatactaaatatgtcactaaactttaaatagataacttcagtgctagtcacatggtataggttaggcaatacatatgtataaatgtatatataaatgcactctagctctaagtaaccaaaataaaacttgatagaccagagaggtcatagttctatccccaaccaccaaaaacttagcacacttagctcatatatcaatttctagattggtatgttaagtaactaacatagaacactcccctagcgtataaaatgtgtagtagcgtaatataatctctaaaattgtgaactaagattatattggttaataaaattagtcattttatacatcacaaacaatatgaaacatgtactggacataaaactccaaaaccatgtacacatagaagctacctacctacaacacgttaaaacttgtaaaatacataagaaattcataataactctaaaagttatgaaaccaaatgtgttagtcttagaaaacacatctctacacccctgagaaatcaaacctaataaaaatcactttgcaaaaatatttcataacactacctaagtaaataccaccctgtaccgagtaaacttctaaaactcataactcacaaataaaaagagataaaatataaattctttcacctaaattcatcttagatcagtacctacccactgtgcacaaagcatgcattttagagcattttgaatttttacctattttggtgtttaattgcataacgtgtattttatatagataattgcgtaaatgatgaagaagtgaattaggtgctaacatttcccaggaacaaggcaagttttctcctcccaatctttgatcacattgaatcccatgttttgaggaatgaaaatatatttgtttgcaaagttgcatatgaatttagactataacggtatttgaaacttggttatggtagctatgacctaattgctgcatttacttctttgaataattgtgatcctcactgattgtaaccttagaaatggttacttagaaatggttagagtactttcaaagtgctcaattgggtttatacatgcttacataaaagccttacgcttagccatgcctagtagtttctaaataatttcatgatcacttttaaaatgagaatttaggggaaaattttcactgctggacagaggtgaatatctctgatatttgtgaattaaaaggtgtaaaagtgtgattttagacctgggcggcaagtggtatgcatatggtgttagttgcatacctataggggaagtgctcgccctagtcaattaaggaccgaactttgtgtcaccatctaagtataccgtgcaaccacatgtgctaggaatgggacggccttagcttattaagttgtttaatgtctaaccttgcattgggaggcagtagtagtatgaactagtcggaatgatggtttataggagctacctagtgcggttgtgcctaggcgtctaagcgtgtccaatataacggttaatataacggttaagtacctcgtggaggaatggatgtgttcgctgccatggcgctagggatggcgagggccccccgacctagcggcacttgggttgctcctcgtgtgaataaacacttgccgtgctcgtgcaaggttaggcattagacaatgtaaaggcttcgttatgacctttagaccacattcaacgtgaagaatgtggtagagtcttgcaaactcgaaacaaactatagtgttcatatcatgtgggtaaagctgtacaaactctgtagagttctttaaaactaatcgattagccatgctcacggtcatgagcgctttggtgatgtgtcatgagtatagccttgtgttgatgaaacttgggattgaaatggaaaaattgtgttgagttgtgtgagtgatgatgattataagagttgtgccattgaaggcaacaagagtatgcttatgatgatatgttgttatatatgatgatatattatgttaattatgatgaacttacaaatttgttaatttaattgaatcaactcctttacaaaatatttgtgaaccaaaacttgctttatgctgaaattaaactacatattgtcctttgaatatatgccttacatgtagtatgttaggattgatttttggcttgccagtacattaaggtactgactcttgctactggaataatcttttgcttgcaggttagacttagtcttcttgagtggtgcgggtttcgattgctttttctaggacttgaacttaatggggtaaacccttaatcggtgtgcttgtggttgggtagtcaagcttccgctgttctctgttatctatctatatttggtcggtcggcctatgtaactataaagtagttgtaaatttgaatcgctttcgtcttatttgtatttgctatgcataaccatgcttaagaagaaagtgtgaatctagtacatatcctaggaacaagattcatatgagtatgagttaaggatatttgaggtatcgtagatctttagcccatttgacaagtctcctgaatgtgtaacacatctgatcgtctccttcgtgtggtttgatgggcacatctcaggctgaagttgactggcaagctaaaggcccattaatgtctctaatatccttctctcgaggcgtcggatgttttattacgtttgtttgatggcttgaattattcactttatccctcaaatataatgagaggtccggagagcctacgacaaatataccgtcggtatcgcacagccattgcgcgaaaataacgtgggaaagacgtcgcgtcggtatcgcacagccattgtgcgaaaataacgtgggaaagacgtcgcagacggtatcgtgcggtctcgcacgccgcgctgtcgctcgtgttgttgatgagttgattttgacaaagaatgtgttgaaaaaaaatacaaagttgctttttgtgcaagttctttggtcaatgcttcatgtgcaaataaggcaaaacaaaacaatggtgttttgatttctcaagattgctcaaagtgtgttttgaatgagatgaagttgaaagatgctttagggcgtgttaaacacatggaagaaattgttaaacaagataaggtgttttcttgcccaacttgtagaaaataaaaaggtcttttggatgcttgtaaaaattgtgctattcttacacagaaggtttcttatttgaaaagttctttgcaaagattttctgatggtaaaaagaacctcaacatgattctggatcaatctaaggttagcacacacaatcgtggtttaggttttgattcttatgcttatcatgctagacatcctcctattattttgggtgttgctaggaggtgaaattttgattggatctgagcctaagaacactgtgtttaaatttgctggcatcatgtcttctttaagtgcatcttcatcgaaatcaaatgttgtgaatgcaaaaccatcaatttcagaatcatctacttcacaaacttgtcgtgaaaagtacacttattctttttgtggaaaaaatggacatttggttgttttttgttttagacttgcccataaacagaaaaaggaaagagaaattgcttttgcaaaatgacattggcaaaaatcgggttttaattcgaggagcacagttagaccgacattgtccagtcggtcagaccgcaggtgaacgggcggtcagaccagttgccaggcccggtcagaccgcaggtacagcggcggtcagaccggccttggggcaatttttcgcatacttcaaatcggacttttgtgaaacgacaaggtaagttttcaggtaagtctggttctgattttattagtgcatatgtatctactggttctactggttgtgtgactcagtgttggattccaaaatttcttatttctaaccccaacacagaggcgtcgacatcttctcgtttgtaggtagtttggtggcatagtccccatgtgcgttcaatgttgagatgacgattgcttttcaaggtaacatcaatttacttttggattgacataatattgttctactttcttgattattagcttttcatgtgctagtgtttgagattgtagtttttgttgatactaatgaatgtatgtcaattttgagagtatttgtgatatctttggcaattggatgtctttttcaaaatctttgatttcttcttgatttttgttcggggagaattggaggttattttgagggggagttagtgctttttatgactttcttttggcatgatttaagggggagtttatacctcatggttttatcaagcaaaaatatgacaatgaaaaaattgataaaagagagctttgtttatacatatggtattttcttgtgcatgccagcaatactttgaaggtttatttgtctctagcatagcttgtatgtattctagtcttttcatgagatttaaattttgcttttaagagagatgatgcatgacacttaaattctatacttgaattaagcaaatatgcaatgttgatgtaaaagcatatggtttgatttctaaatgctatatatatatatgttttattgaattgttattcctcaaatagctttaattgctcattgtgaaaaagagaataaaatatgaaaaaatgaataccgaatccttggaaacagtcttgacgacaaagacgtattcgatgtgagtaaaataatgggtgccgaatccctggaaacagtcttgacgacagggacgtactcagaataaaaaaaagagaaaaatatgagaaaaaggctcaagaaaagaaaaagttaaaaattctctttgttatgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttcttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgttgtttgctaacaatgagtcaagttggagatagcttggtctcagaatatggtttctttgtttgtttcatgtctaggtgactcgatgcctcgggagagtatttgcggtgatggaccgggagtcggcttggtggtaagacgatgtccgtggtggtcagatatcaagcgggatactaaggctagagttgatacacgtggttggtgaagattccatatggcatacgatggaggtattgtgtacgtatgggatgcggagtcgaatttgaaaggagtccaaatttggtacgattggttatgtaaagtttctttcttgtactagagggtttcctaaggtgtttaggactcttagtatgagtttggttcatggctttaggctgcctacctcatgtataaatagagggggagcgtgaggcttcccggattcgcttttgagagcaattgagttgagttttaagttagggtttcgagttagtcaaaatttttgtaaggagtgctgttggtgcactttgtaaacacagagagaagtaataaagtcgtcatccactttaagagttcttcgatttgtgtttcaccaggtttcggtggtctaaccgacgactcatcggcggtcggaccggcggcaaggcggcggtcagaccggcggaagcgaggcggtcagaccggcgatagcagcaggcacggtaggcgatctcggcggttcgaccggagttcgatctcggtcagaccggcgtgttccaggcggttagaccggtgcaactacttcggtcagaccgcgatccatcgatttcgaaggtaacttttatttccgctaaaagtttttggtttttgggtatctcaaccattcaccccccctttggttggcttagttcttgtgattcaatcctacaagtggtatcagagccacgtttgctctttttgatctttgccgatcttgagtttttgccatggttacttctaataaatttacaactaagcctcatattttcgatggaacggat

SEQ ID NO: 32873 - DNA, 1389 bp, Oryza sativa
atatctgtgattgtttcatggttatggcttctagatagatactatacgtatgtaatactgtttgtttgctaacaatgagtcaagtgggagatagcttggtctcggaatatggtttctttgtttgtttcatgtgtaggtgactcaatgcctcgagagagtatttgcggtgatggtccgggagtcggcttggtgttaagacaatgtccgtggtagtcagatatcatgcgggatactaaggctagagttgatgcacgtggttgatggagattccatatggcatacgatggaggtattgtgtgcgtatgggatgcggagtcgaatttggaagtagtccaaatttggtatgattggttatgtagagtttgtttcttgtactaggaggtttcctatggggattaggactcttagtatgggtttggttcgtggctttaggctgctgtcttacaatgcatcgggagaatatttgcggtgatggaccgggagtcggcttggtggtaagacgatgtccgtggtggtcagatatcatgcgggatactaaggctagagttgatgcacgtggttggtgaagattccatatggcatacgatggaggtattgtgtgcgtatgggatgctgagtcgaatttggaaggagtccaaatttggtacgaatggttatgtaaagtttctttcttgtactagagggttttctatggtgtttaggactctttgtatgagtttgattcgtggctttaggctacctacctcatgtataaatagagggggagcgtgaggcttcccggtatcacttttgtatagcttttgagatctagtttagttagggtttcgagtttagtcgagatttttgtaaggagtgctgttggtgcactttgtaaacacagagagaagcaataaagttgtcatctactttgagagttcttcgatttgtgtttcactgggtttcggcggtctaaccggcgatatactggtggtcagaccggcggcgctagggcggtcagaccggcggcgctagggcggtcagcgacaggtgatctcggcggttcgaatggactttgatctcggtcagaccggcgtgttccaggtggttagactggtacaactactttggtcagaccgcgagccatcgatttcgagggtaacttttattgccgctaaaagtttttggtttttgggtataccaatcattcacccccctctggttggcttagttcttgtgattcgatcctacaagtggtatcagagccacgtttgctctttttgatctttaccgatcttgagtttttgccatggttacttctaataaatttacaactaagcctcatattttcgatggaacggatttttctcattggtgtagtaggatgcaatcttacattatggctgagaatta

SEQ ID NO: 32874 - DNA, 23428 bp, Oryza sativa
  unsure (1)..(23428): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaattaatagaggagagtcaagggacgacacagagggggacgcatgcaccaggtggaggaccgtcaattagagatgcaatcgatgatggtgagtcgaagaagatgaaggaatagaagatttaagtctcagtgtactttactatatggagcagattataccatttctcataacatcagttagggagcaagttgaagaataatgtatcacccataatatagcaaccaacctaattcagctggagcaaagcgttaatctgaatgccataacaggaaccaagatggaaaaattatcatgctaaaacagactgagcatggtgacctaaatagggtagagatccccaggagactacggatgaaacatattctgtatttctgtggtcaactggtgctactgctcctggaactccgtaaagtcttctagtgcgagcagcctgcagccctgcctttatctgacggattgggccactgcctcctcgcgcgcatcataaaactccctaagtcccatggggttccgttttccctgcttttttctagaattttttccctctcctcttgatttactgacgtaccgttctaccagtggtagtttctgtttattttatggtcgtccgaacgaaggatgttggcaaatcgatgcctgcttgttgctgcgttctctgttggtgtcgtctaatgccgctgccaataatctcatcgtctgattcctttattaattgttcgtcttttcttgctcgtttttgtgttacttccttctgtttggtgtctttgatagctatctgcttgcgttgctggccggtgtttacagcgacacgcgttgtttgcatggattgactcatccaatttctttgcatatatacgtgccttatttccctacaatttgcttgttccttccaggctccaaaggctcatcattcagcgtctgttattattcctcttctttacacaccaggcaacattttcactgtggcctgcagaggccaccctcctcagcattttcgctttgtcaattgtactacttcaccttcgccatcaccatgatgctgcccaccacgtcaactgggcgcgctcaactcgccgtctcatcccgttcatgctcgtgcagggcccgtcctgcaaagttgaatcctcagttaaaccgacggctgctgaggtcgtcgtgggttggaagtgccggcacgcagatgatccatggtgttgtacacttcaacctgatggtgtggatcttggtgtatgactgggcaagaaggaggcatatgcatctcagcctgctctagcgcaccagggggttgggatggagctgtgtgtgtggtgatgatgctggtatccggtgttggatcggagctagcaccgtcgccggctgccgggcatgaaggtggtgaggatatgttgtagtgcttctggctggtgactggtaaacttattattatttggcagtgttaaaaaactaagcctaattgtggcttcaatggaggccaatcatggttgaatggtgttagagtttgtgtcgaatatgtcggttacagtttaggacatagagttgtactaggtgttaggaatagagtaagcgtcggactctattctagcctatctcttaaataaaggggtagatatgttgcaaccgcatcgtgacttaccataggcgagagggagtggctgccgacgttcggctgaggctcgttgtaactctaatacattgtaataatgttggatgcctgaatcgatggagcacccataatcagtgccacaaggatataggcttcggttgaactttgttaacaaatatcattcatcggtgtcatcatcaaatttggctcttctatggcgtttctttcatgtttagtttccaattgtgatttgggggccggctttagaacaagttgtatgagagcttatgggaaatccatggtagaggtacgtgggaggtgctccacgctacaacgattacacaggatgtgaagggacgaatgtgcacgcaaggtggagcatggtggtgataaacgaaatttgatcggtggatataacatttcaggcggtggtttgaaccgttcgatggatgttttcaacaaggagatgaccagatgcagtgctcgggttgatggtggcagaagcaaattgcgatccaatagatggattcagacactttgggctggtgactcgaactttctagaaagctactttcaacaaggtgacatgaggccaaacactcgggcttggttgaagctggaggtgattgccattctcggtcggtggaatcaaacacaccggcgggggtgggtcgggccttttggcgagttgcattcaataaagagatggccaaacgtggcgctctggtcattcagcaactatgaaggcaacatggtgattcgtcggctttggctaacgactagattgataggtggtcaatctaagataggttggaacagatttgttgggtgacgaagtccgggcagcaggagcacgtcttggtgtggtcgacatgtaggtgtcagtgaagtttgacacgggtgggctccgacgaggaggcggtgggttccgacgacaaggttgacggtgggggccatcctcgatagagatggtggcagttcctaaaatatataggattcctagtcaaatttgcttattctcttgtatatttggattggatatcttccatatcctttctgttagttgaccgttaaattcttgtgtaaaagtccaatttgccctatggtatgaaaaccaaataaacttatagagtatggaaatttgttgtatgatacttttatatttatcattttataacgcaagatattatttgtgacaaagtttatttttagataggacataaaaataatatttatttttaatttttaaaatacatatatgtagcttattttgtgcatagtactaaaacatgttttctatataatataaatatatttatacgctacataaatattttttattaattaataaacctaaaatttactacctctattttttaatagatgacgccgttgactttttctcacatgtttgaccattcgtcttattcaaaaaatttacgtaattataatttattttgttatgagttgttttatcactcatagtactttaagtgtgatttatatcttatacatttgcataaaatttttgaataagatgaatggtcaaatatgtgagaaaaaatcaacggcgccatctattaaaaaaggaggtagtacaaaattccaagtcaaatttctttaggtttgaccaagtttaaaaatttagcaatatctaaaacaccaaattagtttcattaaatctaacattaatataatttgataatatgattgttttgtattgaaaatgttgctatagtttttataaatttggtcaaatttgaaaaggtttgaccgagaaaaaacttaaagctacttgtaatctgaaacggatggagtatgtaacaactgtgttcctagtcatctatcgcatacttagtgtatttatacactaactgacgcccttttaaataagatggtgaatgttatatccaaatcccatctaaacccttttatctcatgtaaataccatatttaagtaaatgtgcacctcctcttcacaatttggtgtgtgttcatataaaacacgtggaaaacttattcctttcccctacttatgctttgtagtagtatatatctttaaccgacttccaaatttatataaccagacacatgtacaaagctttgtagtagtatatatctttaactgacttccaaatttatataaccagacacatgtacaaatttctatatcttcgacatcatggaacactcggtttttttttgtcctttcctgtgttgtaaaaaatgatttacatttacatggatacaatttgttatgaataagaggcaccaggaaaattgtgtgtagatctggtgggacttggcgtgtcatgatggtatgaagtggaatgcttcagtggggagtcaagcctcccaaatcttcaaaacgtgcaagcttcgttggatatctcaagaagagactactacaacgatcagaaaatgaagattaagttgaacaaaatcatttgataccttcttttgttcggcagattcctattttgatcaaattattgcaatacccagaattatgtttcagctaggttgcttccttgcttgttcttgagctgggaactggtatcacaaagtcctactccattcgtataataatctaagatttttctagcattgctaatattcgtatagatgttaatgaattagacacattatgaaacggagggagtagcattgatttcttacctcacctacctgcctctcacttccttcagattgtctggcttttcactcgcgatttgtataggatcagtttgggatgtacacattaaaatcgagtagccttgaacgcttgtactaacttaatgcaaattggtacagactagagagataaaacaattctctcttaggttcatgtatatgctctatctccttccggcgggccgctataccagagtagtctacctttgcttgtttgtgcaccactggaactccttgaagcatatttgttttcttaggaatgaaaggaaccaggaagaatgccaagacaagatctctcagcagtgttctgattgtagtctttgatctggtggtacacacaactctgcattcgtctaggccatgtgagattcacaaacttgtgagttttgcgggtactagccactaaagctgaattgctgatgataccaaaacacatatatagcacagacacacaggtcttgggtgtacgtacttcactatatggagcagattataccattaatttctcatatcatatcatcagttagggagcaagttgaagataatgtatcgcacattatatagcagcggaccaaattaatacagccccaccaaagagttgatccgaattcgacaacaggaaccatttgagatctagagcatacacgctacttgctcgtgattgtgtctcgatgaatagaaattgactggagtatgcattgcaaaactcttttttcttaagataggcaggaggatttttactcaatactgttgaacaaaagcatattaatattggaaaggaacaaccatactagatatgattgaaaacaaataagctgatcactcttttggccgtatgaagaatcctgattgttttttcaatgtcggccaaatgttgaaagatggtatgaccgtatgagattaaaaaaaaaagccagttcaactagggcttcaattaagatggtatgagataaaaaaaggccaaatgtttacttcttccttacatgcttcgtcctaaaaaagtcagttcctagctatgaacatgtatatgggcatgtccaggtttaaagctagagattgtttttcttaggacggagggagtaagtgactaatataagagttatgttaccgtaggccaataactgaagcaagcaaaggctcacatctcgcccgaaatttcggtgttttgcaaatttttgtgaatttggtcaaattttattcaaattcattcaaaataagtcaaaatttcaaataatttcagccacaaaatttccgaaattttggtcctcccaggcaaaaatacaatttcaaaattgaaaaccctgctcacacatcacaaattctggcgcaacataatttatgttaacatgtttgggtttgtttcctcatgctacctcctttagcctatataaggactaatgtctaagcatacacttcatgtctgataggaatgtgaagtcactctattctcagttgttatattagtatagtgcatttctttacttggaataggtggtgtcgtggaaagaatatcatgatatggagtcgtatatgctgagcatgctgaccaaaataaggaagagatacctgtaagaatacggatggaacctgtactgtggtcgactggtgttgccgttcacatagctcttaaaagtctccctatgctatgtgctagcagcctacctccatctccatctcattgggctgctgcctcctcgcggatatgttgcaccgccattgcattactactttgtctatcgtacctacctctaacgtaagttcaaaggagataaatttacaactaactccatcaccacatatgcctctcacttccctctgatgacctatgttatagctctcgcagcaaagttcatttgagatgtcacactaggaataggatctagagcatgttgtcaatctcgccgtctgtggcgttgtctttttaggcattttctatttttcactgttcctcatcgggtagtttgtcgttcttttctttgttttgcttgtgggccagctggctagcagctacgtcgtgtgtaagactttaggtgtgtgagttcacgtcaaaatcgtggagtctgttgtggagtccgagtctcgcacggcacgatctgacgtgtgggatggcgcacgtcggtgcggatcgtgtcgcgtgcatgatggccactacggccgatttactagcgttgtttccaaataaaaggggatgaatataacccagaaaaactgctgaaggtgttgcagcgccaatgcacttgtcttcaagttcagaggcattgttgagtttttcagtttgggagttgaagagagattgaggacgccgggattctgttcgccggctaagagagcatacacattgctttgagaaaattctctgcgtacgtaccctttaaactttctctacgtaattcctaccatgtctctgaattttgctcattctcttgtatatctatgaattttagtttggatccttttcatacacttttcgttagctaatcgtgggtcgactgttgtattcctataaaaaaaaagtctattttgccctttggtacgaagaaacatataaaattatgaagtatagtattggaagatagaaatgtattatttgagactattatatctgtgagtttattatgcgaggtattatttatcataaaatttatttgtatatatgacataaaaattaatattagttatttagttatgaaaaatcatttgtgtagcgtatatctatatatagaaaacatgttgttctactaaccaataaataagctacgaacaaaatttttaataattagaagataaatattaatttttatttcatatttaaaaatattttttttcataaatactacctcgcattttacaaactcaataaagtctcatacaacaaatttctatactctataaatttatttattttccataccataggggtaaattagacttcttcataagagtttaataatggtcaactaatagaaaggttaggaagatatccaaactaaaatttgcggtttaaaagggaataagcaaaattcagaaatataaaaagattgggaaaatttttaggggtacacggggattttctccattggattctagtgattgtcttgttcaattgactagagtgtatacgtaaaactcttgactagatgttggaccggaatacggtccatggggatggcaaaactggtaacctttcttatttttttttggcagtgttatgccaattgtgatacactttcgttctaatggaaaaccaacataagatttgctccaaatcaccccaattgttgcttcagtcatgaagaggtaatctacactggaattgttagaaagaaaaaggaaagagatatcatccaatatcaaactagcatgatctacttaggtaggtaggtaaaaatgagttgttgtttgaagagaacatcatatttcaccttttcttttttttttgtgggggtatatttcaccttttcaacaatatttggataaaacgagggatttagaggatacacatgggaaagaaagaacaatatgggacgaaataggattccacctggtaatttgcgtcaaatgtgctagcgcgagcatgctatgcaccaactcatatgtggaatcacctttcgattggtcctagctaatttgcaattttgcatggcccaaccagaataattactgcatcctctgtcccagttctgtcatacgtcaaacactgaatcatattaaactatattaattttagaaattaatgattaatgaaacaaacctttgatttaggacaaaactgaataaccaataatttaaaacgaaggaagtaatatcttgaatgtgttgaccgggtgggtctaataagtgacctttctgttcttgttggattgtgtggtgcatctcattagttgggaatgggtggtgtcatgaagagaatatctttacgacaccgatcagcttgagcaccgactcttatcaaaagatggccgactcaaggtagagatggctgcaaaacccctctgctaactcttctatgccaatgtgcgattgttcgtctgttcggcatcaagatgaggacaacgcaagggtaacttaatttagttctctccctgaccgcattggtggctcaattgattataaacgctggaattgttggtgacccacataatttcccccctttccaatacattaattggagcctggttggtatatcaagtcacctaaaaaatgagttttcttatggtgatccatgtgttctaatcgtagtcgtacgtacatgatgatctcatcttgttttcacaacacactggtttaagatgttaccgaagccgctaatttgaagacaaagaaaacagaagcaatacaatgaacgaaattctttgccatgtaataaggggacggtgagaaatccccaccatgaatggaaaattcagtcatcaaagaattcagccatgaacgcaaaacaaaatgaaattcagcatatcctagttctcctctggtagcatatatcatatataaatactccatattgtctcccgagcctctatcctaggagtacattactccttgcctctccctctagctttcttcaccctgtttctccgttaatttgcacacttctgcattctaacaacacacaagctaagagaaacgagcaggtcgatcctaactgatgttacatagcagtaaccaaaacagtacttgccgtgacagcatcgtgtgtgttcttcacttaggaatgggtgtcatcacggaaatgacaagtatgggatagatggatatgaccatttcgatcatgttggttggacattgcacggttcgtgaacggtatcattctctgcgatttgtgccagtcaccaaaggtccagcattttcgcttataagcattggtagataattaagtcattactcttcggatgcttgtgtgtgtggctcgtgattagctttcaccgccgtcgaacggttggtcaccttggtgcggcgcgtgtgcgcggtaggtggttgcggctgcgatcctagagtgcggtcgtgtgcaggagcaagcctcgggcggggcgccatggccggctcggctgtgcagggacagtgtggttcggaggagaagggaggatgctgatcattctattttatgggaaacctatttttattaagttaaaggaaccagcaatatccctggacaccaacaattttacaacccaacacagttaactcgtgcgccaccctgttacattcgggacagaagctgacagagcacgacaagaaacaattggaagtgctcatcttggcggcacagttgtgaagggtgaaaaatttaaatgggctgaaagggaaaaaagctggtctggccaagagaggaaaaaaataggaataagtccacttttaatcccttaactttagaaaccgacacctatgacatctcctgtagtagtgcaccaatgtcattggcgccgatagcctatttgtaaatattttttgaaaaaaagacttatttgtaaaataatatttataaataggtcatcggtgccaatgttatttattgtgaggacctacatataaatatttcttattaaaaatagatcctttttttaaatggttcacttccccttcatataagtgatttagcttttatatagaggataggccggggaacgccaccaacgtctttgttggaccacggtgacggcgtcaatgtcgttggcgcgaaaaggatccattccaagaataaatttttgtaggggtctatttataaaatattttttaaaaaagatctaaaatgaaaaatccaggcatccttggcttatataagggccaatatcaatgcatacacacagtttctttcagataggaacatataatgaccgttttgttctcgttggtttaatttgtgtggtgcatcccattagttgggaatgggtggtgtcgtgaaaagaatatcgtcatgacactgatcagcttgagctccaatacagataaatagataaccgactcaagttagagatggctgcaaaactgcggctgaaaccaatgttttgtaactgactggtccagtttgactaccctgtatcgttaagtcaagattgaagcattggacgtttttaggaacctgtatccaggcatcacttgatccgtggaggaatcagcaatttgtgattaggttgttccagctaaatttgagtgaaacatcaaacatacatggattggttcttcagttgagcgcactatttgcaatttttgtttcaaatatcggaactatgagcaatttgcaatttacaatttgagggcagtttggcaattttggtatcccctcccccgcacttgaaactatttagcccgaaattttcaaggctttcagttttttatgaatttggtcaaaagtttattcaaattcggctaaaatttgttcaaataataaaaattttcagctaaccccaacacaaaagttcaaaacaaattaatttgcaaaccctggttgagggcaccacgacaagaaccaaaaaacgccatatactgaagacagtttgttccaaggtacaaccatgtaattaatgtgaacggctcacaatctctatattaagtttgtgaatggtatagcataacatttagatttatcagaggggtaaaactgcacaatctaaaaataattcttggagcccaggaaccttttgataccgcagagcataaaattctaatttaatttccatatcaattattgctagatactttttttagagaataggtattacacccaacaggatatatgcgctcatatgacttcgcgcccaatttaaaattcgttcttatggggatttgaactcaaaaacttaggttgctactaaggtcactgtaaccactttcaccgctagatagtagtggatagatagctaatatttttcatcggacctaacgacttgtcgtcaacccataataaaatatttcaaaagaaaatttttgaaatattggattcactggtatgtcccgatattcagttgctctggtcaaatattttttgtcaaactagttcaaaacggtaaaaaaaattccccaatctcatctcgatctcccctgttaactctagtatgccaatgtgctaccgtagttcttctcttccgcatcaaaatgaggacaacgcaggggatcattagctctctcccaatccacagtggccggactatccggcgatcccgagatagctccttcccaaaccagaaacctctagtgtcgatgtggttttggtggttcaattgattaactaaacgccggaatttcacaaattgttttgatgaccgcaaatgagttttcttcccatggtgatccaagtgttctaatcgtagtcgtacgtacatgatgatcttgctttcactacacagtggtttaagatcttaccaaaggcgctcatttgaagacaaagaaaagagaagcaaaacaatgaacgaaaaataatctttgccatgtaataacgggccggtgagaaatccccaccatgagtggaaaatccagtagttatcaaagaattcagccatgaatgcgaaccaaatgaaattcagctgatcctagcgcagttgtcctttggtagaattcaaggccctatatgcacgaactcacatcatatatactccatattgattcccgagcctccgatccgttcttgtattctacttgcagtagattactttgcctctccctctagctttcttcatcctgtctccccgttaatttgcatacttaattagcagtaatcaaaacagtacttgatgtgacagcatcgtgtgttcttcgctgaggaatgggtgtcatcacggaaagggcaagtacgagattgttgattttgaccactttgatcatgttggctggacattgcatgtgaacagtatggttctctgcgatttgtgccagtgacgaaaggtcccagcgccttcgcttagcattggtagatgtcattagtcttcggatagatgcatgtgtgtgtggcttgtgattacactggtagagaaactgtctttactcccggtttgtaattccctatagtcccgggtttttaaccgagactatgaattcgggactaaacatcgttatctttagtcccgggtgaaataatcgggagtaaagatctatctttagtcccggttggtgttggtacccttttcttttttttgttacttttttattttctcccgaatcggatggcatgcacatcccaaatcaaaccccaaatccccaaataaagtaacatcccaaatctgcatcacaaatcttaaagttacttatacacacaaatctaaaatatcgcaaatcctaaaaaatttacacacaaatcaaatacatcacagattatacatctcaaatccatacaatgaatcacaaaattacatcttagtgaatcaaaaaatataaaaaaaaagagacaacaagtaactttaggggagggaggacgtttgcgcgcatgtgctcaccctgcaacgcacgtctgcgccgcacgccgcgtgtccgtccgtccaccgcgtccgcgcggcgcggcctcatccgtctccagggagggaggaggaagggaaggggctgggaaggaaggaggagcggcctcatccgtctccaggggagggaggaggaagggaagggggaaggaaggaggaaggggaggatctgtgtaagataggagagggaaggagggggagaagagaggatgatcgatctgtgtgtgtgagaaagtggttgtgattgtggagtagaggataaggactagggattatatactatgttgaattttagtcccagttggtaataaaccgaaactaaaatggtaatctttagtcccgttggtagtatcaaccgggactaaagattctcggctccctcacatgcctctgacaggggatgaaccgggactaaaaatcatctttagtcccggttggtgtgtaaagattaaattttttttaaccagatcccggtttttaatggaaccgggactattgtggaatttgatcgactgaccaaagatggtttctctacctgtgttagctttcaccactgtggatcgtggtagctaggtagttgcagctgcgagcgtagcatgcggtcgtgtgcagcatggcaagcctcggcggccggggcgccatggtgatcggcccggctgtgctggaacggtgtggttcggaggaggagatcagggaggtggctgatcatatttttctggggaatcttttttttttaatttaaggaaccagcaatatcactggacaccaactatttcacagcaggcggcgtgctgttccaactactctcttccattaaaaaatgaatctaggattacgtgtgacatattctattactattaatctaaacctgaaagatatatgtctaaattcgtaatactaaaatattttgcatttgatagtaagttggtattttatagtacggagggagtagaaccgatctagagcttacaaaccaacgcagttaactcgtgcgccacccgttacatttgggacaaaagctgacagagatcgacaagaaacaattggaggtgctgaacttggctgcacagtagtgaagggtgaaaagttgaaatgggccgagagagagaaaggctggtccggcgtgttcgtttcaggaggatgggaactaatccctcccatatgaaaaacagagtggtccattagctatttttttataaacatggattaatatgatttttaagaaactttcgtatagaaactttttacaaaagacgtaccgtttagccgtttgaaaaacatgcacatggagaacgagagggggagttggtaaccactgaaaacgaacgtagcctaagagaggaaaaaaaaaggaaaaagtacacccaaggtatcttaacttgtcatcgatttaaaaaatcgttcccaaactgcagaagcatatatatgatatccttctacttataaaacttttcactttaggttcttcggttattttaaccccgttttatccgatgtggtgactgagttagcttaggacccacatataccccacatgccaggatgccatgtcatcaccctctcccttcctcttcctttcccttcctcctctccctctcacttctttgcgcaggctggccagcgggtggggaggaggtcggtggccatcaggaagatgaaatagaaagagcaaatcaaagaaacgagaaaaaggaagagcagcccgcaggctgtcctggccgccgacaagcagcacgccacgccatctcaggcgccgcgctgcgctgccattgcacacggtcgctgccgggtagcccatgccgtaaccgccaccctagacttgcatggccatgctgatgccgccctcctccgtcggaaaatgccgtacgttgcacagccactccaccccgcgccagggtcgccgcaccggctgcaagcgctgatctggcaactccgttggagggaaagaacaaaaaaagaataggagaggaagaagaaaaagaaaaaaaaaaggagcagcaccggatggccgcgccgctggacgagccgccgtcttccaccatgccgttgtgcacccacggcaccgggttcccctccttgctgtgacaaccgtgggccgctcgtcctgcgcctcgcatgcgctggagaagctgcgcctgtcccttgtccaacattgccgccaccatcgccgccgcatcgcccgtcgtcggccgctgacttcctcctcctctccggcctcaccacgccggcttcctccccacctgtcgaccagcctgcgcagagaagtgagagagagagaaagaggaggaggaagggaaaggagggcaaagagagagggtgatgatgtggcatgctgacatgtggggccatgctgactcagccgccatgtcggataaaactgggttcaaaaccaccgaaggatctaaaatgaacggttttgtaagttgagggatgtcatatatctgattttgctgatggggacgattttgtaactcgatgactagtagagagaccttgggattatttttccaaaaacaaaaaaataaataaggagtggtttcgggcggagaaaagcttggaccaattgaacattgccatatcatagtttttaaggatttatgttaggaaaaggtgttcgaagggaaagggaacgggtctgaatttgatacatctgatttttggatggagctttgcatgcaatgtatggatgagttaatatttttgttggcaccagaatcaaaatgtatgttcaatatccaaaatctgaatttgaagtctcattcaactgtgcttttagcaacggtgtttgatagcaataattcagccatcattgaccctgtgacattaatttgatactgcgcaaagcatgtgcatcccctggtcatgcagtaagttcatgtaacaacaggtggttgtggacaccttccagttttgaactatactgccaagtgcatcacccttcaatttataaaggggtaaatgtaggtacctaaaacctatgtggacgatttattcgtacgtggatgatttgttgtgaacgatgaaccatcatatggtggatgcacacctcttatttagaacctggtgtgttgtcctacaaaatttgttgatacagtaatcttacaattgagggcattacatattttagctcgcatcttattctagtctagtttattataatctagcttacagtaatttggcacaataatctagattatgataatcttaattataagctgaaacaagcatgcctaacactccgagttttctcattgcaagctaccaaggtaatagggatatgaacgtttggtgtagtttcctcatcctgcctatataagaacaaatatcgttggcatatatatgctttgctgtgaaatagaatatgcagccactctattctcccttatttttgtggtgcatcgatctctttgcagcttgggattgggtggtttcatggaaagaatatggtggagatattgtactaactgagcaaggatgattttatacttgcctcgttcaagtagagatgggtgtcaaacttcggctggaacctctactgcgcagtataccggtgttgctccctgatgagttctggaaaatcaccttgttctgcctccttgatctcacttagtacccgcgtgcacacgcactcgctgcatcaccattatgttgtcttccgtatcgtagtatgcgttcatctgatcatcaagctaccactgccaagacatcgtgttgaacagtagatccttttacgaatatgtggcagccttgtcgccatggatcacataattcatggatggaagaacaattacttatgtttatatttgagccaaattaatttggatgtgtacatggatcatacttcgtttagggattgagggtagaaatacagccaaatattgtgtatgaggatgttttgcatagaagtgccatactaaggctgtgttcgcatgttcttgatgggaactcattccctccgcacgcaaaaacggagcgatccattagttcatgattaattaagtattagctaatttatttttcaaaaataaattattttgattctttaagcaactttcgtatagaaactttttgcaaaaacataccgtttagcagtttgaaaagtgtgcaagcggaaaacaaggagacgagttgggaacaaggggtgccgaagcaacttggcaaggcactacagtatgtgtgcagggaagttgcaagcacaatacaaagattacacactaaggttgtgttcggtacacccttttcccaatccctctccctcgttttccacgtacatatttttcaaactgttaaacggcgcattttttgtaaaaagtttctatacaaaagttgcttaaaaaattcaaattgatccatttttgaaaaaaaaaagctaatacttaattaatcacgtgctaatagatcgctctgttttctgtgcgtactattcccggttgaacggagcctaagtcagtaagagcaggtaatttgtactgaactccatcagcaagctctggtattaacatgctctgaacatatattaatgacggaggtcagtggcatatccctaatctaaataaaataaataaaaaaagcatatttccacatcactatgccgtatcaggtcatctcagatggacactaaccctcaccttcgatggatttcccccggtcaaggattaggggtcactggtgactctagtcacttttgacgggccagtattttaatttcccgtcacaggtgagcgtctccacatgcccatgtttggttgcaacccgtcacagtgagatacctaagacgggtgcaaagtttgtacctgtcggatgactcacctttgatggattgaagtaacaaggccgtcacagatgagctcacatgtgacggtctttgtttacgacccttcagttatgaggtattttcgaaaaacaacaatttctaaatattgactagactcatgatttgctagccacactctctgaaaaaagaaacatcacatatatcctagccatacccaatatcacatattctccattttagcacagatgcatcccaaaattaacatcatgcacacatgcattccaaatttttacataaattacatagacagtcacatattcccacctcacatttcttttgaacctgtgaagacacaaacttgcccaatttcttgccgcaaacttacccaagttacttatagcctttgccttttgaaaaataacgacaaccaaccatttcaaaaaagttagaaaacaattgaacaatacaatgtagtaaataataagtacatgtaagacgtagtaatcaattttgatggtaagttgttcaaagtttaatgacaattgaacctaagtcatttctaaacaacctacgtctacaaatctctaaacaacctaaatcaaaatatttctaaacttcctaaatcaaaataattctaaacaacctaaataatttataataaacaacttaagtcacaaactttctaaacaacctaagtcataaaacttctaaacaacctaaatcaaactatttctaaacatttgtgactcaaaatcattctaaacaatgcaaattatttatagacaacctaaatcacaaaaaatgggaacaatctaaatttaaaagaaagagaaacatgcgaggggtgggggagctgaggaggtggcgactggtgtgggggaggcggcagccgttgtggaaacagaggaggcagtggttggctgtcttccaggtgggcgtgaaggcagccggtgtcgagggcagcgtgaaggcggcggctgttgtggaggcagaggaggtggaggcaggtggtcttcgaggagagtgggaggccggaggcggttgatgatcgacgtcagggaggcatcacttggcggtgtaggaagacagtgcggtggaggctgtcaatggaagccggcagtcaagggcggggaggtggagcccggtgtcatggatatggagaggtcgagggcagggaggtgctgctcggtggaatttgatgatggcgggaggacaacggttgacgtcgagaaagcaagggaggtgcttggcatggagtaggtggctattgacgagtgttgagtgagtgagtgagtgagagatctggatctgagagggatgggaaacggtccaaccctacttatcccggtcaaagtcacctgtgacggacgggagtgttggcgccatcacaagtgacatcacctatgatgggccctgctcaccggcctgtcataggtattgtcatatgtgatcagccggaaagtagggcatgtcacaggtgaggtcacctgtgacggcgccattactctcacccgtcacaggtaactttgaccagtcttattttcaagttattttgatttttgtttacctatttcaacataattgctctaacattttttttaactatttatttatttatttatttattgtaaccagtaatataatatttttttatttatttcaaaggcaatatttcatttctcttaagtatttcaaaaattttcaaacttatctcaaaatattatagctctccagtccatttccaagataacacatatactacacaaaattaggcatatgatcaaattgggcctatgtttcaaaaatagtccttcctcatggtcgacacatgcatgttagaccgcatcttcttcctactcctcttgtagaggtatttctagacccacactgtggatatgctagttatagctccagtatttgctccatttggccgtagtacttatcgcgacacccacgtacgtcgctacttgcgtctatgcgtactgcactgttctacactgtgcatttgctgtcttgcttgaccgtataataggtgtaccattgccaggtgggagcatcccatcctagatcatgtgacaaccacttgagtggagtactttaggtgcactttgtaaatacatattgataaaataaagttgatgtactttcaagagttttgtcgatacgcgtttttagggatcccaacggtttgaccggagttcattgggcggtctaaccagcgacagctagaaggcagtacagggaggcagtggttcaaccatccagacaccggtcgggcaggcggtgaagttgcggtcaggctggtgtgtacacgacagttcagaccagctacgcctagggcttcattaggttggtagggtaaatttttagctctgtaaaaagtttttgtttttcgtgttgctactattcaccccctcttgtacgtttggttattgtattcgattctacaacctattaattggttgacaatattttctatttaattatattttgaggtatgagagcacatatgcttgagttgtaaggacggaactccacataccaatgttaacattaattaatacacactggaggtatatagttgtattcgaaggcgcaataaagtggaatgaattgcattacaccataggagaagagaaaattcagtcataataaagaaacactcctgccctctgccacaattcaacaccccatgcgtgctttctcttggaatacgacttctcttatcacagtccaattccacgcacatcccttaatggaagcatacaccctaagttgggattgggtggtgtcatggaaagaatatcatggggatattgcactaagtgagcagggatgcttgaaacctctactgggtggtataccggtgttatttcctaattaaatctggaaaatcaccttgtgctgcctctgtgatctcacttagtagccgcctccacgcgctatcgctgcactacaactgcattgatttcttgatggagtagcaaacattcatttgatcatcaagctagattgctagaagcaattaaccactgccgagacacctgtctgtccgtgttgaacagtactggatttattttattttttacaaactataaaaataaccgtgtgttgcaatgggtgaatgttattttaatcttattattgttattatacgatttagctaaggtgaaattcattgtgggaattcacttggatatatatattttttagaaaatcatgaacttcaattagaagtccgatagtgtcaagttagcatgcgagtttttttaaagggatttcttgtacaactccttttgtatatccgaaagcgaacaaacttaaaaatcgattcatacatggataacgtatcaaagtaatcggtaaaaacatcttcaatttttataatagtagagatatgtggcagccttgtcggcatggatcacatgattcatggataaaagaacaatttcttatgcttttctttgtgccaacgaggaggagaggcggcggctcgactcctccctctcccggcgatgcgtgacgacgacagctccacctgtgggaagccagcggatggaggaggagaggcggcgacgcgcgacgacggcgccgacacgatgatgacgacgcctgcggggaagccggcggacggagcagaggcggcgatgcgcgatgatgataccagcggctgtggcagtggccagcggatgaaggtggagagccgtcgaccggaggggaggccggcggcggcaccctttttttttattcgctgtgattttttcacaggcgagtgaatctaccagctgtgaaaatggagatgtcgcctgcaaaaattattttcgcaagcaggccggcggtccttacacccgcctggaaaaactatttttgactgtgcaaaaacattttttctattagtgtctaacgtgcttcctgtgcaagcactgtgtagcaattatagaatagtacgaattgcgcgtaaagggcctttcacatctcaaaagctaaccaattaggtgaagaggtctcccacttacatataatattccttacccttccacaaccaatgtggggctatttaatagaaatgggtgccatcaaggacaagataagcacaggcttcactggttcaccccagagcgtccatttccattttgttggctggatttagtacatatacatgttttctcaaaggtattattctctgggatttgtgcctgggaataacaaaatgagaatataagtttaccattgaacgatgccatcaatcttcagacttgtgccttggaattagatttcataatgatcttttctagaatcggtatttgaatatatttgtttgttccataagaaaaaaatacaaatcatagtgtacaggtccaaatttggaatggccaattcaggaaacaaaggcagtacctgtcttccgtactatttttgttgttaatattgacatcgcttagacgctacccacattaatgtgatttaatatatacgagatttaccagcttcttcacatttccaactaataaaaatttgattcggttgatatcgacacactactggagaaattctgagaccccgaatctgggactaaagatggtagcgccacgtgactgacgctaccatatttaattccggttagtattatcaaccgggactaaagggttttttttttgttttttttgctggcttgcatattgatttccccaaataaaatattcacatataaaatcatggattcacatcacaaattctcaaaaaacaaatacattacagatcacagattcacataccatcatcaattcatccaatccaagaacatattaatcataaacatcacccatgagatctcatgaacgcaatcatgaaaaaaaaaatcaaaatccatgaacacaattgcctcgtgaacacaatcgcctcatgaatacaatcacaaatccatgagcagcagcatctgctccgccaccactacagccggccgccccctttgcctcatcctctccacgctctccgccactcctcctcttcttcttcttcttcttcttcttctccccaccgcgagccaccatctgcttgatgtggctgctagtacctgccgtggcccggatccagccggatccacctgcgaccgccaccggagacgctgtcaccgccgccaaatccaccgcaagagggaggtgagtcggacaggagggggcgagcgccgtcagcaagggaggcggagggattggagggagaggaagagggggcgggggaggtgagagggagaggaggaggggggattgagggagaggtggagggggcggatcgagggagtcacctgcgagggaggtggagggagcacacagggagaggagataaggagggagggggagggcgggagcgagagagagggagggagtttcgcttgtgcgtgcaaggagataaggacgagggagggggtggcgtgcggctgtcagttttcttttcaatcttttgtcccatttggtacaaacaaccgggactaaagtattgatctttagttttcttttcaatctttcttctcggtatggtataaacaactgggactaaagtgttgactaaaccaggactaaaaataatgggacctgacacggcctgac

SEQ ID NO: 32875 - DNA, 3247 bp, Oryza sativa
aagatcccacccaaaaatttttcaccatgtcatatcgaacgtttaaacacatgcataaagtattaaatataggctaacacaataactaattacacagattacaactaatttgcgagacgaatcttttaagcctaattgctctatgatttgacaatatggtgctacagtaaacatttgctaatgacggattaattagacttaataattcgtctcgcggtttactaacggattctgtaattaagttttttattagtatccaaacaccccatatgacaccctatataatacccgatgtgacacgctaaaactttagaccctgatttaaacatccccttaattgtcttgaacaatagatacacatagctgtccccactgacagccagcttgcttatcaccctgctattagcttttcactctgctattaagtctctgtaactatttataacacaatgtatctatatgttttgtcattgttacatatatagagagagagatttgacacgcacagttcaaaggggaagatcagctgagtaatacaaacagtgatcgttgtacactcttctcatgcctgaccttgttaaacctaggtttgtcttgcgagtttagttttacatggaaatgggtggtgtcatgggaagaacgtacaacgcttgcaccatttgcagtggggttgttattcacttattccctcaagcaaaaggttgaagcgatgatggttaagggtaaccgggactaatgcttttgctgccaattacttgggttagcagcaagtttgacagatctatatatattaatggcgttatctgggcatgtatgctgaggtgagactatgcgaattgctgcactaaagagtatcacggtgatcatcaggcatgggagtatactgtatgctcaactagctagtagctggcaagctggttgcataggcacgttcagcaaaactaataacatatttatgtcctgctaatgatgtatcaaattcgattacttatgttttctattgaaatatttatattgtgttatgactcttttttttacatgggtatgttgttggttcttattctgaacagtagatcaaattgtatggaacacaaacagttttagtaaatcttgttactctgtacactaaatgaggaaacaatatgggaagttcactttgtaaatctagagaaaaaaagtagtagcatggattataatgtcattcccctctacggacatgcatttctcaattcaatccatagatctcagaattaaaatacattatgggctcttttaatttagtgccaaatcttacactaccaaattgttggtagtctaaatactacttatgtgttgtttggattgattccagaacttcctaaatcaatagaaatatctaccaaagtgttggtagtaccaaattttcattaaatgtgttatccatatttttctatagggtatattatcaccttcatttagatttcactgttttttaatatgataaaattgaagggctaacctgcaaaatttaccattaggtaggtagtggaattggagattcactgcaaccatcgtaaccttctctcttcgaggctgtgtttagttcagtgtaaagtttggattttggttaaaattagagatgatgtgactgaaaaattgtgtgtgtatgacaggttgatgtgatggaaaatgactgaagtttggatccaaattttggatctaaacacagcccaacttttgtcattattttccatagttttatataattatttcattgtattgagcaacgagaggtacacaagagcacatacttattttgttattgttttttcagagtttttagaattgaactccacttactatatatatattattggtcttaattaatacatactggagatcgatattattgaagtcaccaataatgttaacaaatacaataaaatgaaatgaattgcattaccacgtggcagaaggaaaaattcagtcgtcttaataaagaatcactcctgccctctgcttgcttttctgtagaaataatacgacttctcttaccacggccgaattgcatgcattttgcatcaattaatgggcttattatacatcacaaggtatgtaactggcacatagatgtaggagtatatatgttaatagaaccaagacccccattgtgtagtgattgtcaaactctagaacaaaagcatattgatattggaatgtatatctccatagggaattaatggtcaaatcagataacctgatcattctttcggaaatgtgaagaacaaaaaacttaattgtagcttcaatggagtccaattgtggtaggattgtttggaaattaattaaaaagtcacaaccattttcagactagttcaatatttagtgctacagaaaaatggtcgtaatatttgctacaaataattccaattggagtacttttacatgggtatctgccggtagttatcgttctacccatattatcactactatggtaaccgttcatttgtgagttatattaccagtagaagaaatattctactacgagtagttcatcacttttaggaaacgaataattacttatttgaccctatttcgaaggctaactaccaatcggatcttatttttttctaggttgctgatttaaccctgcttttcacaattgaacctaccgtttgactatatttgcaatatactgatagggtttcatttaggaaaaagaaaataaatctatttattattcaaactaaccaaaataccctccttcaatcttatccatctcgtaccaccctgcctgacccttatcgctctctcgtctctctcggcatgaacggtagagccagcgccggtgcgtagagggagggggtggcgttggctccgacatgctgagggaggagggggcggtggtgctagcgcaggcgggtggatggatggaggcagcggctccgcaggcacacagagggagagagcggcggtggcacggagggacgagtaggacgagcgtggggagaagattatggtggtgttgttctcggcttcctcttctaatttgttggctatgctttctcaccaccacaagagcaaaatcagtgtaccaaacttgtgtcaaaattggtgcactccgccaaatttttcaatatgattcaaatttatcaaattgaagccaaatctatcaaacttgtgtcaaatgtgaaagatatgtcaaattcgttacaattatgtcaaaaggttggaatatatggatgtttttatataatatggttaaata

SEQ ID NO: 32876 - DNA, 7519 bp, Oryza sativa
ttgacttgtgctgctacgaatagatatccggagaacaaccccgtgttacctccacctcttattgagctgcaatgcttggtacgaccatcccatcgcctctcataccacgcatccatctgataatcaatattatgtcactgtcgagacgacaatctgtagcagcccgctaccttgcatctcatgatttaatgagaaaaaatcaacagatttgctatatttatatcgccatcaaatccagcctctatattcatggagaatatacagagccaaaacacacacgaattgttaggccctgaacccccctgcacagaagaggaaaaaaaaaagaaaagctaccggaagactgagcttcagtgtcatcaaagatgacataatctttcacggaagacttggttggacgtatccaacatatagggtagatggcctacagatgtcgataactacacggctgctttcgttactgggagatttgagagagaaaacaccttgttttccgcatgtatgtttcctgaactacttaaaaaaatcatattaatctgttttaaaatttaaagtagttaatactcaattaatcatacgctaattgcatatctcgttttacgtatcttctcaattccctcttttcctctcctctaactcagccttagcataagacatggaaagaaaaaataaacatgagatcgatggcattgtttttcatgcctcgatgaataatgttttctttttaagtagtactacttgttagtttttataaaaaaatcaatttcactcactgaaacttatggatgtgtacagctcaactcatacaatttgtaacataaacctgcaaatactctttaatgaagctttctttcaactttggtcgttccacctttatccattcagtttttttgtgcgttgaatttgactagttgaattgatattaaagcatgcgcagcttcggctggattgacctttggctggtcgagtaatgtgtggtgtaaccaaatcaatccaattcttgcacaagctgcttgtagtcatcaaaattcacaaagtaagatatcatgagcaacaattgtttaagcaccccatgtagcctagtgatttcagtgatttgtatagcacctcaaggtcataagtttaaatctccatatgagcgaatttcaaattaggttgtttgagagactaagttcctaacttaaatggctgcaaatatccggttcgataaagaggccgtgtaaaaaatatacttatctaaaaaacaattgtttaaggccctgttcagatcccctgtaaaattttacgccctgtcacatcgaatatttcgacacatgtatggagtattaaatatagacgaaaaaataactgactgcacagattacgtttaaattgtgagatgaatcttttaagcctaattgtgcaatgatttgacaacgtgatgctacagtaaatatttgctaatgatagatttttaggcttattaataaattcatctcatggtttacagacggattctgtaatttgtgttgttatagactatatttaatacttcaaatgtgtgtccatatatccgatgtgatgcatcaaaactttacaccccccagatctaaacacagccttagcaaacaactagtagggtatccctgtctacatagttgtccttgaactcaggaaattggacacttctcagtctccatgtcatccactcatgcccatgcatgttcaggattctacttgcttgaatttactacatccatccctcctaaattagatgtcgttttaacttgttgcttataatgtttaaccattcgtctaatttaaaaaattagtgcaaatataaaaaaagataagtcatgcttaaaatacttttgataataaagcaagtgaaaaaaaaataaataataatttcataatcttttgaatgagtcgaatggtcaaacattgcaataaaaacttaatacgatgagtattttcggacggcgatagtatgtctcgttgggtcaaccactctcttaagacgtcaactcaggccacgacgtgatactctgtgttgtagtaacttatggctcgctatcctgatcactttcaactagcctattctcaatagcttcttttccaataccttccattctcaacataaaatcttcttgcttacaatatccattaatgttacagaactcgaaaagaatgccaaagaaatagcttgaatgtgttgcttcatttgcatcttgttcagggataaacaagaaaaagaagaggggaaggcagcccgaggtatcaaataggattggccccggccgcctcgctccaccacaaccacagctcaagggatggccgtctctgctcgttggctataggttcggctcagctcttatcaggggcggacgttaccattgggtggcatggggcgacccgtgtatgatcgaataacaagaactaagccaaccaaaggggggtgaatggttggtatacccaaaaaccaaaaacttttagcggaaataaaagttaccctcgaaatcgatggatcgcggtatgaccgaagtagttgtaccggtctaagcgcctggaacacgccggtctgaccgagatcgaactccagtcgaaccgccgagatcacctgccgctgcctgcctgcgccgccggtctgaccgccctagcgccgccggtctgaccgccagtatatcgccggttagaccgccaaaaccctgtgaaacacaaatcgaagaacaatcaaagtagatgacaactttattgcttctctctgtgtttacaaagtgcaccaacagcactccttacaaaaatcttgactaaactcgaaaccctaactaaactagctctcaaaagctatacaaaagcgataccgggaagcctcacgctccccctctatttatacatgaggtaggcagcctaaagccacgaaccaaactcatactaagagtcctaaacaccttagaaaaccctctagtacaagaaagaaactttatataaccaatcgtaccaaatttagactccttccaaatttaactccgcatcccatacgcactcaatacctccatcgtatgtcatatggaatcttcaccaaccacgtgcatcaactctagccttagtatcccgcatgatatctgaccaccacggacatcgtcttaccaccaagccgactcccggtccatcaccgtaaatactctcccgaggcatcgagtcacctacacataaaacaaacaaagaaaccatattccgagaccaagctatctccaacttgactcattgttagcaaataacagtattacatacgtatcgtatccatctagaagccataaccatgaaacaatcatggatatccaaagtaacaacccgaaactgaaactgacacagcgacgggcggtcagaccgcagactggccggtctgaccgctcacatagctccggtctgagcggcaaccaccgtccggtcggaccggaccacataaaataatagcacctgtaaatccaatcatccaaaaccacttcgacgataatctccaaataacaaaaccaataatcacatatgccaattgttcatcacagaataagaatcaaaacacacgttgatcttacaaccggcacagctacggcccacgtcaccctacctcccttgggacgtctaccaccgcataagaggaaagcccaagtgtccaatctagaattttgaggaaatcacggaatcaccggttcgccttctcttcttgctaccccatactcgcaagcacgacgcttcgtctccgtctcttatctctctcactatgatgctcactctttgttgagtggctgatcaactaggagtggattttaactctcgaggggatatcccctcgttgtttgtaagttattcaaatagttataaaaaattgagaagatgtattaacatgtgatatatcacttcgtaaagatacaagttaaaattcaacttttacacgtcacaacgaaaaaaacaaatttgaccgtgaatataagttacactactacagtaatgattattctgaataagacattctttaggttacatacaaatcatgactggttacctctgcaaaaatcaacttccgtttttgcatacggctccttaaaagcaccacacgcaaaaatcgattttcacaagtgggcctctgatggttccacatgtaggatcgaatcacaagaactaggccaaccagaggggggtgaatggttgatatacccaaaaaccaaaaacttttagcggaaataaaagttatcctcgaattcgacggatcacggtctgaccgaagttacactgccggtctgaccgcctggttgtcgtcggtctgaccgagattcaatctccggtctaaccaccgagatcaactgccacttgctgtcgccaccgccggtctgaccgcccgtatgccgccggtctgaccgccgcttgtcgccggtcggacggccgttgagtcgccggttagaccgccgaaacccggtgaaacacaaatcgaagaactcttaaagtagatgacaactttattgcttccttaaaagaaagaaattcccaattgaaccaaaaacaaagaaagaaattcccaattgaaccaaaaacatgcacttcttagaaactcttctcttctcccaaaacacatctcttctccccaaaactcatctcttctcccccttttgccaatgatttcatcaagcatagaaattatgtttattaaagtataagagcttaacatacatatagcatatcatgtcatgtgttgcaataaaaagaagatgaatccatctataatataacaagcatttattaaagtataaccatgaaccaaagattttacaattaagcttgaatcaacaatcaaaaatcatgatttcatacgatttataatgcaacatcttaacaagcacataggttgaagaataaacactaacacatatacctattgcatttatcattctttctcaaataacctttagcacaaaataacaaagagaatttgactttttctttttcttgagcctttttctcatatttttctcttttattccgggtacgtcgctgtcgtcaagactgtttgcagagattcagcacccattattttgctcacatcgaatacgtccttgtcgtcaagactgtttcgaaggattcggtattcatttttttttcatatttctattctctttttcacaatgaacaattaaagctatttgaggaataacaagtcaataaagcatatatataaagcatttatgaatcaaaccatatgctagcatcaacattgcatatttacttaattcaaatagaatttaagtgtcatgtatcatctcccttaaaagcaaaatctaaatatcatgaaaagactagaatacatacaagctatgctagagacaaataaaccttcaaaatattgctagcatgcacaggaaaataccatatgcataaacaaagctctcttttatcaattttttccattgtcatatttttgcttgataaaaccatgaggtacaaactccccctaaaatcatgctaaaagaaagtcataaaaagcactaactccccctcaaaataacctccaattctccccgaacaaagaatcaagaagaaatcaaagattttgaaaaagacatccaattgccaacgatatcaccaaaattctcaagaattgacatatatccaatagtataaaccaaaactacaacctcaaatagtagcatataaaaaagctaataaacaagagagtagaccaaaattatgtcaatccaaaagtaagtgatgttaccttgctatacaattgtcatctcaaagttaaacgcacatggggagtatgccgccaaaatacctacgaacgagaagatgtcgaggcctccgtgttagggttagaaataagaaattttggaatccaacactgagtcacacgaccagtagaaccagtaggtacatatgcactaataaaattagaatcagacttaccaaaaaaacttacctttttgcttcacaaaagtccgatttgaatttcgcgcaaaattaccctgaggccggtctgaccgccactgtccctgtggtctgaccgggcctggcaaccggtctgaccgccggtcggtctgaccgctggccgatctgaccgactggtcagtgtcggtctaaccgtgttcctcgaattaaaacccgatttttgccaacgtcattttgcaacagcaatttctctttcctttttctttttatggccaagtctaaaacaaaaaccaaccaaaacaatttttgcaagcatccaaaagacctttttgttttctacaagttgagcaagaaaacacctcatcttgtttaacaatttcttccatgggtttaacatgccctaaagcatctttcaacttcatctcattcaaaacacactttgagcaatcttgagaaatcaaaacaccattgttttgttttgccttatttgcacatgaagcattgaccaaagaacttgcacaaaaagcaactttgtattttttcaacacattctttgtcaaaatcaactcatcaacaacacgagcatgtaaagcaaatccaagagcaaaagaagattccaactttttagatttttcaatctcaaattccaattttttgcaattaacagaattgacatctcgcaaagcattaatttcagaaaataaaacttcacaagattgacaattatcatcatcaggaatcaaagattttaatctagcaatttcatcatttaaaatctcaacagtgtgatccttctcatcaagctcaatagaacatgtttgaagttttttagcaaatttttaagtagcaagttctaatttatcataactaagcttttcttcattatcatcatcagatttatcaacatcagaactagcattacgagaaataaaacctagatcaacaacttgcttacctttgccctcatcttcatcttcagatccatcaaaaacttttatgagttcttgaattaaccactgcatgcaatgcttcttcttctccttctccttcatgttcttcttcttgttcacgtcatcatctttgactctcccatcatcttccttcttgcctctcccaagcttaggacaatgcgagcgaatatgatcaagtgctccatactcaaaacaacgattcggttctcctcttttcctgttcctaacatttttcatagctcgagaaaatttgttagatagcaaaaccaagtcctcctcctcgaactgttcaagttgatcatcggacatggcattaaataaattgatgaagaagcaccaagatccaaagaagttgaagacgaaaccaaagcactagacttagaatcacctttacgagaaggaatattcatctcatgagttttcagtttagtgtaaagcgaatccaaagtcaaagtagacatgttaacagactcctgaatagatgtaactttcatctcccaaatagacatgtcaagaccattcaaaaagtgacgagaaatctcagattgtggataattagcaccataagaagaatcaacagatctaagatcactcaaaattttattaaacctagaaagatagtcatccaa

SEQ ID NO: 32877 - DNA, 5633 bp, Oryza sativa
ttagcacagaccatcgaaacaaacaggattagcaacatccgaagaacaaagatgtgattgaacctgtaacagttcgagtgatagcagccttgtctttgtagcaacctcatcactctcttccttcatgctcatctacaaggatgtaaatgatattcaactccggtcaaagtaacattatgtacattgtaagctattcaataagaatacaaaccttgcagagagtccggaagagcaatagtgcatcacgctgtattatgttcacagtgtccaggtctattccactggaaaaggaggagggttaggggtcatatgtaatccgtaactacaacctatgaaggacaggtaagtagcatcacagatacagcactaaagacaggttaaagcttaacgaaccctgatactttctttccatcctcaagttcaacagccttgtcaagaacagcctccaacccctgcaaaatgatttttttggatcagatagaactaatagaatacatataaattagtgtgaaatgtcctgatagtaacattaaacaataagcaaagcaatttcactaccttaatatcagctcctcctgcaagactctgaagctcttcaacagatgctggagatgcttctgtagctcgattcaaggatagcgcatctccaagagtaattttttcatcagcttggttaccagtggatacttcaccattctctgattcctctgtgctagatgatggttcttctttcattgcagagctggcaggtggtacagaaacctgacaaaaaaggcaaggcacacacctcgttccttcagtaaatcatctccctttgcataatgccaatagaagttatggggaaaattttttgcctgctcagattccatccgcctgaatacgatgctgatcatctgggttaacatggcctttgaggtagcctggttcacagggctcttgctatggaaatattgtaaagtatcagacaggtttccaagtcaaaatacagcagatcatgaggtggctatataacatgtacctgttgagagcaatattatagcatactctaatcactccaagcaaaggttctccatgtactgcactcaaacaaacagctcaaaattatgtatggtgtctcccgttattcttctatatggatacggaaaagggagatacatgaaagtcccatcacaagccttgtaaaggcgatagctagattaatatcttccactgtgttcacttacaggatttttgtaaaagacaactgcaatttcttcatgaattcaccaaagaaaatgtaagaaacaaaatagcatcgaaaattagataatccctgttgcagtgctatgtacacaaagtgtttgatatgttcatctaattcccgtaggcactatttagtgggtaaaacttcaggagaaggtctgcccacagggaccaacccataatggataataagattagcatttgcctagcatgccagcatgattcaaagatgccatatacaatatcgtgttagctcctaaacttcctaataaatggaaagtttgagcaacatggaaaataagcttagcaaggtaagtaggtcacctctaaatctatttgaagcaacagcattgagaagcactttcaagacttggagaacagtgctgcaacacagatgtcacccagttcagtgcatgtgcaaaagtgtgatccaacataatatcatcttaaagtgatgtgtacctgtcagaggaggtgttatcaacacaaccgcagaccatgttcaggatgtcagtaaatagaggggaatttttaccaccctctaaaccagggtcgccttctagatggtcataagcaataagtttctggtaattgaaaatggaacaggtcaatcagaaaatacatttcaattcccgcaaaaaaaaaaaagaaaagacatttttcaataattgtagcatgtaaaagaaaaggtaaaaccttgttggcaacgtaaaggtggtaaacatatattacgggcatgattctaggtccaaaatttgatgtaatgaaaagtagtggcaattagggaattcatatggtctgcaactcagccaggatgagaagcactgcctgaccaaacgaacagggaaatgaatcttacacgtcatacaaagacgataactaataaacggcatacctgtatatctatatgtatagcagcatgatgagtcaaactctgattttcattaaacgctactagcaaaatgaattggcacattaaccaaaaaaaatcccatgaaaaagtgttaaacttaagtaggcatgtgtgtccaccatgtttgcgttttttgattttgaactatatgtagcattttagtgaagttagttgatgtggatcttgcagtgctgtctcaattgttattcagatgctaactattaattctgatgcattaatttactttctaaatcgcactctatatacagttgaagtctttaacacagcctcttcaaagaaagctcattactgtattgcatacttcgatgatgcgtctgcaagacccatagactactagaaaaattaagcagccccccacctccaacctaaacaattacggagtatataaaaaactcgagaaattgtgcaacacatctttaaatgtgaaatgaggactgatccagtccggtatgaacgaactataatcctagacggtacaaagtggttgcctcacgcgatggaccaatgccgttcacaggagctttggtgctaaggtgagagatctccccacgcatctcaacaatgatcggcgctaagcgataatgtaacacactttctgctacatgagcatcgggccgggtaaacaagtactagcaaggagaagatgagttacatggaggcagtcgagcgcgggctcgacgagcttgacgtgcttggtctcgaaggcgaggcggagcggctgcagcaccagctcggcctgagtcccctccagcacgcgccccgccgacgccagcacctgcgtgatgggcgccgccgccgcgtcgccgccctcctcctgtcccgccgccgccgcccccttgatggcatctgcgacacgcacagctcacagtcaactcacccccccaccaaaccgagcgccacggcgtcgcggcagggagatccccccacccaatgcccggcagcgaagaggaagaggaggaggaggatggggcacgggcacgggcacgcaccgaggtaggactggatggattgctgcagcgcggcgaacttgccgcggttggctgtgcactccttgagcatggcctcgaaggcccgcgtgacgaaccctcccgcggcgcccgccatggccgcagatctcctccggtgggtggcagaggagagagagggggtgggaatggttttagatccgaggagagggagcgctcatggggcgcgagatctgagctttgtgggggttggaggaggaggacgaggggggtggatctgtttgtctcgcttcaggctcaggctcggcagcagatcgcgaggaccattttgcgaaattggcttttccacgccggatttgatacctgccttgatcggtggaacggtggatcgcttcgcttctcctctgctactgttttgctgccagttgactgccccgcggtggatacctgcgaaattttgttacagaatccgtgtggaaggtgagtgggccagtgggcctgccagaagacaagcgggctctcgtatagtattccacctcgtacttccttcatttcacaatgtaactcattctaacacttttcacgttatattgataataatgaatctagatagatgtatatgtctatattcattaacatcaatatgaatatggaaaatgctagaatgacttacattgtgaaacggagaaatgctagaatgacttacattgtgaaacggttgaagtaatatttttctataacttttgcaatgcgtgacatgatagaaaaaaaaaacaataatgttttagatcggcaccgtgcatataaagtgtttcttattgcgttcggcgaaacgttttcatgcatattatgtcatagttttgttcatgtgaaccatgtcaatataagtatactcatgtgtttttttttgttttcaccatgtttttctataaattgttttttttatcgtgtgatggtcaacaaagctagcatattcattcgcgtattagttaacttcttgctcttattatttattgtcacctttcaaggatagtcatccttgaattcctctgatacctatatatcgtttgttgtaatatctaagtttcatgtattagtattaactaacttctaacttttagtcaggattatccatgaaatttgattctttgttgcctttcaaagatgctcatccccctcacccccctcaccctctaactccttcattgtcgactggttgttttatctttttgttataatcgagattatccataaagctacatctattattccctccacctctcccccctatccctcaaactcctactccactgaccttttttaatattacattgcagatttgcagtagttgccatttgaggcttctactctcccagtctgctagttgctcctcgaaacacatattgatcgagatagataaagatcatatatctttaaagtcacatgacttttgttatgacatgtggacctgatgacctatggatccacaagttagcaacaaaaagacaccaagtcaaagtgagttggaaggtagatgaccttgatatctcatgtagctaactcacaatagcaaaagctatggcatatgtagaaaggaaatgttggaacatacattcaagcaccactattcaagcttggtaaaaatctgtccatttcactgccgttctttttctatcaatgcatacattcaagcatgttgaaacatatttattcacaaaaaaaaatagtacctaaaaagccacgagtgcacaataaaaaagaaaaaaaatgattatagagagatgttctgttttcctttgaaatggaatcatgggaagttcaaagcagcaagacaagcgtagctgtagagagaagaaaaaccaacacaacaattgtactacatgaccctgcatgatcgacaagcgagcaactaattctactaatctgacatgctaacagcatcgcacgtttttcgtcttgtctccgcttatattaggcccaacgacagcggatccgaatagcagccgtgtagcgtcgtgggacagggaaggagttgagcagctgaaggtcctatcagattcagtttcagctttggagaggatgtaacagggtttacgatttcgaaatggtcttccgttttgaactctgtggcgaaataacggttttcgcgaaatccgatagattccaaacaaattttataaaccaaaatttgaatacaaattccctgagtttaccgataagctcatgaaaaccgagggctttggcgaaattctgagcgaaatcactgaaatttcaatccgtatctagaaaaggaggtaaactgaaattcttttccttttttatttcattattttttcctttcctactataaatttcagtaaatacatggaatacaacaattttttcgaaaatttatatcccaatagattctatgaatatcacactatttataagattttatttgattttttcttttttatcaatttaaatttgaatttggatgaaactcatag

SEQ ID NO: 32878 - DNA, 2574 bp, Oryza sativa
actgtttgtgctggaagaaactttcagtgcctttctgcagtttatgcatttcaagatgaaaaaatagcagacactggtatgtttacattctatcttatttgtcacttttgtcacacctgcagcggaagcggactagatacaagaagatgattcgccggcatatagacttccgtatccttcattcaaagatcaagagtggcgcaacatcttctaccaaggagcttctaagagacattctactgtttgtgaataatgtccttgccttctatccaaaggctacgttagagcacatggctgcaattgaacttcgaaatattgcattcagaacagtgcaagagagcgcaagcatgccctctaagagttgtggagtaacaggagcagcaactgcccctttagtgaagaagaacacccgacccgtgcagcctggaagtcatgggcctcatgatgcaaagagaagcaaagtttctttaaaggggactggaagtactgtcaagcagggtgaggccaagggatcgcgtggtggttcatcagtgacagctaatgtaaaaactatgcagagaaatccaccggccaagaagagaggcgttgggcggcctccaaagaatgggcagaagcgtgctgctgcacagcaagatagccctaacaaaggcaggaagaggacccgacgctgaacttcggctcaaaatgcccaaatatacaaaactgtgtacagacagcgtatagctagaccacatagtgtcgtctctttcagtgtttacttgttacctggcaaagactaggtcggaaatcagaatgttgtagcagggagtagtactgtatttcctgttgttgtcttaaaaggacagataggaaagaacatttttataggcagaaactatcaacttagatatatatagtatatctcttgctttgtgcaatgctgatggtttcttgatcaaatgcatgctatgatactaacgcagaaagtttacctgcaaattttgaacttattaggggtatatattcagtacaatgtacagtggcttgtcattgctcaagaatcatgatctgtatagtacctgtcagtctccagtaactgcatgatctgcatctgtatagacgacagtcaatacttactcaaggcgtgtttaggattgatgccattttaaaccatactatattttttaagttgttaaatatgtggatccatttaatttcttgtcaatttttaataaatacataagaaataatgttaaaattttgacaatattgttaaaaatttggtaaggtttattttggctacaatctaaatggctcctcattcctgtttattttaggagggagggaaccggtgctttgattgatgatgttattgggccggtatgtcgttatgatgggccgcggcgggccggcccaaaagcagcgagcccgaggaggagccagccaacaaacaaaccgtgcggaaaacccggtcgccagcggctagcccaaaaaaaaagaaagaaaaggagaaaaaaaagccgccgaggcggctcgcacccgtcgccatcacggcaaatcaccgcgcggcgcgagtcatgggtgcagcgaatgcgaaggcgtgtgtgtgggagagagatggggtccgacgtggagccagccagccgtgggaggtggcggtggaggtggaggtggaggtgatctggggtttcatcattcgtgttccttgtccttttgtaagagaaaaaaaaaatagtacttacttacattgtgaaacggagggagcagtaacttttgctacattttctagtacatactccctccgtcctaaaaaaaactcaatttggaaggggaggggatgtggcaccagtccagattcattgtcctaggaggggtcacgtcccttctaggttgagttttttttggacggagggagtagtttctttttcttctaatttcgtatttacgcgagacacaccactgcacggattgagatcctctgcagtcagatgcacgctgcctttgtcacttacatgtgggcatagagaacatcgggtccacatatcagtgacaaagtcatataatcttgatcctcactgcacatgcggaacgcgcgtacacacactaaatgactactatataccgttacacacgagcttatcaccgttacacatgcaggccatatagacatgccggtgagtgtaccatcaacccatcatggagaatgtatcgtaatatgcgactatacctttaacacgttctaaataatagatttgagacgcataaggatccggtgcagtcgtagtagagactgcaaaggcagttgggaccgttttccatcattagatcgagaggcaatcaacgatccagacatgtgctatatcagttttaagtagtactaactgctactacaatactacagggaaagaatttctgatccaatagtagctctaggacagctatagctactgcaggggatcccaatcctgtttgagatcaacaacaaattcatgacctcttttctatagtgaaataattagttgatgtcttacatcttgctagaaaaatacacggatgaatgtatacatattgtagaaatgatggataaatatgtat

SEQ ID NO: 32879 - DNA, 2874 bp, Oryza sativa
ctttcttgctgtccttgtttccacagcattaaagaataagcacagcacccttaacagccaatgacactaacacacaaacagttcctcttgttttcgaaggttggactaaccatgctacctatttctagcctaaatacctaggagatcttccctacttgcaattcacgggtagataaggttattattgttgtgaattgcagcaatcagactgatttatatccccatcatgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatgtcagcacagacctggaattgtctgacagcctaaggtaacatcggataatgtgcttcagcaaccttgtggaaggctgctcagcaagtgaaactaccatgtttgctaaaacactgcctacagcaaagaaacgctcagcagtgcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggcagcaccatatagttgccaaattgccaacctcctctcaatacatatagcacaatccaccttttaggcttataaaacgaaaggtggcatttgagcttaacaaagggaagcctggttgagaacaagaaaattccaaagatgagcggcagcctgtaataagaagattctaaagatgacaggtggcttacttcacactaacctggacaggctatcattattcatggtagcagaaattttaacctagccaagctacaattcatggtaacaaaaaaaaaaattacacacaaacttcagacagcatcatcacatacttaaagaagaaaaagatgatggtatttagataaacatgagatggttagcgacatacagtttttgacagctcacttcccatttccatggtacgcaaacacagaggaattatttcagtttgcagcagaaaactgataacttcagtatcatcaacctgcgtgtattacatgtgaaagaagctttaattccatttgaaggaaaaaaaatctaaaaccagttcaacacgaaaaaaagaaggtagaaaacatcaaagagtacacatgtttgtttcaaagtaattcaacatattacaaggttacaaattctgttttgtgcatttttcctcagaaccctgccagagggctagtttccaataaccaagctctgtgtctacttatatataaaattggtttgcatccaaacttaattcaaatttctacaaccccacataattcccccccaaaaaaaacatggatacttggtagttacagtgctacaggaaccaggcaaaccactaaacagaagtaaatggctggttaccacgaggatcttggaaatcttttgcttacaatttatgcctgctgttctgcctaatacaagaaggatgcattcttataaggcctcatgcctaactactgaataataataacatggctcttcgccaagatggcagaatagaattactgaaatgtgtcaattgtaatatatatcatgttcgtatcactggttaaacgattaactcatgtaactacatagatgaattaccttaacaagtgcaccgatgacacccaggctggtgagtcgcaggtattcaaaaggtcttgtcttgctggtagtattcaagaatgggtacaggtacaggggaatatgagctgaaaagaacaaaagaaaatgagagagggaaatggaatttttcacagaaacaaaaacaagagctaaaaggttctttagtgtgttattttcttatgaagattaagactttacctcgatttttgttagcacgcttttcaaactaataaaccgtgtgtttcgtgcgaaaactttctatatatatgttgctttaaaatatcaaatatatctatctgtcaagtttgtaataattaaaaattaattaatcatgtgctaatagctatcttgttttacgtgctccaactttatcttcatcttcatgagtttcaaacactagtactacacatttaggaattaggatacgtcaaatatagattacaaaagcatgatcatacacgcatatgagagacagacatgcaaaggaccatgaccattaccagttaagaaaaggatcctggtctcagggtgagatgcaacacactgaaattatttttgaaaagcaaaaaagaaagagttaatcagcaaatctatgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacaca

SEQ ID NO: 32880 - DNA, 8088 bp, Oryza sativa
tctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgttaatgttatcttgatcaaaacgtagtgtaatagcccatttcatgatagatgcgcatcaaccatacggtaaccctaacaccaaatcaccattcaccaaccctaaaaaaaccattgacattcacaatgctaaggcgaaaccttcccccacaggcagtgtgaattccacaaattaccaccagtgccccagatagggtaggctatagaaccctagaagaacgcgcgctggacctttgagagctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaaggagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacacatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggcgaaagccgaggggagagagatcccctctgtcgccccctatggcgccacacggacggccaggatcaaccgatcgccgagatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactactattgccggtatgtttgactagcaatttaaattcatctgaatattacagacctgagataaatgctactatttgttttaagtattgaacagttgattaactgcaattctttctagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactgtgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacgtttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatgtttacggcccatatagagaggggtgtatctgcatcgctagggtttgcctccgcgccgccacctccttcttagcaaagcctcgtctccactcccctgccctcccgcctctccggatcccccgcgcgccgccgccgccgcccgcccgccggtcgatacccctccgcggcagccatggctgagcaggtaaggctcctcccagtcttaccctcgagcttctccgtcgcttgcttagggtcagttctatggtgtccttgttatgtgactcggatcttcttgtcggtgttgctcagtggtattgcgtgatttggcctggaattgtagggagggaaaactggtttggtagccttgcacatcagtatgttggtcattattgtcgattatagatttgatttggggttctagcctagtctcatgagtttgttgaggttttcttgttagatgtgggagtagttgggcggtgggtttgcatagtaccattctcaactctcacttgatatgttgtgacttgtgagccatgttcatggtagcaaatgccaggtgcagttttgtggttagtgtggagcttatctgttagagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagttgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcctgtcatcagttaacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgccggaacatgccatagtgctaagatgaacaggactatcattgttcgcaggaactacctccactttgtgaagaaatatcagaggcaagtaaacaattatggattctacttatgtttcttttcctttttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattatcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgccccctcctctgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttctcttcccaaccactaacacagcaccggcggccattaacgcgctccgccgcctccgccgatcctcggctccggctcctcctgcagacgcgtccgccgcagcggccacggcggtaagttcctcagttgtccccttctccgcacgaatcctagatcgttctgctgcgtggggttcggaggtatctgctatccgatcgcgtgctcgtgagatttgcctccgcttttgattgggagtaatcccagcgagcccccggcgacggcggcgagcgctcgcgaagctgcgagtggaggatcgaactgtcgaacgtcatttcgtcatcaagcatagcacgcttttttttcccctagtctagtcgccgatgcattatcattcccacccatgcttcatcgcgcatcttgtgcttgtgccatcctcaggctccagtaaagagcaactgcaaatcgtatcgcatcgcgaatcacgcatgacgcgtacattagatttttcagttttcccgtttatgtccgcttcctcgaatttccacccccccccccccccttttttttaccagcaatccacgggaaagcagatgctaaagctggagtatactacttttcttgttttcttccctccttttggttcgtgaggtatgcatccaaatttatgtacgcctcatgcctatgcatttctctgtgagggaccactagggatcatgcgggtcatgtttttaccccaaaagagaaaatctgacttttttttctctgcatacaggatgctatgaatttatcagacctttcttcttgatgtcatgagacagtccgcctttattccacatatttagaattttagatagtagtgccttgtggataaggtgagttcgcttgtgctgttttatttgttcatttctggtgaagtatatgcttgccgaactctctaagctggctcaatgcaaagtaatgaatgatgatactacccacttgattccacagaatggtagcgggagagatagctgttctaagatgagactgcggttgcatctgctgattctttgcttgatcattttatttctggtttataacatggcgagttaccaacataaacagacaaaggtaacactcatctacgaaatgtctccctgtagtttgcttgacagatatgactgaccttattatgggttgttgcagttggaagcaaaatcccgtccatttgatacaattacggtatgtaaaccaatcagctccactagaaggaaaagaactttgtgctatgttaatctggaagcatattttcatttgttgctgggacgctgattttgtcttctatgtaaatatttaggtgtctgacaaagtgtcttctaaggtgtctaaaagatctgccaatagggttggttttttaccccatggtatagtggaaccttactctgacatggagttgaagccattatggctcacaagaagtgcgcaatcaaaggtaatttgaaaaccaagcctattcttgtatacagtgtgttgctcagtacaatatatttgttggttctatttcagttttcatacataaagcaggctttagttgctccacctttctgagtacgaggcctgaatatctagttatctgacgctctgcgaattttggctccacaggattctagccagaaggatcggtgcttgcttgccatccctgctggtatagatcagaaaagaagtgtggatgctattatgaagaaggtacttaatttgctacctcaggaagtgatagtttcctcatgatggtaactcttgaatgttcagtttcttccagagaattttacagttatgttgttccactacgatggtaatgttgatgggtgga

SEQ ID NO: 32881 - DNA, 2929 bp, Oryza sativa
caacgcaaaatccactcgagaaaacttgtgcgattcatccgatgatgagttttttttctcctttttgtggtggctacggcgtcaacatcatgctgagccggcggcgtgtgtgtcattagctgccggatcagcggcggaatctggacgccggcggcgacggcgacaggaggaatccggcagctgttccgttcccaacctgtccgttctcgtgggcctctctctctttgctgcgtttcatgtgccctcatttactcggctcgtattgcacacgtacgctcttgtcgatcaggcgtttcatactttcatttgccttgcttttggacagttaatttattattagtaccactagtagatcaacttggatgatttcttttgctggtgtaccaccaagatgttcagttagtaacagtaccaaattaggcattcatgcacgtgaggacatcgtcgttgtcgatttattttatcagtttcgacatgcgttgctgaggctcagctcgaggtagattggtggcgacactggctgacacggcggcagctacaacggctacttaggcccctatttagtgctcctactaattgtttactcctttcaaaaggggcaccacgttacagtagccgttatcggttagtgctgttgattacttgattagtcaattagtgttgcgtttaacagttgcttaatggaataatggttggtgctcagtgtccagtgtgccgccagaaactgagaaaagcttcggcctttaggctctgttcgttctgaggagataataggggagattgattctcgttttccgcgtgcacgctttttaaactactaaacggtacgttttttgcaaaaaatttctataggaaagttgctttaaaaaatcataataatccatttttgaaatttaaaatagttaatactcaattaatcatgagttaatggctcacctcgttttacgtatctccccaatctcctcgatccccttctcctcgaacacacccttagtcatggaaacgggaggattgtgtgagccttcagcttgctggcatgccaatctcctgcaatgcaagtaggagaaaaaatggataataaattgcgtattgtccttctgttagtgtacaagtacagattactgaggcgacacgaggcagcgtatctgatgcgatgcctattgtagacgcagaaattttgggctctagatcctgggatgacatgatcggaatcataactctaggactaccaaagttcacccctttttttcatgattttatccatacgatgggctaaaaggatgggacaaattctacagcaaaaggcattccttggattccgccgtgaaacaggaataggagggatggagcagtcttgtaccagacgactcctcaacatcattttagtctccaatccatggtcatcagcgtcccaaaaatcaaagggttcatcattcttatacccatggtggtatctcagtaaattgagatgcttctttttttacacagattctatcatgataaatcgcaattcttgtcatttaaagcccaatcacaaaacagatctacagagtaattatgcaaagcgcatagtagtaacaaaaccaaattcaccaattctaaatttatctgtgactatgtctttttttgagggggagtggacatgcctttgcaaggcgcactcatgtttcattgtttcacatggacaaggttgtaaggttaaagggtgtaaaagaaaaagaaaaacaaagctatctgtaaccacgtctttagcaaaagccatggatgtatagtcacactttcattgcctcattcttgttagacagttattttataagttgttagactgtttgtaccatgaacttcacacagatcctaaatctaggcccccctttataacatgagagttcacttgtttttttttttttggaaatcaataaaccactcaaaaaatgaaaaaaaacatgtgaaatttcttctctgtttttaaaaagaaaatcagagagctacgaagtgaccataacttgttaattccttttggtagaatctactcacttaggttcaagatctaaacttaacatgcgtgattatatatacgtctaattattttttcatcgatagacgatgtatctatcgacacgatatccatggtgactttgtaaatcaaagtgtatattcgcaaacgtcgacaacgagacgttcatagtcacttcgtcaatctcatagagtgtagtgttacgagtgcttacatagattatttttctttcgtttagagcaagtttaatagtatagcccactattggctccaattcgtctatagccgatctaatagccatttcatataatagttgcttactattctattaatatatggtcccacttgtcatacacatattacgtcttggagtccgtgctgcagctggctacagatctgtagcccactacttttttctctcatcttttatctcattaaaatatgtttacagctggctaatagtctgctactgtacctgctcttataccgtattaaaaaaaaaatcagagagctactactatcacaatcttttttgaaaaaaaaaatggtgctgtcacaatcattgctcattcttagcgctggctaagcaggtttaaaagcggctgctttgctgcacttgtctttttccccttccaccccatctccgcctacgcgcacacaagcgtaacagacgctctctcacactctcctcctcactcgccgctcgcttatctccccaatccaatcccctgccgcgcgacggctctgcgagattgcaaggctagtgtagatctgtctctttcctccctcccctttctcccgtcgtctccgttgttctccaccgagcagagcagcaaaatccttagcggccaaggcttccgggctcggtgagaagttttaaacgcattattacgaggggggggggggggggggggg

SEQ ID NO: 32882 - DNA, 1423 bp, Oryza sativa
ttgcaataaatggcttgtacactgcacttgggtcaccttcagtgcctggatggattacaaacggtggcgacccctgcaatgaaggctggcagggtgttgaatgcgtggtctcaaatattacctccatgtatgatctgctattacactttcgttttgttaatgttgtttgtttgattacctgtttatctggttatctgaacaatgtgatatttctggtagaactctcaatgctgcaaatttgggcggacaactgggtaacacactggggaatttcacatcgctaatcaccttgtaagctgatcattcgtgaagtttaagattattggtgatttcctctcgaattgacactgttattgacttggttcttaatgcttcttggtttacccaatgtagagatcttagcaacaataatatcggtggaaccataccagataatctgccaatcacattgcagcgtttgtatgcccatttgatcattttgttactcttccaaaccatctatgtggttattttaatcttttactatggttttgcttgtcaattacagtttcctttctggtaaccagctaagtggtagcattccaagtacattgtcgacacttacgcttttgacaggcttgtaagtatattgttgcctacacattcacaagacttcataaagttagtgctttcagtgataattcttgcatttgcaggtccctcaataacaatcatttatctggagagataccagatgcattttcaactctaactggacttgcaaatttgtaagagcaagtttaagtttgctctaagtgttattctatactagcatttgttgacaatgtgaagtttcttaccaaagtgatcaaccttcttgaatagagatttttcttccaacaacttgactggtcctttgccaccttcaatgggaaacttgacagcattgactagcctgtgagtattgaagtttattgcactgtctttcaagttgacttttcactagtgtcaagtacttaatgttatactatgatcacaggcatattcagaacaatcaaataattgggttgcttaatgtgctgcaagatctccctctccaagatttgtatgtacacaaaactacagttttttttacttaattcttttctccaagaagttcaggaaacctgctatttcagtaaagataatttctctctcttttttcacgccttgttttctgtggtgactaattcaacaggaacatagaaaacaatcttttctccggtcctgtgcctgtgaaactagagaacataccaaattttaagtaaggaacttccccttgattgagttgtttctgtcgatcgttgctctaactttaatgtttaaaaatcaattccattgctcgtatactcttttaatattaagaatcaactagtttttcatgtgcatatttgtgtttagcgaa

SEQ ID NO: 32883 - DNA, 9692 bp, Oryza sativa
  unsure (1)..(9692): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagcgcagatgccaatcctcatgacatctattctgctttggttagagaaggcctgtttgatactggtgatgagattctgtctatggatagaggggagtctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgtgtcttcgccagagccagaagatggtgtttctagaccatcctagccatgctgatattggttgatttcttctcgagtgcagttcattctgtcaaaatctactgtagacgctggtgaagcaactgaatggcaatgatttagacgaggaacacacttttgctgccatgtgctgagtgctgtagactaagaaattatatactccctttgtttcaggttataagacgttttgatttttggtcaaagtcaggacaaatttgtagaaaaaaatagtaacattttcaagccaggacaaatttattatgaaaatatatttaattattgatttgatgaaactaatttagtattataaatattactatatttgtctataaactttgaaatagtttgactttgaaacggagggagtaccgttgctccagtgtatcaaaacaacgcattgaaaacataccattacgatttaattccatcactagcgcaacttattattgacgccgcgcttattagctcttttttctccctgatgaggatcaataattcgttacctcatgctgaaatctgcactgtagaatacctaagaccgacgtcgaggtctcgaggatgaagaatttggcacgccaaaaccatcctaagatcgagaggctgtgactgtgcctggtggcatattcaagatgtgatcaggttgatgaagacagcattgcacagaaatgtcttcgattgaatcaatgagcacgatcattggcgtgttttgcacgaatgaccaaaacagagacgatgatcggacgaagagatgaaacgaatgcaactcttatcgatcaagacatcggcaccgttactaccaaaggttcttttataggaaaagtattggtggagaccgggtgtcttataaccggccttatctacagcctcgccccggatgaatgccaaaaccatcctatgagcgagaggatcagattgatgaagacactaccattgacgtgttttgcatgaacgaccaaaacagaaaagatgatcggacgaagagattaaactaatgacactagcccattcttttctccaacaagagctggataaagattaagatttttatggcacgctttttaaactgttaaacggtgtgtttcgtgtgaaaattttttatatgaaagttactctaaaatatcatattaatatatttttcaagtttgtaataattaaaactcaatcaattatacgttaataataccatctcgttttgcgtaaaaaaacttattctttattttcatcttaagaaaaaaaaaacatcacaaagatgaccagaagtagccctcgggcgtgcctagttgtctctctctctccccctctctgtcgaacactatgccagaatatgaccagtggaacgaacacaaggtgtttggtgctgtcaagtggcagcatttctgatagtgttgattgcaaatgtaaaggatacgttagcgggggctttaaccacgactccaactttggatttgtttggagagcttaagattttaagaaactactgattggcagtgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccaaggcgccccgaccccttgtgggttttgcgccgcgtatatagggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttacccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggcggggctggaaggggggatgatctggagagtagatcccacgagaggaaaaaagggagaagagggtttttagagtaagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcaggcagatattttataagaatatggagaagtttcgtttcttagattatggcttctagttagtttttgaattttataactacaatttatcaggatttggatgaaaagctaaattgtttggaaattttgggagaaactggagctaccatagactccccaaacaaaaccctttgtgcgccacgatcggttcgcagcgtgtgccatcccacgcgctcggttcacacaccacgcagggaggctctggctcttcatgcgattctaacaaacctaacaaaccttatctaaaagagaaaaaacgaaataaagaaagagaaataccgaaaatactggtttgacacgcaccaggattttctaaaaaaaaaatccaacagtatcgatctaagacatcgtcaccgttattataagaggcatttgtaaatttgttatcgattttttcaatattgtaaggatgccactcgaatgatagttttagtagtatttttacaattttttagtggcagtcttataataacgattcaaaatagtggcaaatttgcaattgcccgttcttttatacgcagagactccgagagtcagtgcaagcaagcaggagctcgtcactgtcaattgacaaaattcagtagcaaatcctactctgtctgcatcaatggctggcccaaccatcgtcctcctcccggcctggggatccggccacttcatgtccgcgctggaagccggcaagcggctgctcgtcgccggcgggggcgccgtctccctcaccgtgctcgtcatgcaggcgccgacggagatagaggcgtcggtggtcgaggcccacgtgcgccgggaggcggcttccgggctcgacgtcaccttccggcggctccccgccgtcgagcaccccaccggctgcgaggcgaccgaggagttcatgtcccggtacgtcgagcgccacgcgcaccacgtcaaggcggccatcgccggcttggcgtcccccgtggccgcggtcgtcgtggacctcttcttcacgcccctgctcgacgcggcgcacgagctctcgctcccggcgtacgtgtacttcgcctccaccgccgcgttcctcgcgctcatgctgcggctgccggagctccgggacgacctgaccgtcgggttcgacggcatggagggaaccgtggacgtgcccgggctgccgccggtgccgccgtcgtacatgccggtgtgcctcgtgagcaagacggtgaagaactacgactggttcgagtaccacggccgccgcttcacggaggcgaagggcatcatcgtgaactcctccgttgagctcgagggcgcggtcctcgccgcgatcgcggacggccgccgccccgctccggcgatccacgcgatcgggccggtgatctggttcgacgccacgctgccgcccgagcagccgcacgagtgcgtgcggtggctcgacgcgcagccggcggcgtcggtggtgttcctctgcttcgggagcatcggcttcctcgacgcggcgcaggtgagggagctcgccgcgggcctggagcgcagcggccaccgcttcctgtgggtcctgcgcggcgcgcccgccggcggcgtgcggtacccgacggacgcggacccgggcgagctgctcccggaggggttcctggaggcgaccgccgggagagggatggtgtggccgaggtgggcgccgcagaaggacatcctgggacacgccgccgtgggcgggttcgtgacgcactgcggctggaactcggtgctggagagcctgtggttcggcgtgccgatggcgacatggccgctctacggcgagcagcacctcaacgcgttcgaggccgtggcctccatgggcgtcgcggtcgagctgaggaggacgacggcgaaggacggcgacgcggcgagatcgctcgtggaggcggcggaggtggagcgcgcggtgaggaggctgatggcgccgcagggcggcgggtcgtcggaggcgagggagaaggccgcggaggtgagcgcggcgtgcaggaaggccgtggaggagggcgggtcgtcgcacgcggcgctgcaacggctcgtgcgtgagatcgttcgtgtcgtggcaggccacactaggccggaatagctggctggttgcggttggttggcccatctcacacggtactcggcccagtctagacgagaaaattatactagaaaccaagacgtcaaccacgtgatgcggcttaagggtgtgtttgattcgtggtagggtatagccatccctacccctatgagcaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggaaaattcgctcccacagggagttgaacccaggacctcatgtactactgaggctcttgtaaccactaggctacaagccctttcacgggtatagccatttatatttgtaggaatatggtggttctgtttgttttatggatatatgaccatccggataggaacggatagagtaaaatcaataacatattaatcaatgataaatatgttaattatcatcaatatagtcatatctatactaattaacaataaaatggactaattatataatcaacactaattttgacaagtcaattactccatacgcttcaaaatataagaaatctataactggatgagatattaatcatttactaatgattaagattaccaaatgtggatatcctcatccggtcaatttaacccactcatctagtatcttcgtgaaacattttctctttagaccacccaatccattcttacccatcaaccaaacatatttaaaaactggatcgtcatatcccatttagtgatatcactctaaccaaacacaccgttaccttcctcccacccttaacccccatcgcattagaagctgagaagtagctggttgatagctattccctccgtcttataacatagtaatccaaaactgaataagacatttcatattagaacaaatctggataggatggtatttagattcgttatactatgaaatgttccatccgattatagattattatattatgggacggatggactaacttttgagaatctggaaaagttgaaaaactagaaaggctaggtttccaaatttttatctttatttattttctatattctataactacaacttcttaaatctaacttaaaaatttatattatcttaaaatataacttaaaaatttatattgtttaagggagctaaagatttaaataaaagctatagcggttaaaaactcatcaaacagagatactcctagttagcaaaggagggtggcatttcggcttgggaggcccatcgacctcatatctccggcgaaacggtataagccaacaaggcaacaatgtactactacacgtcaagcgaggacggtgactttcgtggaggtagaggactctgtctgaactgttttcattgaagaaacggaattgaatacaggccaagtgcgcaggtacaccatagtcacctattgatatatatacgtacagagaaaatgaactacacgtctatctacacttcaaccgtctctcaactcacatcagtaatttaatttccggtttatcccaccgcatatccgtttgttgacatttttccatcactacttattaagtgcgaaatatgatgactgctcgctgtaaactgcaaggaccatttaacaggcttagctggagcaggatgaactcagttgctcgttttgctcatttctcatttccttctatttaattttattacctgtaatttttctcatttttcactgaaattttagtgagtccttcaaaaattaaataaaaaaacagaaaaaccagctggagtcgaggagtggtcgctgcatgtttgtgtgcagtgggccaacgaaattaaaccaaggttttctggtaatgaaggtccacatcaaactatcctctcgcatggcacagttaatgctaccaacgggtggtcgggtacagaatttaaatgctgtgtgctttaagccaaatgtagagaaaaatgggtctttatttatttcgaaatatctcatggccagccgctctcaatggtgtgactaatcacgttcaagccatgatatgatggatcaaggcgagacaagaaaaatgtatgagcagtcatgcgagcaaaagtagtagtactgatgagtgatgccccttcaaatatcataacctccctgatcttttctataattctattagaagaaataattaaaagatcgatcacacataggctctgctaatgaaaccggtaacaaaaatttaatcaacttcctctcttcatctccagcatatgtacaacatactacatgcacagggattacaagctgcatgcaaagcttagcattttgcaagaaatcaacaaagccaattaattaatactcctccaatagtagtactagtagccaaggcccaacgcaacaagcacacctcgcagagagcacagagacgtacgcagcaagtaggtcgcctcctcctctctctctctccggccatcaccgccggcggccggcgatcgtaggtagcgtagagctagctggcgtagagcctgtagtggcggtaggacttgagcatggcgccgcagaaggtgcagatgatggcgcgccacgtggccctgtgcacggtgagcaggtagcagaagcgcgtcgccgtctccatgtccgccacgctcgcgcacccgccgcaccgcgagcagatccccgccgccggcttgctgctccggaccttcctcctctggtccaccaagaagcagaagaacaccatcctcctcgtctccggccggccggctcgccggaatctcaaataacacgatgtgtggagtggtggtctctgacagcggcggaggtggtggtggaggatggcgcaggggggttttaaggaggagagcatatggatcgcattgatggcggtggtagtgaggtagcgggtaggagaggagagaagggggtggaggtattaatggcatgtcggcttgatggctggacggctggaccatgatgcatgggcatggcgcgttgtatgccactcttgactcccggactccacttgtccggagtaatacaattacagttgttgtttgttaattttttttcttttgacttaatgtttagtacgagatagatcagaattgaacaccgccactccgccacctaaaaaaactgactggcaattctggatcttcgatcagccagaaataaactgtctgaatcttctttttttttttagaaaatttctgtctgaatctttgatcagcatgtttgtatatatgtgatgtggagaagtaggttacgatgtttctcatcagttttatactagcacatttaggcttcctttagaatggaggaatctggtgagaattttacgagttttgaaccgattcctgctaaactgtcgtaataaaatccctagtagtacattttaaatgagccgtcagtgtctttttattttccagaaacagcactagagcgactgagtggcagctataaacatcgtccagaaattaaaaacagggacagttaacacgtcggtgtgagataggagtagatcgcacgacgctgactgcccactgggaggtaagagtctgggtgcgagctaggctgcgaaggaggaaggatgatagccagttggttaatggatagacagcaggagctagcagatggatcgcaagtatccgtcaaccaatttattagttgtgccttcgccaattccatttggatttcacacgaaagcgcctcgtgaagcaagcaaaatatgggtagagagagccttccctgctaagcaagcgagcagtcgatcgagcaatatattcatttgaccgatcactaacttctctttcgaagtaaatgatgggtcactaactaactgtctaactgtatagtaccatttgtaattgcagatcgtttcagagtatgacaaaggcaatctccatcagaaaaggcgccaacggtctccttttttttattctttttgaaaaagagaaggcgccaggcaacggttcttttaccaattcttacaggtttctcttgtttcagccagggatcaccctggagcttggggaggaggaccacctcctttgatgttggatggga

SEQ ID NO: 32884 - DNA, 3492 bp, Oryza sativa
tttttagtaatggaggaatgtacgtagtctgtctctgttcttactgtttagtgtactgctggtggaatcgaacattaaaaaataaaaacaccaatgctaatgatcttatataaaaaaacatctttttgaaccaaaaaaatgctaagaaaatatcatttccatcacattttgcatcccaatagcatgggacggaaacatatactctaactttaaatgattgacatgtgagcctcacagctcgtaggctcataggttaacgacacatgtcggagaactgtatgttagaggagcttcttcggtatgagatggcattttcctcctcaccgcttctttaatttcattttcatacacttttgtttttactacaacattcaactattgtataatcccaaatttaaaacagcgttcttaattaagcttatccaaacctttggatattagctagagaagaattatggtatggagagaagctagagagttcaaagaaccaggtgactagtcgttgtctttagtaaaggtggttctggcatctctagatgttcttccaggttttgactgccttctgttgcgtgaaaaatatactggtgcttatgtatacagtacataactataagtatatcttcttcaaatcttaatacaatcggttgtccgtttcttcggccaacccggccaaaaaaactagagaataattaattaattttcaataactagaaaaggatccataatatttaacaagcaataatgaattttatacattaaataaaatatataaataaatggatataacttttattgggttctatatatttgctcacaagtcacaactgctctctgtaattttggtcttcatttcatttatttattttagctgcttagaaggcatgacgagacataactacatagggtattgattattaaacttgtctgaaatgttatggcaccaaaagtagctgtaagagttgttgcggcgatttaagatgtgaaacgtgtgatgtcattagctttcttataagagtgtgttaattttcggtagtaaatcatggctgtcacatttgtgatgttatgttacgtacaggtcagctaccgcaataccgcaaataggatgaagcaaatgaatgattagcacacccaccatcgtccttttttcatcctactagccaagaaccaagagaaaaaaaaacaatgagttttagtattaattcgattaaacatatatttaagttaaatagtttttttatgattttccttattgaataaataggtgattttataatttaagaagaatcaacagtgaatcagccaggagatgaccgttgaagggtgtgggttgattaatggaatctatttgcctactccctccgtcccaaaatataagaatgtttttatattttgggatggaggaagtagtcagtggtgtaatataatactccctctggttctatattaattgacgttttggataagattaaggttaaacttttataactttgaccatcaataacattaaaaatatttagtttaaagaaactagaaaaacatatatagatttgtctttcaaaacactataataaaagtaaacatgcatttatttattgtatatattataatagaaaaataaggtcaaagatatatcttgtagagcgtgtcaatgtccaaagcgtcaattaaaatgaaactggagggaatattatataatactagtagggatggtgtggtagaaaaaccaccactacatatacatacagtatagaaattcttcattgtttacattattaaggactactcatacgtaccattcaatcttatcttcaaagtttccaacctcatgtatgccaagccaatccttgctccactacatggagtgcaaatgctacccaatgtatgtcaatcaataaagtgattaatgtagccatgtagggcaagtgatacaagtcatgaacagatcgatatttattgctttgctagttgctactgcaatatacatgctcaaatagtctttaattatcatcttgattcttttactatacctagcatatttcccaagaaattaaagaggggagctatgctggatgttgttgcccatgctgctggcagtataacttgggctgtgtttagttacacgctactaaaaatagaagtttaaagaaattggaacgatgtaacgaaaaaattagaagtttgtgtgtaggaaagttcgatgtgataaaaaaattaaaagtctaaagaaaaaaaagttggaatcgccttgagccatgactgcctccaaaatcggtgcttccttaactcggctgcattactccgtttggctgcattgctccgtttgtcacgctcgcactgattgtcttgtcgttgtagatcagtcagttaattaggaccacacgcaggcagcgcaattagagcaagtttaatagtataaccaactactagttacaattcaactatagtcagtctaatagctcgtccatacaatagttacatactgcactattaatacctggttccacctgtcatacacactgtgtcttggagtccgtgctacagctaggtataaatctgtagcccactgctctcttatttatcttcttaaaatatatttacagctgacttatagcctactattgtacctgctctgcctactcatcctcatatcctttccttccttcgactacagggaattagtagaagatgggtcggtctgacacgtaaacacgggtacattaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgta

SEQ ID NO: 32885 - DNA, 5559 bp, Oryza sativa
gctcataaaaccttgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacaaacttatactctcgaaaataatactcccattttccatcaacaactccctccaatcaaacagactgatacggatactgatgcagggagtttttagagttattgtactttctagaagtgtggaacgaataaccattaaccaatacgaaaaatatcgtacttctagaagcgtggaatgaataaccagtatggaaaattgttttcatcattgaagaaatgttatttacatgtcagtcagataatcatcagaaaagtatccccatggtgtccgtagtctagtttaagataattttctccattacctactactcatagagtacaaccttacatagtagtttttagtgtaataacgggcgcacgggcgcgtgtctgcccgcaccgctgctaggggacacgcatgtaataacgggagccgtagagatcgcctcacccgacatgaattgattgatgagcccgcagagataatctcttatctgttcatcatcgtaaaattgaagttacgaattgggggagaaaaagatgggcctgtactttgacacctacttctcgtatgaccatgtccatgtaaagaagcaacgggaaagagagaaggagatgatggtattttcgtccaatacatacaaaatacgtatcttagtagcaccaatgaaattacaaacaaatagcagtggcatcgtttgaaatacgcaaaaagtaacagtatatttcaaaaccaataaaattttaatgatatagatctaattaatccattaataaatcatcacttacatagatgaaatttagttcagaaaaacaagtagtaagagagagaatcttccaatccctctcttccagaatgtgtggattattcagagaactgaacacacgtccagccaaatcccgaccaaaaaccatcatcaatcagccgatcctgatgttgtccctgccgcacacgagcgtggtggcccagttgaccgccacgtagaacctgttcctccagctcaccaccctcggcccagacacgcccattggctttagcttcttcccaatccaacgtctggtggtctctcggaggtctgcgtcgtcgccgttgttggtcggagcatcacctgggcggtgtttccctgtctgtcgagcatcacccatggcgcataaagaggtaagcctactactgtcttttcgcatgaatgtaaaaactcttagagaacttgtgtcaggattgggacgaccttaaagtgttcgatagaatgcccagtagaggggagtgggttataatctctcgagacgatagctccttattaccagagcaactagaggttggctgccttccactgctgtgctgtgtgttgcaatatttaatcaccaaacaagtactaataatctattgatttatctttgcacacaatatttaagtattcttgtttcttcgatattaaataggtagattattaatgataaatagattgttgtgagttcaaacatattagcaggtgctttggcttactatgcagtgtggtatggtaggggagcatattttagagggtatgcacataagggtacacatatgatctctttttttttttacgaaagccacctttggatgagcatagagtatagttgtgtgcgggttaccttgcctttaaggtgttcgttattttctatcagcacagagtatgaaactatcttaaggtgtacgttcccttcttgcctgttccgtgacgcacccatgcgcgaaggcgcgagctcagctcgtgaccacgacgccgtatcgcctcggcctagccagctcgcaagtcgcaaccgattccccatctccgcctctgctcatctccactcgcccgccgccggctcacctctcggcgacccggcctcagaaagcgtcggtggagcggggccgggggcccgtcaaccggcccatcaaacaagccgttggcaacaacgcgtacaggaagagggagaggtgtgggtgtgtgcagttaggtgcggcgccgccgccgggcggagtacatcacttcggcggcgctctcccggctaccgagcatcacccatggcacacaaaggggtaaccccgcagtttcctcccaagtacctcacatgtgggatttgattttgttgttgttgttgtgtcgaggcgttgagaagttgtgtcgatcttgggacgacctcaagatgttcgatggaatgctcagtagagccaatgatctgctgcttcggcgtacgcctacacaagcttcagcaacaacacatcactctaccgatatagatatcgactgtgcaagcggccaattcttgatgttttacagtgtaactttgactaacaattagaatggattgactgcagcccgacgcgcccggtgtcagtggcatcagcagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgaccgaccaaccaacctaaggtttggttcttctgtcactgaatttttttgtggcaccgttgtacaattgctcaatgtcgattaaggtgtgattagctcataaaaccctgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacagacttatactctcgaaaataatactcccattttccatcaacaactcctgaagccgccggccgccaccgtactcgtatattcctctccacccgtgtgtcgcgtcgatcgccgtcggcggcgggcggcggcaacttctggtttatggagaggaacaactagggtgggccggtgattggtccagttttgactaaacggcccaattggttcatggcccaggcgcatcttaggggttcggagatttcttctccgtaccccgtcgaaacatacgcattcgccgttgtggtgccctcgtatcgtattaccggacacctacgaggaaccatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggttcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgaacaattgctcaatgtcgattaaggtgtgattagctcacaagaccctgctttgattaagggctaattgaactggatgattgagagagaaaaaaaactcatacggatactgatgcaaggagtttttagagatatattgtactttctaggaggtggaacaaataaccaatacggaaaatatcgtacttctagaagcgttgaatgaataaccaagagtaaaatacaccagcggtccttaaacttgtcgggaggttttacttagttccatgaacttgtaaagcgcacatcgagttctctaaacttggtttattgtattattctcgtccaaagccgcgtttgaccctggtcttgcctacgtggcacgccacgtgaacgataacatgg

SEQ ID NO: 32886 - DNA, 11176 bp, Oryza sativa
gcaagaccatagtcaaacgcggctttggatcgggataatacaataaaccaaatttaggaacctcaatgtgcactttgcaaatttgtagacctaagtgaaaccttctgacaagtttaaggaccgttggtgtattttactcaataaccaatatgtgaaattgttttcatccattgaagaaatgtttttttacatgtcagttagatatagataatcaacagaacagaatccccatgaatccccatggtgtccgtagtttagtccaagggtttgttcactttgatgctattttcaatcataccattttttttgtcgagttgctaaaaaaatatctgcgtttagtttgttgccaaatttagttaatacataagaaatcatgctaaaattttagcaatcttgccaatattttggcattgccaaaacttggtaaggtttattttggctacaatctaaacagtccctaattttctccattacctattaaggttgtgttcttttcccctccacccaactcacttcccttccttttcacatacacgcttttcaaactgctaaacggtgtattttttataaaagttttctatatgaaagtttttttgaaaaatcatattaattcatttttcaagtttgcaggttaatacttaatctcaccataatcacatgctttgttttcgggaggcaacgttgggaacctggcctcttgaacgcaacctaagagtacaatcttacatagttttaggccttgttgagatcccaaaaaaatttggcaaaaaacgtgggaaaaaaatcacatgcattgagcattaaatgtgggaaaaaatcaattgaacagtttgcatgtaaattgcaagacgaatctttcgagcctaattacgccatgatttaataatgtgatgctatagtaaatatttgctaatgacggattgattaggcttaataatttcgcatcgtagtttacagacagaatctgtaatttgttttgttattagtctacatttaatacttcaaatgtgtgttcatatacttcaaagtttttacacccaaaaaactaaacacacccttagtctaagataaattttctccgtgtaatgccgccttttcaaaagccttatcttatccgctaaaatttaaattttcaactttaaatttgaagttgattttaagatttttcatcgaagtttttttagtcttcccttttagatcgttatgaacacgtatatataagttttattcataaattatttttcgtttgcccgtttttcttattccacgtaccacgatggagccacgagtgtccagacttgaatgaaataattaccccctccagatccaagcaagttcaagagccattcaatcaaaaaaaaaaaactcaacctaaaaaaacttaacctagcagaggtcatccccttcctggatatatggtagtcagggttgatttttttttcttgagacggagggagcgaagcaaacgaatctccaccgtccgatcaaacagcgtctcatacttaaggtggtgtttgaaagtcctacaggtagacgaaatgaatcctacccaggaagaaagaaattaaagcggggcccatccagcccgtgccgtgggacgtgcgttttcttcttcttgcagcacaagccgcggccgtgagatcttccggcaagcacggggaaggctcgcgcttataaaaagaaagaaacagatcttttcggttaaataaattttaatcaagaaaaagagagagaaaggcttctcttcttcttcctcgtattgctgctgctgcttttggtctcctccggtgaaagcgacgggccgtgatggtgcagctgccgtcgcgctcgtggtgaaatcttggacactgccggtaatttcttgtcattttttccccttcttttcctcgagtctgggtggattacgcacgcacacaaaaaaagaaagctggggtttctcttcaatgcgattcgagggcgaatggggatgacgcacgaagcccctgcggcgggcgggcgagacgacgagcgatcgaatatcctcaggttttattttctttccacgccgttcgcttcccgcaatcttgtttcctacgtacgacgatgacgagtccactcggaatatccccggaggaatccatggtggattcaacgaatcatcaaaactaccaaaccgtggagtagtgtgtgtgtgccgtactgttgaagtctggccgtttcgctgggtcgcgatcttgtgcagcacacgccggcccgagagaaggttccgattcccatctctcagccagttttcttggagaagaaacgttgttgtacactttattatgtatggcgtgataaatttggagagttcgtttgctccaaaattcttgggggagggagattggtcaacaccgatgtgcttctagtacttctcttttctcactgggctccattttccaaggaagaaaaatgcgaagccaagtctcgtttcgttcgtgtatcatgtttttttttgggtcgctttctttgtgtgtgtatatatattcctcgtgctgttgttgccatcagatcagttttgtgagattcaaattgacaactctttgaattgatctgcaggttctcgtggtaattctgtagttgtttttttttcgagttcttgtgtggggcgaagcgaagcagatggcgtggtcgaggattgcgaggggctcgcagctcacgcagccgctctcgaggattctcgccgagggcaacgcggccgccaccccggcggcgtacgcgctgcgcaatgcggcggcgctgggccagcgcgcctcgtcggcgtcggcgtcgtcgtcgttccacagcctcgcgttggcggggcttgctgacaagtacgcggccggcgctgccgggcggctccagccgagcagggggatcagcacgacgtcacctgcgctgcgccccgcggcggaggcggcggcgagggtggtggagtgctcggacgccgccgacgaggcggcggcggcggcggcggtgccggacctcgggcccacgcggccgggggagaagccgcgcgtggtggtgctcgggacggggtgggcggcgtgcaggttcctcaaggacgtggacacgcgcgcctacgacgtggtgtgcatctcgccgcggaaccacatggtgttcacgccgctgctggcgtcgacgtgcgtcggcacgctggagttccggtccgtcgtggagcccgtcagccgcatccagtcggcgctcgccacccgcccgggctcctacttcttcctcgcctcctgcaccggcatcgacacggggcggcacgaggtgcactgcacggcggcggacggcgacgggctccccgccaacccgtacaacttcaaggtgtcgtacgacaagctggtgatcgccagcggctccgagccgctcaccttcggcatcaagggcgtcgccgagaacgccatcttcctccgcgaggtcagccacgcgcaggagatccgccgcaagctgctcaccaacctcatgctctccgagaatccaggtacgctttcaaccacaccttgcatttgcacctcgtccatggcgtccatggcgatggttgctcgatcagttcttgatcgttttggtgaatgatggtgtgtaggcttgtcggaggaagagaagaagcgcctcctgcactgcgtcgtcgtcggcgggggtccgaccggggtggagttcagcggcgagctcagcgacttcatcacccgcgacgtgcgggagaggtacgctcacgtcaaggactacgtcaaggtcaccctcatcgaggccaacgagatcctctcctccttcgacgtcgggctgcgccagtacgccacggaccacctctccaaggtactacatgaccgagacgataggaaagattagtcgttcttcgttccgctatatcgactaactttttttttttttggttttaacactaaatcgttgcagtacggcgtgaacctggtgcgcggcgtggtgaaggaggtgaagccgagggagatcgagctgagcgacgggagccgcgtgccgtacggcgtcctggtgtggtcgacgggcgtggggccgtcggagttcgtgagatcgctgccgctccccaagtcccccggcgggaggatcggcgtcgacgagtggctccgcgtgccgtcggtggaggacgtgttcgcgctgggcgactgcgccgggttcctggaagggacggggcgggccgtgctgccggcgctggcgcaggtggcggagcgggaggggaggtacctggcgcgggtgatgtcgaggatcgcggcgcaggatggcggcagggcggggcgcgcggtggggagcgcggagctcggggagccgttcgtgtacaagcacatcgggagcatggcgtcggtggggaggtacaaggcgctggtggacctgagggagaacaaggacgccaggggggtgtccatggccgggttcgtcagctggctcatgtggcggtcggcgtacctgacgagggtggtgagctggaggaacaggttctacgtggcggtcaactgggccaccacgctcgtgttcggcagggacaacaccaggatcggctgaatttttttgtcgggatttggctggaacgtgtgttcagttctctgaataatccacacgttctggaagagagggattggaagattcttttttttttactacttgttttcttaattaaatttcatctatgtaagtgatgatttattaattgttttatacggttgaatagtaagcgtccatggaaaatattggatgcttcaccagtccactgcactcactcctccaccaagtatcaacatataatcatcgtctacacgactcgaaatgttaatggccgtgatataaccctttctacagggtaagataataagaacttctcgagcataactatgtggtgcgtcacaggaagagattccccttgatctatttgggtcgatctgtttggatcaaggcacactttgcagtcctcgggcgtccatagtctttgtccccaacctgccatgacctggttcttgggtggtggctttggtcccatgtatgtgataacatacaggacgtgtggccatctccgaacaatctaggggcacacttcatctctgaacagttctaggacacacttcgactcaagccggttgatccaaacagagtttcgagcattcaactttttttaaaaaagtttggatcgagccaagagctctagactagggaggtgttagcccacaaccaatacagtctgacatcttgacttttttcccactgtccaacccccaacccggaatattaatccgtatgtgcaatgtcgtgtttaagcctgccagtgggctagattttattgggcgaaatggattggatgttgatttggatggtggtggttggattcaaatgggctgatattaattttggattggagcgggttggcctgtgaagaattgcggtttgggctggagtggatgcgggttggcctgtgaagactatccatggattcagcccatgggttagcctccaaaacaaaccgaactatccccactccactccaaaccctacactccccgcacgcgcctgtgcgcagtgcgccgccgcgcactgccgccgccgccgccacaaccgcgcgccgtcaccgccgcgtgccgtcaccgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctggggggactgttcttggaagtggttcctgggagcatcctggtatggtaccttggctatttttgtgctttttctttgtttcgatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaaagatgttggagatttgaacaaattggaattacacaaattgattgctagcaatgttctgttattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagtcccatataactactaatctgttgatttaggtggctgtctttcactgtataacaggttgctgttgggtatgcttatcatttcactagtttttagcacaagtagtaaatgtaaatattaattctgcacaagtagcaaatgtagatattaattttctattcttgtcaaacacaggtttattaaacatgtctatgcaaaattctgaaagttcatctgccaatagttctagtcatgagctgccttcacaaacacgtaagagagcaaaagtgtgggaacattttgagcaggagcttgtcatgatagatggtcttccaaaagcacaatgcaaatattgtggcttaatgttgtcagcgactagaaaatcaggaactagccatctcataaaccatatttgcgaatcttgtccactagttgatggtgaagttagaaataggtttatatcaacagttaggaaacaacccgtggaaaattttgtgtttgatcctaaaaagactgaagagttgatgataaaatatttcatccatgctgagataccattccataaaattgaggatccctacttggatgattggatggcatccatgcagccaacttttaaacttgtgggtcgtcaatcaatccgcgacaagatttacaactattacaataggctgaaacaagaattgcatgctgaattagagaatcttgattcgcgtgtatgcctaacatcggacatgtggacctcaaatcaaaacctaggatacatggttgtcacagcccactatgttgatgctgaattcaaaatgaaaaagaaaattataagtttgaagcctgtgaagtatccacacactagctttgcaattgaagaagccatgatgaggtgtttgactgagtggggcttgagtagcaaactgttcaccttaactttagacaatgctagtaacaacaccgctgcttgtcaagaattagtgaaaactctcaaggatgagttgctttgagtgatcctgattggcaaaccagcgatcttttaaaacgattggctgctcctatgcacaccaagtttgcaaaatattgggatgaaaaattggcaaacaacttcaatttggcacttgtcattaccactgtgttagatccaagaaggaaaagagactatttggatttcttttatgagaaggtgtctccccatggttctaatgttgaaagtaaagtggactctattatagaggagatgaaatcatactttcatgtatatgaaggaattgcaagaagaaggggtgtatcctacatgtcacagtctagtgagagagttagtgttgtaggctcacctgttttgggaaaaagaaagctagagcatgaattcaccctcttcaagtcaaaccggaaggttgcacgtactcagaagtcagagattgatacatatttagaagaagtatgtgaggatgatagtgaggattttgatgttttggcatggtggaagaaaaattccaaaaagtttcctgtgttggcaattatggctcgagactttcttgcaattccacttagcaccgtgccctcagagtccgctttcagcagtggaggaaggattcttggagacacaagaagctcattgacaccagagatgctcgaggcacttgtttgtgcaaaagattggctacatagagccaaaaaacaaggggattaaaggtataatatctcacgccttgtatttcgtctcagactttgtggtctgtgccatataaatagtaattgtagatgtgttttcattttatattgtttgattagtcacaaaatctagattaatttgtctgagtgcccaccagtattactaatatttgtgccaaattttctttgatctaggttcgtactgagtactgaccatatgatgttttgtgaagaaggtttggtatgatggctgttttttttttacaatggtggggtccctgtgctcagtaacttaatgttgttttttgttcatcagttggtgaaatgttaggcggaatttgtaacaccttgcaatgccttttatatctattagttgtatccttacttgtatatattcttatttgagcagctagagcatgttcaggagatagatgagagcattgtgtatgtgaaggataagcaaggaaggtggcctctctcttctcccagaggggcaaaaaaggccccaaccaggactctgtcatcctctgccaggtaacatcttcagctctaactctctgtctctgaatcttttctttctgtttgatgtgctcagctcagatcaatccgctcaatttctcctcttgatgaggctgctcaggccaaatgttttgttttgtactcaaaagggttcagattagttcagggcttcagggtgttctctagtccatgatttgagcttccatgagctaattaggtcagcagttagtagagtacttttttttcaggaagagttagtagagtacttggtagaaatagagaaaaatcttttctttctcttgcaaaattgtttgatatgatatgttgtatcctactatgttgattctggctgcagaattttggggctctcaaccttgttttcttcctctcttttttttttccatttcttgaaagtccttgtggttgtatatagtagtatagatatttagttgaatagtggggatggatggattcattcttcattcttactagtgtgtccactaactcatgctagtcatatcttatagaaataataatattcaacttgtaatctttcaatgttatttctgaaatataaatttctgatggcttctttctcttccagattatctacaactgcatatggatcaaggcatagatgatgttttggtagtttttgttgaagatataaaccttattatggcccttattattgctgtagtagtgagcaattgacttaattgtaattatatgacatcattagtcttctggtattcatttcagtgctggatcagctaacaaacaatgcgatgcgtatcattctgagtattttttttgcccaattttcagtgtttcagcaagcaatgatgttcttttaatatttctgttttgaattaattgtttgcacgtgtgtctacactgctgctctctatactgtagctgagatccatggctaaagaagtaacgaggcctcctggctccaagctctctgtagtgtagctgggatcatggattgaatccattccagtgaagtgggctgaacccattttagtgtaatggtttggggtgggttggattgaaatctgatgcggggtgggttggtttggattttggaggagaggaaatggggtgggttggtttggcatgccattccatgaggaggtgggctggggtggattcaaattggatctcagcccactggcaggcttagtcgtgttccaatgtggtcgcaggcatgcggtagagaattaggaattatgccggccaacctatcggcaacaaacattgtgcgcaatctcagtttcagctaccgacgagtgatcccgcggcgatcgtgcagccttgcaaccaccatatcgaacaagagataggggaggccaacttgggctgggacttgatacggatgaactcaccaacaatttgggccggaacgggattaccgtgtatgggaataggtccacttgccatcccttaacttcacattgagtttaattgacatcctttattcccagtaccaaaaatttttacctttaaactatacaaaaccgtgtaggaagagtcccatggcagtatcaacagctggtttagctgacgtgacgtcctagttagaaaaaaaaatggtgggattcacatgtcagcatctactcgccaatgaggtttgcctcggcgcctcgcttgtgttccaactccaaccttttattcctgttcgcccgcggaccaacctgatgaggccaaccaagaacacaaatccccacatcaccaatccacacaacttacacaagctcgcagcttgcgcgggatgggagagagaaaactcttctgagattttctcctctcctctctgcttttgtttcttggattggtccacggttcttggggcggcggcgccgtcgatctggtattgtgaggagaataagaatcagaggcaagtttcttgatctgatgatggcaagcatgacgtcgatgacgaccgctacctctgccgcgaagacgtaggtggggttggctgcgtcttcaaccgcggcgggagacgtgtgtacgagggtcaccccagtgacatggtgcagtgcggctggcaacacgtgcatagggcgtggttcggcgtgggaaaatgaaaagagaaaaagagagtgggcgatgggccccaccatattttttttattttcttttttttactatgttagctaaaccaagtgctaatactaccatgggatgatgggactcttgttgcacggttttttacaatttaggtgtgaagatttttggtattaggataagaggtactatctccgtcccaaaataaataagtgtagttttacactgtttatgtcgaacgttcatccatccgtcttatttgaaatttttttatggttagtatttttgttattattagatgataaaacatgaatagtactttatgtgtgactattttttttccatatttttttttcaaatacgtaaacccacagctacttatttttggacggatgtattatcaattaaactttgatgtagagttaagagacaacaagtaaacttattccccatggacgagtcaccaacaaatagcatttgattgcctatctg

SEQ ID NO: 32887 - DNA, 2051 bp, Oryza sativa
cacatatgtctagatttattaacatctatatgaatatgggcaatgctagaaagtcttataatatgaaacggagggagtatttgttattcgcaggactgacctggataacccagatgctgagcaatgattcgacgcagaacaatccaaatccaacaaagtagaagatctgcaaagaaaaattacaccaattacttgaccgacaagatcagaaagagttttttcggtaggcatctgaaaggtaagttgattatcttcatgaatcaaaaactgcatatctaaccatagttacttagcatctaacaataatgcgatgcacacttacccccaccaaagcattcttgctgatgagatcaattgctggtaaaatccccctgcgggagtataaaataagcattagttcatgcaagttcaactctcacagacactagagaatccttaggcccaccctcctcgctacactagctaagaagaaatccatccaatcatattttttttagtatttatgtatgtgttaaacagaggagcttcagatcccacatattgaagtgcctattttttgttgtttctattgaaaagatgaatatactaccacttcatgaatcataacttaagctcaactaaggaaactccaacatccagggaagttaaatcaaatagtacaatgttcttatgcgtcaatattatattgctggaaagcaggtgcatcaaaacttgcatagacaagcagaccacttcactgataaaaaaagccatttgtacaacatgcaagtaggtcacccttttagtttcagtttccatattcccattgacagaatatgaacaagcagggaacttacgccaatgatttcccctcgaagacaacaggaggagccacagcagaaaatacacagaaaagaatatggaactgcaaagacaggaaattcaagaattatgttcccacacattcaaaatcaccgaatatcttactaacatataacaaggactcctcacttaccaggtaaaccaagaagaacaatccaaacttcaaggcactatcagtcctacaaaacaagtgtccaataaatgttacttactcatatacacaagaaaagcacggagaagttcgcagaaacaatacctcatagcattatacagaggtcgataccataaaacatatgcaccaggaaccccagagatgaagtagatgattgccagcaaccatatcttcacgcctgaaaatggacatagcattattaaaggattacagccttaaagaactggtcaatatgtacaagcaacgccagaagtgtcatgagtataccttcccccttgacccaagctgaagtaactgctatgacgttccagaagagacagcaagccaatcctactcgacaccaaaaaaagttgtcttaattttgcatataacagaatggaatgttgaaataattcataagacagccttttatttctaactagaaaaataaatggcagaacttgaatataattaagaaaatctcaaaagctcatccctattgttttagaattcttattaacttgacttgcaatgcagacagtcacaaaatctcactaacgaaattctaatgataaaacatgtgactaagatcgtaggagactggaaaatttgcctttccagttttacagttgaaggtgcagaatttctgaaagaagggtgaaaatgcaaactttgtagaagactaaaatgcttgtccattatgcagttaaaacgttaccgaagtgcaagagcatcaagattttgggaatctgacaatcagaagcataccaagaaatgatgcaaatgcaacatattgcattctttgaaggtgactcggtatctcattggtgatatcatgatggatgagtggcagaaatggaggccagtttttctcctcaatgacaataccagctgcaaaagtgttataccaataaagtggcataagtttaatagcccgtgagaaatgtttaatgcataagttatattagtctgaacaccttgttattctaaaatgaactacaaggatctacagctctatcatgaaagctacacggtatac

SEQ ID NO: 32888 - DNA, 3106 bp, Oryza sativa
aatgtaacaatcacaaactaacaaaccatcatggatcaaactaattatgtctaagtaaagcatagaattccttgtgcaggtagtaagctgatttttagagaggaaaagaacactgcattacgaatttatgattctgaatacttcaggctaaggactgatgtctgctgtgtttcgcacaaaaaattaagaccaagaagcatcagattacaacaaactcttttgttgacctatcgtaatggacacaactaatgggtgatacaactgcatatgttcatggtgtaccttctccctcttgttcaattccgcttccctagcttgcagctccttttccctattcttcaggtcctgagtatccatacatcacacattagtaaaaagcgacattaggtactattccatgaaagatcctctactgtactgcagtctagctgcagttcaactgagacggataaactacacattcatacaaaccttggaagagtcaagagggatatccaccgtagccccaaaagctgcgggctcagggggaagaggcgaaagccgcgaattcgacgacacagaaggcacattccgtggattctgcattgcagtacagattaaacagttggtaggtaacaaaccaataattgcgaattcaagtattcaacccccaccgaggcaccgacaaaatggtccaactgagaagaacagaacaccgaacagcttaccggcatgtagaacgcgccgccgccatagctgggctgccctccagccttaccacgcgcttgttcctacagagaaacaaacgaaaacaaattcatccgtgcccgcacaaacgagggtttaggcaccaatgcaatcatcgcaacaccccccaaataaaaaaaaatccccctaaatttagcgtcggtgatactacaatgcgagaaaaaaaaaacaataaaaacggccaccgattcacccacggcacacggttagatctgcggccgccaaccagatccaaccacgaacgaagaacacacacgccactcctcagaacgcgcacggaggagaagggcaaggaaacacgaaaccagatccgctgcgcccggcgggaacgtggagaaagggagggagggagaggatgggttcctcaccgagaaagggttcacgtcgtcctcctcgaaggggttgctgtcgtagcgccccgccatctcggccccgtcttccccttccctcgggggtcggcttgggcttgggctctcgctcgcgccgacaatgatggcggtggagaggagtagtggggtggggttttctcgggggagagggagacgacgagacgaggagtcctgccaaatacagcggccgcgcacgcacgcacgcaccgccgcccccaccgaggcagatacggacgagtgaccgcgacgactctcggtgaagaaggggagggggaggcgggtggacgcgcacacacgcggaacggaatggcctctgcacttctgcagcttgtaaccgctcgcggggccaaccctctctgtgttttttattattttcttgctcccaatcttattggtcccacggtttatggaaatattgggtccactcacattatgtgggcagttttgaaactggcgcctcgtcgccatggaacagccaaaagagcccaaaccgtgtgaattatcacaggctcgcagtgccctacacttttgtctcttttttttaaaaaaaaaaacacgttacaaatgtagacgcttacaacacatacgtacttaggccctgtttaatttccagaaagttttttctaaaaacatcacatcgaatctttgaacacatacatgaagcattaaatatagataaatataaaacctaattgcacagttaggggggaaattgcgagacgaatcttttgtgcctaattagtccatgattagctataagtgctacagtaacccacatgtgctaatgacggattaattaggctcaaaagattcgtctcgcggtttccatgtgagttataaaattagttttttttcattcgtgtccgaaaaccccttccgacatccgatcaaacgtccgatgtaacacccaaaaattttcatttcgcgaactaaacggggccttaccatatccttaagaacatctccgaaatattaggttaacatatcttaagattaacgaagtcaccatgggtctatgtctactactgaaagaataattatttgtaaacacgtctactagtaaaagaataattaaccatacatacaagtacacaagtctggatttaaactcgaatagtctggttccaccatagggatcctaaccaattgggctacgatcacttcacactttttggctcatgtttgctctcgtctcaaacgttcttatctcaaattagggtaaaacatagttctactaaatttcggtctaaaaatctacagctctccccaaacggtctcagatcttgtaaggactaaacgtttttttatttacgatctcagtaaaaagagggctaatccatactccttccgtactcataaaggaagtcgttttggacagcgacacggtctccaaaacacaactttgacttcttttttctataaaaatatttattgaaaagtgatatatgtatacttttatgaaagtatttttcaagacaaatctattcatataatttttacattttcaaactcaacaacttgagagttattcatgatttatattatcaatatttgacttaaacattgtcctaaacgagtatggagggagtacataagttacatcaagaaatactcttttcacaatttccagctaacccaactacccaagttcgttcatccagcaaccaagacaccaagtgcttggcatgaggcagaaaactatcgtcctagaccaccgtttcgtgagtcatgtgagttcatgactcgtgggaaatggattctgctttctcttcacatgcttgaaatgtgcttagcaaaacagagttcgcttactggtgaaggtcgccatctccaccgcactccaccaatttcgctttcaaacgcttctattggccgtcatacgcttgagctttcccagattactcattattactatctttgtttatttgtcatcgtgttactaccagtaccagttagaatcaagctagcaa

SEQ ID NO: 32889 - DNA, 327 bp, Oryza sativa
aaatggtcattccatctggttttcatcttttgtacacttacataatgtgaaatctggtttcctttttcctgttccagatccctgcagtccatgatcaaaagcctcagcaatagcaagcatgatgatggcaactctgaatgtcacactagtcatactgagtcatgttcaaataatgaaaatacagctgataacaattcatcaagcaaagcattgtccaaagatagatcatctgctgctagttttacagaggaagcaagcaacagtcagaaatctgaaaaggtgcaacactgcgatactgattcaattcaagtgaacaatacttcagca

SEQ ID NO: 32890 - DNA, 759 bp, Oryza sativa
attcctgcagccctatattatgtgatttatttgtcaaccaggatgctggagaaagtctgcaaggattcacaaatgcttgcagacatgtttgtaaattatgattgtgaccttgaggggccaaacctttttgaacgcatggtgagcacaatgaattttatttttacactagaaaactagtatctcttctaactatctccacatgatatatctgattgaacatgtatcactatcaggtcagtgcactctcaaggattgcacaaggatctcaaaatgcggatacaaacactgccgcatcttctcaaacagtttctgtgaaaggctcatctcttcaggttactgttatccaaattgctaagatatttttgtccttagtgtatataatgttaatcactcgtaaaacccaaattgcagtgtttggtgagtattttgaagtcattggttgattgggagcaagctcgaagagattccttgaaacaggggagtgttgccgaagcttgtgaaaatgattcttctgcaaggagcataacaagtgatgaaataaagagccaagaggatggtcgcaatcagtttgagatagctaaagctcataagtcaacaatggaggctgcaatctcagaggtagggaggttgctgttttaattgttttgttttgttttatttattttgcaatcaagaatctttatctcatgatgtttaccaaatacatgcatgttcttgtagcagttaacctagtttgctgttactgcattgctgattgta

SEQ ID NO: 32891 - DNA, 682 bp, Oryza sativa
aagttatatgaatgcaatatcttatgtttctttcttaaccttttgcaggtttacatttttgcatgctcctaaggaaatgcgtagtaaaaatgttgaggctttacggaccctccttggcttagctgacacagatatggatgctttgcaagatacttggaatgctgttttagaatgtgtctccaggcttgaatatatcacttcaaatccttcaattgctgcaactgttatgcagggatcaaatcaaatatcgagagaatctgttgtccagtcactgaaagagttgtctgggaagcctgctgaacaagtctttgtaaacagtgtaaaactaccaagtgattccattgttgaattcttcactgctctttgtggtgtttctgcagaagaactgaaacagacacctgctcgtgtctttagcttacaaaagcttgtcgagataagctactataatatggctcggatacgtttggtatgtcctgtctcttattgtttgtttggtattcctgttacattggagttcgattcaccacatctttgcagaagtgcaaaactagttggtcaaatgtgtttccatgttcttaaagaaaacctagagtagtatacctgtacttctggagccattttgatttgtgtaactgaacaccagcctgtcatctgtttgaagtgcaagtgcaatgcacatcaa

SEQ ID NO: 32892 - DNA, 1163 bp, Oryza sativa
acaatttctaaaatctaagccagttcactgctagacagcaaaacaccattttaccaccaaacttgtcctaattggaaaactatatcagagagtaggaaaaaaatcacctgctgtaattctaattgtagatcctagaaatcataggccaacttaaagaaggcaaataatataaggtataaatcgtgtctatttagcttttatgtgccatgagacacaaattatgcatcttgtgtaatcagtttcagagttcatccagttcccgcatgaaaaatacaataggccaagacaggagactcaacacaggttaaagttcaaggttagcaatttactaatttatcgtcacatacttactgcaagacgttataagactgaattcatgtggacaagctagtacaacatagaaagaatgatgcaacacttactcgcatgcagagtagcgtgcttgtatctctgaaaatttagcttcacattcctgcgaacaagaatgggtaagctcataattagtatggaactctaatatcaagtaagcaaatgtctaccataacttccagcaggcatcagacatgcaggcggataaaatgcattgctcctttttggaaactagaaacaatttgatctgtaaaactgattgtactaagctccaaaatgtttcagacaatgggctcaatgctctcacatacccaaactattgtaagaaaggcatgagctaacaacagcattccatcaaattagtttgacgcaagtgtaagacgaatcacccttggcattgcacaaactgtcaaactttggtatcgaagcaagaacaaggtatgcaatgggtgctttactgtaaggccaatggctgtaaggttacattttcattccattccctcgttgcgagtcaaaattacagcatgtgttccttaacatttgcttcattttgtttggaatgtaaagctcattcccgtccaagcaacacgaccacatattctcagcatcgctaaaatcacaacctaagaccatttgatggaaatgtaccaaatcatccaacgatgataatacttaaattaagcacccctaaatggctaaatccatgccctaatgcatagtatcctacaactaccgacaatacagccattgggcacgactcatgagcactaccaccaggttagggttggagacgg

SEQ ID NO: 32893 - DNA, 1742 bp, Oryza sativa
agcgcctacatggaagcctttgttgcatcactcaccatgcgagttaaatcttggacaacttcagacattgagggcctaaactctggctcatgctgcataagaggaatcaggtcagccacaccgatccatcttggtgttgatggtaatatcaaatatcttacctgaatacaactgctgataatgtcaacaaaacgcgacaacgccttttcagaacattggcctcgaatagagggatctaccatctttgatatagcatcgatatcgtaaagctgggaagtggcccaccgcaccaggtgttgctcagcacgtggacgtgaactgcagttccgtttccatgagaaaaattagaaaccatcttcaagcaaaacaaggatacttagctaagtggaagtgggtctgggatattgtccttttggaatgttacctgtcataaggtttacgccctgtaagaagttccaacatgacaactccaaagctgtaaacatcacttcgatcacttaataatccagattcatgcacttcgggggcttcataatggaacaaggtgcgcatacggccagacaactgacataaaaaagagtacactatttatcaataaagaaatagtaacattcactcaaaaagtcaaaaataaactagcaaccttattctgttgcgatccaaattccaaagtatataactactgctaaacatgacagtatgtgtttcggaaacactagcaattcctaagcagattaaaagaagaacagcttcacaagttagcaatgtcaattgacacggggggcgtctatactggaatacaaggatggcaattaaaaaatgagattgagaatagatctagaaagaaatattatctgaagcctaaatttgttagctgctgtcagctaagcatccctgcgaaatataacaagatcacttttctataacaaactctttcatctctcctcgcaaacaaacaaacaaaagactctgtcatctcaattgatgcaatgtgatgaaaatgcatagcaatcagcaatacccattcctaaatacaattctttcatttacactagccttcattataattacaaatgcacagctatgctataaatacttaaatagcagtgcatgagggcatccgaaatactgaacatccagagcatcaccaaagagtctgatgccaaaatattttcattaacattattgtacctgggatactgatcttgatgacagtgctgcaagaccacattcagaaatatgcacaactaaagtgctgttgagaagaacaatagacggttcaaaattttggtgtacaattggaggttgacaaccatcatgaagatatctacaaaaaaaaaaatacacatagcattttcacaaatcaatagaatcacttcacaaaattgggaagaaaaaaatagaaaagttataatttgcttactgtaatgcttttgctgcccccacagcgacttggaggcgagcattccatgataatcccttgtttgagtcatcaacataatgaagttcatcatgtagagtcatcttgctacagtgctcatatacaagtaatctctgatcaaactcagcacaatatccaacaagcccgagtatgttaggatgcgtcagttcggagatgttcacaactagctctagaaaggcatccgctggtattcttgagttagcagcatcaatcttcaaaacttccagtagctgatgcaaagcaaatatcacagttcagaagtgacgatggtataatcaac

SEQ ID NO: 32894 - DNA, 4598 bp, Oryza sativa
ttaggatgagcggtgatggtcttgtaaaggacatgttttgaatggtatgtcttcatgcatccatatttcaccaaagtgctcaacctttcattctctttcttaagagcttgcatagcgtcaatattagtagcataagagttcaaatcaatatcgtaacacctagcacaaccattgctagtaaaagggttagaagaattagaaaccacatttggttgagaggtgctattccaaagagtgtcaaattgaacttcaagatctttatgacttttgtctaaattagcaaatttttcttgaagagtttcattgacatccctaaggctagctaaagaaccattagccaaattaagctcattagcaagttgtttatttttagcacattctttagctaagctctcctctaaggcaagatttcttttcttctcaagaataagcaattcttcttgcctttcgagtgattgttctttactatccaaagctctcattaacttagccaaatgttgcatagcgggtttgctaaagctcttaagcacatcatctaattaattatcactttcctcatcactagaatcaacatcaagagaagtttgagagggcttttgagtcatcaccttgcggccttgggccatgaagcaagagtagtggtaggagtcgtcgtcatcatcactcaagttgttgaagagacactccttgcttgaagaggatgacttgaaggcgacggtagcaacaccaccttctccttcaaccttgtcttttgacttgggcttgggcttgacctcgggatcttcttcatctccggagtgccacacttccgccatgtgtgcctccgccacatgagcacgctccggcttcttcttgcctcccttagccttagcttcatttgacttgggacaatcggcaatgaagtggccatattcgccacaattgaagcacgctctctttgattgcctctttcccttgtcatcatccttcctccctttgtcatagccactcttgcgaagaaagtgcttgaatctcttgacaataaaagccatttcttcatcttcactttcttcacaacttgactcttcttcttgttttgccttcaaagcaacttcttgattttttatcatggcggcattattcaccatttgtctcacttcacgagcttcctcttcttgcatctcatgagacacaattcttccaagaatgtcacttggggtgagtctcttgaagtgtttcctttcccgtatcattgataaaaaagagtgggatttcttggaccaaatgcacgcagaagtctcttgaccacaaagtgatttgtcatgtcctcactcccaagtcctttaatcttgttgacaagaatcatcatcctatcatacatttcttgtggtgtctccttgacatccatcacaaatcttccaagccttccttccaataattcaatcttggcctcacgaacggcgggtgatccctcatgagccaattgcaaagtatcccatatctccttagcctcctctagtccatcaaccttgttgaactcctccggactcaaggcggagagaattgcattagaagcttgagcattgcggtggatgaattgttcttgccccgaagtgagctccatgtcatcatggggtatatcaatacctgtacaaacaactttccaaatacttggatgcaaagagattagatgcaacttcaccttgtgcttccaagcgtcataatatgtcccatcaaattgaggagtatgcccggaaggcatggagacgaagtagtgagagggaatagtaagtttgctgtaatcaaaaggtatagtagctcccttgggtggtggagttcccttgctgcttgcttcatcttcatttccattttccccattctttccccctaagtccaacatcgtggatcactcaaagcggtgaagcttgaatcaagagcacctcgctctgataccaattgaacgtgcagagatgtagcctagagggggggatgaataggctttcctgaaattttctcaacaaacgcagcggttaaattgacagggtccggaacctcctggtgatgaacatcggaacttcctggcagtgatgagtagcctggaacttccgaagttcttgagccaggaacttccgggcaatagagaaaaatgaaatatgagaagtataacaggtcctagctagtgaaaatcaggcacagggttgcacaagatgaaaatcacaagataccagcagattcaaacactgatcaagcacaagagagacaaaggcgattttttttccgaagttcggatcacacggatcctactctccgttgaggtgctccaaagagccgggtctcgattaaccccttgcctcacttatgcaaagatcccagaagaggtccacagccttcaactcaacacttctaggtcgttttctagaattgagtgaccaccaagatccaactcataattccttctagaaaagaccacaagtgcaagttgctctacctaggacaacctctgaaaactcagcacaagaaacttcactcacttacctcgtttccttgcggaggtgaggaaaaccttcacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgacgtcatctagccgttactcacaagtttgaactagaaacctgccaggaggttccgggcaaaagtgccaggaacttccgggcagcacttaggaaattttttgcaaataaacggtgcccaaaagttccggccagaacctccgggtagccctctctgtcccggggagaaaatcatttttcaaaaatgattccaaaaaatcttttgactcatagatatgactaagagcactttgtataccctagaaccacacttgaaacccctcttaatagtacggtttttcctaaactcaatttcgaaagtgaaaaacctagtctaatcaccttcgatgatttttgcacttaggaacatttgaattgggggggtctccttgcattcttagccatcacaactcgctttgggactaaactcctgtgaataaacttgataaacacgttagtcccctttaaccaccttgtcattaatcaccaaaaccccctagggggtttaagtgcatcttcagggccgatatgtatttttattgttttattcactgacaggtgggtcccgtttatgtttgttttatttgagtaccatgtaagcgccacgttgatgccacataggatgaagaccaagtcaactcgccacgtaagtgccaccgtagaacaaaatcgcctccaaaaccgctcgaggagttgatttgcaactgtttcgggagttaggggacgtgttatacatgattttgtggttgaggggtgtgattcaaccgggtcatgagttgagggaggcaaaatggacttattcctaaaaaatacaaggcctgagcccatgcggaattatctatgattgccacttcaagttgggacctactagtatgcaacagccagaaaaagagaaagaagataattagataaacatgacgttgacagatggattcaaatagttttttctttgctgattcagcactgatattgctgatgtgacaccgtgttatgttagcatacgacttgcagagtttgcaatactccaaaaaccagtttagcatcaataggattattagttgcaaggatttaatctggcttttacggccgaaatagacatttgaggtttagttcgggaaactgagctcgcacagtatcatcctccaaataatacagcaaggtacagcgaacggcttggtgcagtgatgctgtcagtcttgcgtgtgctgcgccgtgcgagcatgggctgcctgaggttgcaaacgcgagccaggcagccagcacagcaccatcagccgcgtcactccagctacagaaaaatatcgtactccgtcagaatcttggcccgctgcgttattatttataatctgctaattaagaaacaagtggtactaaccattcaaaccccatcatccattgttgcccccctaatgatcccatccacgcccatcatccaagcgtgcaagccagaaacggtaggcagcagttgggccaatgcattaaacaaaggagccatccgctgtggacgtgatcatgccgtggatcatcctagcaccagcaagcaaacgccttttttttctagattctccttggaatgaaggccggaatccgagccgtccatccctcgatccaacggcgcaaaatcgatggctaccaacaaacagctcacgttagctgcctcccctgggaacccccctgggaatgggatcgatccggcgacccggaaaaggcgccgattctgacgccgaaaggcgggcggccctgcagctga

SEQ ID NO: 32895 - DNA, 4570 bp, Oryza sativa
tccaatccagatatatatacttgcctttctgaaaaggcacgggccgtgaccaatgcggttgtgtggatgtttctttacctcctggggccgggcagattgatcgatcgatgttctctcacgtccggaccacaggttttgcgatggaaaatggtcactctctcggtgctttacttcgctacttcaagggtttttaattggtagtgatggtggttggtttacgtatgtttcatgtgatggtcttgtacagttgtgcataccttcaacactatctttatatactttgagcacacatcaacgctcactccttatagcaatatgtataatatgtatgtactttctaacggaccatactgatataattaagaattgagtggatgaattgaagataaagtattgattcctatcacgattacttacagcggacgccggacgaactcctacacatggcgaaaaggggatataaagaggatgactacgcttttaagtacatagtgcctgttttgatcccctgataaaattttacattctgtcacatcgaatgtttggacacatgtatggagtattaaatataaaaaaaataactaattacacagtttgtgtgtaaattgcgagacgaatcttttaagcctaattgcgctatgatttgacaatgcagtgctacattaaactaccttgtgggaacattttcgcactgcatggtaagaagtcgcgaacagtgggaaagcaacaggatggaagggattgagagccctcggacacccctacaagtcgagaacgacaaatatgaagaaggaaactttaaatttttaatataaaaggtgatctgttggagctgatttttaaccatttatccaaaaatcttgtacatgtattatcttattgggaaaaaaaggtaatacagtttagcataagaagaagaaattaggaatgattatagtgttgccaggtagggcaatggataataacaagagggagaaaagtatagaagcttactccctccggttttattttaattgacgttttggacaatgacacggtctacaaaatatacctttgacattatttttctattataatatacacaagaaataaatgcatgtttatttttattatagtgttttgaaagacaaatctatatatgttgttctagtttctttaaactaaatatttttgaagttattgatggtcatagttattgaagtttgactttaactttatccaaaacgttaattattatagaaccggagggagtaggttttactccctctgtcccatagtataagggattttggaggatgtgatatttctgtccggatttatagttctatggaatatcacatccctttaaaatctcttatattataaaacggagagagtaggagggatcaaaattgcagcagaccagcactattacatagagtctctctaacaacagtacaattaagtccgctacaaactaatgaacgatagttactgtgaagctccttttgaactgtcatatgttactgtagcaatatagtccgaataattagagtcgagagcttttgccacctctcgcatccgactgttctccgttgcattttcatgtagaagatctcattccggtttaggaagaaaaaaaagccatagttggaaaaaagtgcattttagatccgggtcatagatttgttctttcttttttatagaatagtaagggcatgtttggattgatgccctacaaaaattttggtagtgctaaatcttggacaagttttggtactactaaaatttttggtagggtagagttgaaaatgtttatttggattgaagtcaaaatttacccataagagataagtttataggcaaagccaaatttatagcataggtagagttttagcagaggtgtttggtttgcaatcctaccaaaattttgataggacaaattttggtagggtagcaatttaaattggccctaactctcggcgacagctacaaagaggccatatacaaattttcgagatacgcaatacggcgattttccattgcaagggggcgcaactctagcataatccggacgaacacttgcctccacacagagcgaaccaaatgcacgggttaagtagtaccagtacgacgtgtccatcccgttcaacacttgccccccgctctgaccgccgctgccgccaaggcgacccggtcggcggtctcccctgctcgccgcttgtttattcctcgcagtccgcgctccctcctcccggtaaacaaacgactcctgcagcctgcaggctactcctaccgctacatcaaccgaggaaaaacgtctgtcgcatgtggtgtgtgtgcattaataaaaaaaaatactatttataatattcgtaagtaaattgtactccctccgtctcaaaataagtacagttttacactattcatgttcaacgtttgaccgtccatcttatttgaaaattttttatgattagtatttttattgctattagataataaaacatgaatagtactttatgtgtgactaaatgtttttaattttttcacaaattttttaaataagacggacggtcaaacgttgaacgtgaatagtgcaaaactgcacttattataggacggaggtagtaacataaatttattaaacctaattaattttttattagcacatgtttactatagcatcatattgtcaaatcatggagcaattatgattaaaatatttctcgtaaattagtcgcaatctatgtaattggagtagttacttccttcatcccacaatacttgtctttctagcattcaaaagttgtcccaaaatattatcacttgaaagtagtacttgccacattaaccacttctaattcaaatttcttctcattatactcccaaccaccatcttacatccaactatactccctccgtcttttaaaaaaaagtaaactctggctatgcttttttttacggagggagcacattagttactaaaggatattatagtctttttctcttaatcttagtatatgctaaacaacctagaattatatgtattttgctacggagggggtatattttttaacttatgggtgtatttagttcacgccaaaattgtaagtttgattgaaatttgaacgatgtgacgggaaagttggaaggtgtgtgtaggaaagttttgatgtgatggaaaagttggaagtttaaaaaaaaagtttggaactaaactcagcctatatttaatactccctctgtcccataatataagggactttgagttttttttcattgtttgaccactcgtcttattcaaaaatttgtgcaaatataaaaaacgaaaagttgtgcttaagtgctttggataataaagtaagtcaaaaaaaataattctaaatttttttgaataagacgagtggtcaaacagcaccagcaaaaacttaaaatcccttgtattatgaaacggagggagtactttggtatatgtgttcagacgttcgatgtgacgggatgtaaaattttaacgtggatctaaacagacgatcaaacaacatcgacgaggagtaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgatttagcttttatttatgtaattagttttgtaagtagtctatatttaatactctaaattagtgtttaaagacagggagacagggactagtccctgatgtaaacaccacctgaaacaacgaccgctacgctaggtccatggtcgtggcaacggcagcgcgtcgggagacgagctgagcaagcgagacacgagaccatcggcggccacgctcttacacgccatcaaccgcgagacacgactcacacgagactccccacccatcctcctccgtgcgcgctggaggaggtggaggtggaggtggtggtgtccgctgccccccgcaataaataagcctacctccatgttcccacccccctctctctctcttctccgtctcgcctcgtcacctcacctcggcatcacccaggtgggagggggtccgccttgacttttcgtgttcgggtttgggtttgagtgccgcatctgcaagcttgtgcgaggggggaatctctcttccttgctgtggtggcggcgggcgggagggcggcgttgatttcgttggggtttgcgttgcgtgcggaggacggggttgtgtttgtgtgtgtgtttgtgctgatttgggcattggtgttggtggtggaggaggatggggaactgcgtggcgaggagcgggacggcggtggatgcgggtggtgatggaggggaggatgggaagaggcggaggaggaggtggaaggcgccgcgggaagatcagctcgggatggtgcccggccggatcttctccaacgacggccgcagccggacggcgacggtgtacacgcagcaagggcgca

SEQ ID NO: 32896 - DNA, 30334 bp, Oryza sativa
tgctgtgcggggtgttcgacgggcacgggccgcacgggcacgtggtggcgcggagggtccgcgactcgctgccgctgaggctcatgtccgcggcgcgcgacagcggggcggacatgccggccgccgcatggaggaaggccttcgcgcgcgcctacaaggccatggacaaggacctccggtcgcacccttccctcgattgcttctgcagcggaagcactgccgtcaccgtcctcaagctcgtacgtgccgtggacaccggacatgacacgcatctcctgtccatcacccccccgtcctctcaaaaatgtcaaatcgaatctgcctactatgcgtctacgcacggcggctcacggggcgatttctgcatgcagggctcggatctctacatggccaacattggggactcgcgcgccgtgctcggctccagggaggccaccggcggcggcatggtcgccgtgcagctcaccgttgatctcaagccggatgtccccagtatgccactcccctgcttccactcacccgctaatcgtgttaggaggtcgtgctcttgcgcttatggtgctggttgtgatttcaggcgaagcggagaggatcaagaagtgcaggggcagggtgttcgcgctgcaggacgagccggaggtgccaagggtctggctgccgttcgacgacgcgccgggcctcgcgatggcgcgagcgttcggggacttctgcctgaaagattacggggtcatctcggtgccggaattcttccactggtctctcacagaaaaggaccagttcgtcattcttgcatcggatggggtaatttgctcgaacctatcacttgaacagataattcattgttctctgtttggttgttggatatttgcccgtgcagcgaatgagtatctctgtccctgcaaaatcctactttctttccgctggaattagattagttgcgatgtagtgtcaatctgtcacactttcgcattccacatgttgttagttgcacatggcgggcctagcgtatccatgacatctcgtgcatttctttagaagctaaaagagacgtgattaacatatccacgaatggtttaggcttttgacttcaaaccgctgtatctttcaggatttatttctaaaactatcatgattgcaggtgaaataatttaagtatcctccatttgtgccttttgtgactgcggcataaataatgattagccagcttaacagtcttctttgctgcatgcctgcatcgtcacccactttttgttatcagctgtactcaaactgttaaatcttatccttattcaacttgactcggttgattgatttaattgttgttgatgagatcatgtgcacctttcaactgtagcagttagaagtgagcacattaagctaatggcatatggagtagccaataaaattaggaagtcctaatggtcaataacttgttttcctgtcaatagtctacccatctgaataatgtgggtattctaccagacaaacccaaactactttgggggaaattacacgatagatcccagttcacttcaattccacgaaaatgtcataatacctagaatataccacactgttgactttcacttaactccatcatcttcacctctcctcttgttcatccacatgttgtcatctttcttcatcgatgcatcatgtgcctgctgactggtccacaccgcctcaccctgcggataaaacgtgacccaaccagtaatgctcctttccttatcgtgatcgcatactagtacctcgtgtcaccaatcatgactgcgctagggcattgacaggccacaccgctgtgaccatgactgttcacaatattgccaacacctttgtctagtgtctacgtgcagccacctgcatccacaacaatcttttgctacagttcaagaaaaaagtgcactgaaaatgcagcgtgttggaagatggggttttttttgggggggggggggggggggtggggcgcagagcagcaacataaaaggggagcatgggcgatgcagggctggcagtgctcattttgtttagtggttgtggtagcgtcattgctaagaacagatgagatgataacatagggtgctggtcagcaacaatagtaatggagggtggacacaattagctgctatccattaaattcagcaccaatagtaatggagtatcttttttttctggtattaaaatgaactgggttttttttttgtgatatataccaaaactgaatcattcagtggtatagtaggacatcctacttttgcttaaatgtttcaccaattaatttctgccactttgtaatggagtggctttaagcttgtcatttgtcaatcacttgaagtggatggttttcctttcttttttgagcattaggtgggaatcacgtatgttcaatttttttactattagggggattgaatttggtgacactcaataggtagtaccaaattaaggcctatatgtattgactttataaactagcggtgtcatgcatgatcatatagcatgaagactggttagtgtatcttaaaggtcactgctatagagtggcaatctgtcagtatgaaagagctgtgcagactattgcattgtggtttaatatagtttaggtagtccatatctaatcaaacagagccttattctgttacacatattactttacttcagctgcaacttcttggtcttttccctcctagtctcctgggctgacaacttctattgacaagtgaatgtgtgcactgtgcaaatcaactttccttttcatttttatgtcaattttaatactgttgttatgtgtgttatgtacttgtcaaggttatattctgagaaaacttataattagtaaccatctatcaaaagtttctatccttgaatgtactatctaatgtatactgccaaaaagtgatgtttgaactttttaacctattatgaaatggttgcaattggcgaggaaagatgtccattttacccatgtaataatggtatctagtatcacgcaaaatgattttataagaagaaaatagttaggtcgatgtcaatcactgtctaccaagttgatattgcagctgtgccagaggagagcaagcttctttagttcctttttgtattgaatgtagtttgaaaagtcgaaagactttagtttggaatctggaaaagaacagataagttacttggtctgcttattcatgccatagaagctctcaatttgtcattgtcttttcatgtatgtcatatatcccttgtttgcatgtatagttcttactgaagttacacaagctatgcacatacttggctgcctttgtagagtttgcactaacaaaaatcttgcaggtatgggatgtcctcagcaatcaagaggctgttgatatagtgtccgcgtccccaagcagatcaaaggctgcaaaatcccttgttgaggcagccactcgtgaatggaaaaccaaatatccaacatccaaaatcgatgattgcgcggttgtttgcttatatttggatggaaaaatggaccatgagcgtgactcaactgcctcattggacaacatcagtattgaagagggttcagttgcagatcctaatgaacctcaggagcaggagcccaccttaactcggaatttcacagttaggacagttgcaggcagcacgcaagagaagaccttagcaggggtggatgcgaggattgctggtgtagcgaacgaccaaaattggtcaggtctcgatggagtgacacgggtaaactcacttgttcagcttcctaggttttctgaagagagggcaattggctgagctgcccatcttatatttacccccgttattttcacctattgttctgaattttagcgtagttgttctagagaaaggtagatgtgggacgatcttgtgatttggtgcggtacttggcaagcgtttcagccactatgcatagaagtcgagttgcacgttttagcccaacaaaactgcacattgcataggacagaggctctcttttcacccatcttgaggcatgtcaactccatacctcgaagatgaagcacaaaagagcaggccattgctccaaatctgcaattttgctgggttaaaactaacaaaagacgacgccaaacacagtggctaaacgcacgccaggccccagtcacccctgggatgatattgtcgggtgacctgtaaattctccaccggcgcttgctttgcttttgtagagaggtgatgtccagaccattttctccgctgcatgcttagcttttgttgacacagggcggtgcgctctgtcgatgtcggattgccaatctttgccccctttgttttgttcgcggtctgtgcccttgcttttactctcctggagccatcatgccaccgagaaaaatggcagtctcaatacttttaggccccctttgattccaagggaattcataaattttagatgattttatttctataggaatttttctacaaagccctttaaatgaaagaaatgaaccctatggaatcctatgaaattcctatggaatgtctcttcctatacaagtttttcctatacaagttttgggggaattttaacaagaggtagaacctcatggaaaaaattctttgagtctttatctcttcttaaattcctgtgttttttctgtggtccaatcaaacgatcattcctacgtttttcctatgttttgcaattctctgttttacacttacattcctatcagaatcatatgtttttcctattcctacgattcaaagaggcccttagccttaatggtggtgaactggtgactgatggtgcatccgtacaccaccgtacatggcacacgctgcatcttgtctgaaatggcatgtgaccggccgagcgttgctgcgctgtaggcgtgcgctggtgagcaaaatttgtccggcgacggtggccggccgacgcacgggcgggtgcaccgtgcaagagagatgcagggggagacaggcatccggcagaccggcaccgtaccactaccgacgggctgcacgggcacctatcacgtgaagtagatttgccgtccatcctgtggctgaccatttaacgaatcttacagcttttattgggctttcacacgcacattcacgcgcacagtctcacgcacgcgcgcgctgttcatacgtggctcgttgctgttgcctgtctcggtgcgccagccatgggtggacgcgaagtgaccgctcggtgactgggcggtagcgtgaggcaaaacccaaaaaagatgaggtgatcgaaggaataagatttttcaccacaaccgtagtttcagcggtcgagcggccgcgcacgcaacaaggtaccttcggtccttcaccgatcactggccgctgagcactatttgcatgacgcggttgtggtttgagatcagaggtgcaattgtaataaggagttgcggttcgactgaggtcctgtttagtttcaaagtttttttttccaaacttccaactttccattgcatcaaacatttcatacacacacaacttttctatcacatcgtactaatttcaaccaaacttccaaacttcagtgtgaactaaacacagcctgattgatacaaaacgaacggctcagatagctagaaaacactattcacgaattacatgtgaagaatctatactgtagtgattattgtagagtgttagaggtacaagagggtagcagagcaaatctgagactctattgtagcgattactgtagagtgtcaaaggtgtaacatggtaccagagcaaatctgagcccttggctttatcgatccaacggtcaaaacgtgttgtgactgctaaagtagtagtagtagtaacgactgcatcggatctcaattccgcggttataggggatcgtgaacgtttgtggtctgcgaaagcaaaatgaaagctcacccctcccccagcaagtgacacggcgaggagagaagacgtggacgagcagccgtcgttcgatgacgaacttccttcagctagccccttcctctgactgagaagagaagatgtagtcgagccccttctttctccggttagcttcccttaacaagatcgatccgggaaccaggccagctcttttctccaccccccccccaacacacacaccacaccctgccccgaaaccctaacaaaagaattcaggcgcacattcaaaaaataggattttcagttggcggaaccagccattgaagcccacgaaatcctagcaagtggcagcaaaaacgtgcctgccaccaccatcgccagggagtggcatcatgttcgagctccgctagtccatcttcagtcttcccttgaggacaagactacagcggcggtgcaacaacagtagcagttggaggtaagcatcacaaggtgttcctcactgtgtttatgcaagaaacctaatcgaattcatacgttgtgcaggggcatgctaatcttctctgtatcgttccaattgtatcggctgttataaaaaaaaaagaattcatacgttgcttgctgcacggtcaaatcaaatgcatgctttgcttgctgcttattgtaattgtgctatgctactacctggtcttggtgcatccatattacccaagtttcacaagcagcaagcatatgctgaatagttgcgattgttgtacccaatactagcaggaagatggaccgacggagtttgagaactgcgcccaaggtggcagcgaggaagcaacgtttctcggcggcgcatcctagcggacgagctccgggtcattccccgccgccgacgatggcggcggggtgaacgcatgtcatcaaactctggagatgtgtttgctatcactagtgagcttgagctttcatgggttggttctattagccagtactctcttcatctcaaaatataaggaattttaaacgaatggaaatgtaacacttcctagtactataaatttggatatggagcctgtttagactcgtagtactagaaaatatcccatccattcaaaatcacttatattttaggatggaggtagtattattaagggcacacgtcatgtgagagatgttatatggtttggacagtggatgagtactgattgcacgctcgtttcagtcacccccatgaaggcagacaatcctggttccaacgggagacatataagagatgagggaggctcgagagtgtgggagcatctcactggagttataggaggacgattgacttcaaacataaaacaatttggcagttggagaagtggtagggaggagatggctagtagggttcaccaggaacagtggtgacgctatggatgcaggggtgacagaatgaagagggtgggatagcggcgatgcacaactagtgagaacaatactactactaggactctaggagacaaggaggacgagtgtgattgagggataaggtgtcttgcacaaatcttaaagagatttcatccattgaaaatcggttgattttccccatgaaacaattcaatgataggtagacggtctctataatttaggcttttcacaaacaaacttgtagctcagtgctatgtcgaagttaatcattttccgcatcaactcgaaatttggcactgtggaagcgatactacactagacattgaaatggcaagaagttggtgccaatctctttggtgcacacctccaaacaaagtcacatttcccctctatccctcttcatatatgggcttgttcattttgctacaactttcaactctaccaattttatttggcaataaactggacaagtcgcatctttatttggcacaccttcattgaaaaattgacaaaccaggatatgatgttagattttccaagtttttttcaatcttataattaatttatgatattgggatttaagtgtggtagagaggggacaaactctcttttctgctccatcccgctcttcaaacaatggtgtggtgagttggtattagactttcaagggaattgataaagcagggtacactgattcacttctcataatatatttttacttttataatgccaatttggttgacggtcagtttgccgcatttaatattaagcaagaccaatttatacaactatttggttgaagccacagttgtgataatattctcttccaacaaattaggtctgatgcatcaataacttagaaaaatgtgccaaaattcttttagacttattaaggtttggtaaagattttgagcatctaaccttagagaagtttgacaactactattgacaaacgatggcgacttgtaaggctctgactagcaactaaacaaacactaattcttgagattgagatgagggtgcgggaggtcaacgctaacgagggtggtgccaaccttcgacaacccaagagaatgggcagcaaccccattcatgacactagttgtaatggactctataccataagtaccacggagttatatggctgtgctgtaaattgtagctggacaacccataatcgttaacactaagatgtttatcctccatgtctagaactctatagttaaattctaggtttaattttcgaaaaatggctaggaagtaaaaggcccaaatttgtaagatttaacaaaaattaaccaatctcgaaagaaattagatgctcgtacaaaccaaagctgatcaagggagctccaaaatctgaggatattcgacgaaattcgagcggaaaggtgaactcgtacttgttcactgtccatgtaacattgcgtgaaggaagacagctggagtattattgtactaccatccaaccagcagccggaagaccgatcatttttaacggaccaattgcgagaatacgccacaagttagcgtggtcaaatctcaggaaaagcactgcaagtgcgagacagagcagagaacagttcagcattttcaggctgctagctagcaggtgcagtcttccaaatggagcaaaaaaaaaaaagagaaaaaaatgccagttgcgcccagctgtccggagcacgtctccacgtgagaatcgccgaacgacccgccaccgacactgacatgcgggcccaatcccccgtacgcactcgctgtcctgtcacccaaacctcttcttcccgaagcctctctgaccgcgttgcattcttgcggctcacgagtcacgaccacccaacccaacccacccacgaagacgtcaacacgaacgcgaacgcgcgcgcgacggcgcgagccgtatgtaaggttcgctgcggcttcttcttccgctcgcccgcgcgctcatggccgcactccgccacgcgacgcggcgcgcgtaggaggcaggcggctcgtgcgtataagaggcgacgagacgagacgacgacaagaagacgccggaagcagaggcaggtagcgtagcggcggcagtgaagcgagggacgactagcgacgatgagttctcgctcggcggcgcgaggaggggtgccgcggccgaggaggccgagcagcggcggcggcggcggcggcagtaacacgccgaggccgggcggtgggggtggcgtgttccccgggcgagcggaggggttcaactggtggggcgcgggcgggcgagcggcggcggcggcatcgacggcgccgttggcgaggcggcaggcgtgcggcagggcaggcagggcgtcggcgatggctcgggtgccgacggggaaccgggaggtggtgcggcgggcgctgtcgccgcccgccacgcgcagccgcggcgccggcgcgctgaggaggtggagcttccggccggcgccgagccggctccgcaacgcgtcgtcgtcgccgtcctcccctgcctcgccacggtcgccgtgatttttctcctctgccgccatggcggcggttctgaccggattttggcattcttccgttggtgacttggggtaggcaccggagattactgtcctttgtaattaggagtagtagtttgtaacgtttaatttttagatgatgatcctctgtaattagtagttccagattaattcttttgacatgatacacgtacactgggaaaatgaattttgagaattacacagtacaatgcatatactcacaacgcacgcgcactcacccctatgagcatttttgaagaggcgcctcgctgtcgacgggtacatcgcatgccactgaagaacccagtacctcagatgctactgaggctcttgtaaccattaggctacaggtcctttcacactgagaaaatgaattttgatcaggttaagttacacttgcgctgtgtgtagttccaaaataattcttcaaacttctaactttttcatcacatcaaaattttcctacacacaaacttctaactttttcgtcacattgttccaattttagagtgaactaaacacataaacaaagccttgatgaaaaatgcactgttgtataggcgagaaatttcagtatatgccattcaagcggccgaagcatctccccgtaagctcaagctccgccgttgccaccttcactgtggattcgccgttggagtataaaaagatcggtagatcaccgagaaacaccatagccgccggactcgatcgatggcgtcgctgactccaccactgtgctactcgattcataacacttttcagaacttgttgccgagggcacgaagtgttgcattccgtgccatccgatccatccagtacaaaaacggttttccaaacagccaataatcattttcccggacgaggggaaggcctgcctacacgcataagcctgtgaaaatgaggcgccatagctacccacctgcgaaaatattttgggcgaaaaaaaaaatcaccacaccccccctacccaatccagccacgccgccgccgcaatcctcgcaccttcggccagatctagggttaaggttttggggggagagggagagggagagggagaggaggtgaggggaggttgttgcaggggcgacgccgccacccttccctccccccttcagccagatctgggagggagggagggtaaccgtcgccaccgcctggagccgcgtcgacgctgccaggagggagggaggggagggaaggaaagccgccaccgccgccctgtcccctccggccagatttaggagagaagccgccgccacccccctcccccttccctccggccagagctgggaggaaggaggggagtcaccggccaacacgccctcccccatgcccccttcagccggatctgggaagggaggggaggggaggggatccgggctgagggtggtgcgacgccgcctccgcttagagccgttggcgccgtcgccatcgcctatcccctccctctggccgaatctgggaggagggacggaagccgccgtcgccgccctctctcctccccccttcggctggatctgggagggagggaaggggagccgccaccgccaccgccgctagccactgctgtcgccgaggagagagggaagaagaggtgggagggaaggggaggggagcaccggggagagaggcaaggagaggtgggaggggagggagagggacttaggatttttgactgcatgtgacagtttttatgatgcttaaggtattttcgtaggcagatctattaagagatcccaggtagacgacgaactcacccacggttgtcatttttttaggtggtcatttaactccgagaggcctactcgtctggaaaaacatgccatcgtctagaaaaatggttttcctggtagtgatcgggaagtcacgtcgtacgattattagcattgcctgtcgtagtcgttgtagccacggaggtcgggcacgatggcatggaatccctggcccttctcatcaccatcggttagcttctcctcgtgttgctactctactctcccactccaacacactttttgaatagaaaacagcactatagtgccttttcattgaatagagcagcagaaaatacaacccctagagacaaaatgaaacaagtagaaacactatagctatacattatacagagtgcgggattaactcacgcaaccgtttagcccctactaaagcgcaaaggctagcctcttttttaatttttgatagaaaaaaactcgttgtcacctctttgtggttaaagatccgccgattcctctcctttcagcacactgggaggaccttaattagtggcaagcggcacataaggaatagctcgtcgacggaggcccgatgcgtgtgccggtaagaccttggtggctaacggcgtgagcgaggagctcgccaatggtgcccggatgcgcgcgccgggatgaccttgctggctggctggcagcgtgtgccgaaaggaccttggcggttgacggcgtgcacgaggacgagctcgtcgtgcttggacctcagcggctggcgacgcttgacagtggccagatgcacgcgaggaggacatcgacagccgacggcatgtgcgaggaggagctcgccgacggcgatcagatccattactaaattttggtaagttgtggtaagttttgaaagtgccgttaattgagtggcattactaaattttttccgttatatgcatattatacctacttgtacacctgggctgtgtttagttcacacttggttgaaattgaaagtttggttgaaattggaacgatgtgacggaaaagttagaagtttacgtgagtagaaaagtttgatgtgatggaaaaggttggaagtttgaagaaaaaattgggatctatacacggtgcaatttcagtactacctccgtcaaaaaagagtatagttttgcattgtttatgtccaacgttcgactgttcatactatttttttaaaaaaatatgattagtattattattattattagatcataaaacatgaatagtactttatgtgtgactatttttttatattttctcataaattttgaaacaagacgtacgatcaaacgttgaacacggaaacccacaactacatttaaattgggacggaggtagtatcaaacatcaaaattgagttgaaaaggcaaccttctctctctcactggtcgtggcagggcgacctcagactatagatggccaaaaggcccgcccggcacggcccggcccaggcacggcccaccagccatcgggccggcacggcccgatcggcacttcgtgccgggccgtgccggcccatgggctgcgcctcccgcccagacacggcccaccagctgtcgggccatgccgggccggcccgaagacgcgggtggcccaccgtgccttttttaaataagtctagttttcgtccctcgtctttgggctgtgacataatatagcgaaaataagtctattttccatccctctactttgggctatgacatatatatatatagtgaaaataagtctatttttcgtccctcctctttgggctgacatatatataggtaaaataagtctattttacgtccctattctttcgaccgtggcatataatatgtctatttttactccctattgtttatgtgtcgggcttagcatgcggcccatcgtgccgtgccggcggagaggcccaggcacggcccggtggtcgggccgggccggcacgggcccgacccttgacgggccgggccgtgcttgggctgggccaaaacgccgtgccgtgggccgggccgtcgggcctcgagccttttggccatctatacctcagacgcccctccagatcccctccttggctagggctgtggtctttgctccatgttcccaacccctctccctcgtattccgcgcgcactctttttaaattgataaacggtgtgttttttgcaaaaattttctatacaaaaattgcttaaaaaaattaaattaatccattttttttaaaaaattgttaatacttaattagtcacgcgctaatgggctgctccgtttttcgtgcggggagatgggttccaaaccatgtgttaacagtgaaatttggtaatcggcaaagacgtcatcagcttagaatcattattggctgcagcatctcggaatcagccgatgggagttatcaagtcgccaatagtcggattcctgctatattcagttaaggaaatcaatctactaaaggaagcttatccctaagtgaccgagtttaaagaggatgcggcatggcagtttatctattaattaggaatagtttgttagtttccttttatctttaggaaagtgtgtttagtgtccaataaggactttatattttccttttatctttaggttagtttctttcttgtccgacaaggaattgtatcaacccatgggtataaatatgtacacccggggtctatgtaatctatcctcacgatcaatacaattcggcgcatcgccaccttttaccttttctatttaattttatcgttcggcgggacttggcacccgacgcggggctgcatcggtgttcgatctccggcgaaggggtaagtccaatgttctgccggcccgggcaattgtctcatctacatcggcgtcgttcaaggctgcatcaagacattcgacctcttggattactctggtttggatgatatatttgcctacctatttatcatatgtctctgttaatctagtcttagcatatcaatttagctctattggctgcttctcgttttagggtttctgccggtatcggctaaatcgtgttgctagattagattagcttagacatctaccaccctgaaaactcaatcaacgacttgattgtctagatattatgtttcttttcatacttagtgccgcatcagttaagtttgatctaataagtcatgcttagaaccataatctctagcctgcttcttgattgccaataagggtttcatcggggtttcaaccggtgagttatctggacgttgcatcggctcataaggattgcatatacatataagtttgatttagccgatgacaacaaaggtttcactgtttaatctaatctgtggatttattgacatcggtcttccagccgatgtgtgcttgaaccttcggatcaatgtttattctatcatattattgttagccgattgatttatactggattatattgctatattatattatcatcagccgattgccttcatatcattatctacattggacatatagccgattgcttacaccctatcgctatcggctggtatcagcatcggctattatcggctatcggctggaactactccatcggcttgttagccgatcggctgttttgatctactatttgcatatcttgtcagttgcaggatcaaactaactggcacgcccgcatctcatcaatctttggacctgcactggagctaagcagatctcccaggccggtgtgttcgatttttttcgtcaacaccatgacatgcgaacacaccctaggtttaagaaaaccggtcggttatcatgaaactgtcgatggtcgttttctggtattggatcaattttcgtgcaacgttggttgaaagtcattgattttacaggttatcgatcggttttcgataaaccggtgagaagcggttttaaattccaaaataaaaggttaaaccatttccacgctgtcgacgggggatacccgtagaccggatatagagggtattggggtacgctggtatgaggatctacataatacgacatcaagtaggcagaaaacaaagaatatactggttcaggccccttgataggtaatagccctaatccagttaatatgggattatatgatggaaaccacatgttacaaagggaatagcggaactcgatgagatcgtagtcgagttgattcgactagatcacccggcgacttggctcctgtaggctccggcttcgtaggctgtggtggatgtgttggcggtaagattcgatgccttaggtcctcccgggggggtcccttttataccgtaggtcaactggtctccaagtaggacccggagacatcggacccggtacgatacaatgacgacccagttctatccgagtaggactctttccgtctgtgaactccataatgaatttccttaacgtatgctgaaaacgtccgtatgcacgcaagtataccatatcgatatgtaacgtatatcgaagggtagagggtataccttacccgtaaccctgacagtagcccccgatttctgtttaaatgaactcgtgaaaccgatcgcgacttccgatgtcgaggttgtcgtcgttctcagtgtgaggactgacagacaaggagtgatcgacaacaccaggtgaagctcaacggtcatgagtgaatttaaattgatgtccgaaaaactgccgcgcataacggacccagaaattttcggcggccatctctctcctttccttggaattctcaacatcggaagtgcgtctatttaagagagttttggggatccaatttgaagtccgcctattgtgaaaaaactctccagcctccaagcgtccctcgtcttctccgctcccgcaaaaaccctagctagctcatctcggtcctttctctggcgatctccggcggcaatggatctcgacaagtctacctgcaccagcgcgtcgctgaagaagctgcaggaggatggcgcccttcctagtcacgggaccatggagagagaagcaggaggtactgaaccccaacctgtcctgggtcgcatggttgcgatcgaggattatattctctgtggctttcttcctccgccttctgaatttcttctcttggtcttgaatttctacggcctttccttgctctatttgagccccaattccatcgccttcctgagtatcttttcgcatctttgtgaggcctacattggggtagagccgtttcttgacctcttctgcttttactatgagttgtgctggatggaacccaaaaaggtgtccggatgtgtcggtttttgacttcgggatggcctgaagtcacgatacatccccttccagtgcccctcatcttgcaacaaatggtgggggaggtggttctatcttcatatatcatcttggaccgccagacccgccttgaccccatccttccaatctttcatcgatatcattgatgacctccgagtacgggggttgtcggggtatgaaatcgctgccgacttcattggtaggcggatccagccactccaggcttgagcccacccagcctttgattattctaggccggaggacgcgacccaggtttctcctcggggtatttttctttttagttaaattgactcccttatgtgcgtgttcttcccgacttattgaattctggtcttgatctataggcttggacagcgcaaccgtggagcgccgcgtcggccaactgatgatcagtggcccgacaacggcgagcaacgtccccgtccccctttgcgagaaaggggcagccgagcgcgaagctgccatcaatgtaagtgtactcagcggtccttttgcattattcttccgggatcgcattatgatttcatgaagcgtaagctctccctctgactgatatcatcgggccactcgtggaccatcaggtggcggcgtcgctgaaggagaaagtcgccaaggaggcgtctgacgctgctgccgctgctaccacaacgagtggcgacaacgttccgaaaaaggagaggaaattctcctctgtgatcggacatcgttggaagacgcccaccccctcggtaagctctcctggtccttcatcacgtagtcaagaaacttccacctcacctcatatacgttatactccaggcctcggatgcgtctcccccgcttccgcgacggtagcggcttgtgacgctcggcgagaagtaagtgaatgaatttgaggtttcgtgacttcgtcaaactcttgcagtctgtctcaattgcagcctttcgcagggcggcgcgggcgaaggcggcgcaggacgggtctggggggacctccagcgcgtctcctgttgtggcctcgacggatgtcgtggtcgtgcccaagagccgcgaggcgacacctagcggcccagccagcgatctcgtggctggtcgtggtccgccggctgtcgtcctcacctgggagcagctccaggttgagatggggtgccttctcaaggctggtactcgcggcattagccgcgagatcacggaggcgagggcggtggcggcgtcgtcggcgaatgagcgtgccgaccggctggcgcgcgatatggaggttcgcgaggacctccagaagatgagggaactggtggccggcaacgagcgacaacggtagggactagagcaccgcatgtcggagctcgagaacaacttgtcggaaatctgtggctcgttgcgggtcacctatattggtctgcaccagctcgccggggagtgcggtatcaagtctaccatcccggcgaatcccgatgaattctcgctgacgtcttttcttgcggagctggcgacggcgatggaggagatcccctccaagcacgcggccaggatcggagaggagacgtccaacgggatctataccggggcgtgccatgtccttgcgtgtgtgaggctggcgcaccctgaactcgatctgcggaagatcttggatcagggggtggctagcgacgcgcacaaggatgtgatggaagaagtcggcgatctgggggagtctgttttcccactttttgtagagtaggattttgactctcttgtactctttagtcatgctttgtaaaactttcattggttccaaccgcctttgtgtgtgtagtcatcgccttagctttctttagcattttgatcttgagtactttgttgtcattcgtagagatgttgatgtcgaggatgtccagcagcgcgggcagcctgagttgccagtggtcgttccgttgcttgcgttcgagccacatgttccggagggcgatgtagctcaaaattcgcatgtggaaacgggcatggcgacgactcccttaggttggttatctctgttttcatctcctttactcttccgtctggatcgatttgatttgttgtattctcgggagagaagagcagtttgacttagtcgtttccatgctgagcagacctcgagagtgcgcttgctgaccaggatcgtcgcatccagtattggaggacgaagtttgaggtcgcggaactcgagaggactatgctagaagtgaagaacgaccaagccgtggagacactccggggtcgcgaggtgtggttcaactcgtatctgaagagttgctgcacctccatgtcaagggtctgtagagagctccgagtaccccgtggggataccgaggaatcggcggctggatacatctcgtggctaaatggggactgcgcccagctcgagggcatcggccagcgtatcgacgaagccccgaagcaggagtgtcgtcgatcgagccgatatgctgggggggcatgtattggcttgtatacgagatcatcgtccgcaactgcacctcgagttcctccacgaagggttttctcgttctcggagaactcctacggagatagatggcctggcgaagtcgatggcgccgctggcggaaaaggtcttccagtctatggactggcgttggccttcctggtagtctccgtgtcctgtgacaaatgtcttaggggaaaagtgtaatataattttggatttttatagaattgtaagaagtacttgtgaaatagaaaagaaatctatctaactaagctttcttactctggatgtagcgtgtatgagtgtcttctcacttcgcgacttcgatcagtcgtttgagttatacactctccctagcccccagccttgtcatcggagaattcttctcgggagataaggctcttgtacctttgacctgcctcgattgaacaagcactaatcctagcccccagctgtgaagttggaaagtttatttttgattacacggcttggttaatacgcacggcgagaactcttacacgaccagatcttacatggtctttcgtctctacaggatccgacaaggccttatcggctctgggcatccccagccgaagttcccttaggttcctcggaggccttgtcaagacggcgtaaagggacatgaggataggtttcaacgctaggtgtcatctgggtaagggatcatcgggaaggaacactttgattgtagtctgtacctaaaaataggctttattgaagctgtaagatgtcttacaagcatggatactattaacttatacatagaatttacgtaattgatcaatgttccaggaatttgacaactcgcgaccatcgccgtctgcaattttgaatgcgcctggccgcagaacttgtgtgatcgtgtacggtccttcccatttgggtgagagcttgtttcgccctgcttgactttgaacccgtcggaggacgtagtcgccgatcgaaagtgtgcatgctcggatgcacttctcatggtaacggcgatgggcctgttggtagctggctgctcgaacggcaactcgttcgcgatgttcctctagtagattcacatcatcgtttcgttgctcctcctgatcctcatcggaatacttctgtactcgtgtactttaatgccgtagcttggtggggagcatggcctctgagccgtacacgaggaagaagggtgtctccttattggacgttgtcggtgtggtacgcacggcccatagtactgatggaagttcttcgacccacttcttgtcatgtgacatgaacctgtcgtagacgcgggtcttgattccttatagtactatgccgtttgccctctcgacttgtccattgctctgagggtgagaaaccgaggcgaagcagatcttgactcccagcctgatgcagtaatcctggaaatcagcactaatgaactgggagctgttgtccgttatgatacggtggggcaatccgaacctacagaatatccctttgatgaatttgatggcgttgtcggccttgatttccctcatgggtgtcgcttcaatccacttcgtgaatttgtcgatcgccacgaataggaacctgtagccgccctgtcctcgtgggaatggcccgagtatatctagcccccaacacgagaacggccaagtgagagggatagtctggagtgcttgcgctggtagccttgtgtgtttactgtggaattgacaggcttcacactgctgaaccatgtcataggcgtctttgagggcggttggccagaagaacccttgtcgaaaagcttttccgactaatgtccgaccggcggcatgtgacccacagatcccttcatgtatgttgaggaggaggtgtctgccgtttggtgccttcttgtatagatcgttgccgatcatacagtagacttttgctttacggaatattttctcggcttctgcgtcgtcctcgggcaactcttcactgcctatgaatttaatgagtggggtgcgccagtcgtctgtggtcccgatatcggcaacggcgcgctctgcctctgtagcccccgagctgatgttgagggcgaccgggctaccttcgccgcttgcctctttcactgatggcctggtcaggacgtccagaaaggtgccaggttcaagtggctctcgtctggatgcacgccgtgctagatcatccggttcgatgttgtctttgcggtatacatgttggacctcgatcccatcgaaccttttttccagcttcctgacttctgcgagatacttggataactcggggctagagcacttgtaatctttatgcacctggttcgcgactagttcggaatcccctttcacgatcagtagcctgactccgagtgcagctgcagcacttatcccggcgattagtccttcgtactctgctgtgttattagtcgccctgaagttgaggtgaattgcatgcttgaattgatctcccagaggtgatgtcaagatgaatcttgcccctgctccttggctgttgagtgcgccgtcgaacgctattgtccacgttttgttgtcgatttggttgtctgacctgttatcaggcatagtccaatcggctacgaagtcggcaagtacctgggacttgatggttgttcgtggcacaaatcggacatcaaactggcttagctcgactacccatttcgcaatgcggccgacaacgtctatgtttctcactacttcaccgagagggaaggaggatacaactgtgaccctgtgggcttgaaagtagtggcgtagctttcttgatgtcatgattaccgcgtaaagcagtttttggatctgtggatatcttgtctttgcgtcgtggagagcttcgctgacatagtagactggtcgttgcaccttctctctctcgacaacaatgacagtgctaacggaatatggcgtggcggcaatatagagaaataattcttcattaggttgggggcaacaagtacaggtggatttgataggtagcgcttgagtgcaatgaatgcctcttcggcttcctgtgtccatacaaatttgtcttgctttttcagtagaacgaagaaaggttgtcctcgctctcccatcctagcgacgaacctgcttagtgccgccatgcatccggttagcttctgtacttccttgagtcttgtaggcgacttcatgttctcgattgccttgatcttctcgggatttgcttctattcctctgccagagacggggaagccgagtagcttgcccgatggtactccgaacgtgcacttcattggattgagcatgaggcgatatcatcggaggttgtcaaacgtttcccgcagatcgtcaattaatgagtcgcttgtcttggtcttgacaacaatgttgtcgacgtaggcctcgacattgtttccgagttggtcgctaagtgcgccctggaccgtgcgctggaaagtgtttcctgcggttattagtccgaacggcatcttaacgtagcagaataccccgaacggcgtgatgaatgttgtcttctcctcgtcctcttttgccatgctgatttggtggtagccggagtaagcgttgaggaagctcaacaactcacaaccggctgttgagtccaccagttggtctatccgaggaagagggaagtgattcttgggacacgccttgttgaggtcggtgaaatcgacacacattctccatttcccgttggccttccgcaccatgactgggttggctagccactctggatggagtacctctttgatgaaaccagctttgagaagcttgtcgagctcttctcgtatggcttgttttcgatctggtgcaaatctccgcagtttttgctttactggcttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacggtcttgtcagggttggcactggagagtggaacgatcttgattgcgccgtccggtttcggcgtcttgtttgttttgctcagtttcttgggtggctcggctgtgtcgggtgggctgggcgtgtgctcgaccatgtcgacgctccgcttgtcgcattgcactaccagcttagcattcccttgaatagtgattgttcccttcggtcccagcatcttgagcacttgatacgcgtagtgagatgcggccattaacttcgcgagtgcagttctcccaatgatggcattgtatgctgtatcgaattcagcgacatcaaaggtgatctgttccgttcggaagttatttgcttggccaaaagtcacaggcaacgtaattttgcccaatggtttagacgatgactgaggagtgattccatagaagggttgatcggtgggtatcaactcgctttgtgggatccccatcgcgtccaaggtgctagcgaagagaaggttgattgagctaccgccgtcgatcagaactcgtgcgaccttgatattccgaaaagtgggttcgaccacgatcggatatcgccctgggatgacagcagtcttggggtggtcctcttctgagaattctatcttctgctcagaccacttcatcttgggcgcagccccctgccacgtcgaacagacttcacgttccaccttcttgtattctcgctttgagtatgccgcggaacctccgaagatgtgcgagacatggagatctgagtttgggtatgctgagtccgattcctgagtagccgcctcagcgtccttctcgaccacacgtactcgcttgcctttttccaatgccatgtgttttgcgagcgactttttgaagacgaggcaatcttctagagagtgtatgtctgacttgtgtatagggcaccatgttttcttcatgtcgctgccttgtgggtctgggcgcttgggagagtccgcgtattctgttgcgagaacatccgcttgagctttccttttcccactcttgcgatttttcttcttgctcgactcaggtgcgtctttgactggtttcttctctcctccggtcttcgaattgtcgttcttgtgtctcagtgcgtcgtccacgtgagcgcatcgatcgacaatttcgaataatctccgagtagtcgtgatgcgcctcgttgccaatgcctgggtagtatagcgatctctgacaccggacttgaaggcgcggattacataagcgtcggtgatctcggggattgtattcctgcactcattaaagcgccgaacataatccctcaaggattcatccgggttctgtgtcaacgcatgtaggtcgtcttcgatcgcgtggcgcttgtaagttccttggaagttggcgacgaactgctgtcacaggtttgcccacgaagaaatcgagtaggggggagatgcatcagccatgaacgcgcagagcctttcaatgcggttggcaaataattcgccaacacgttgtcgtccgctccggcagcgtagagtaccgtggagtaaacctgaaggaattcttctgggtcagtactcccattgtatttctctattgctcctggtcggaatctttcaggccatcggacatctcgaagtgaacgaccgaaagctctacacctagcgttgggggcggtgggttgtcggcgatcgtacgtccttcgtggatgtctatctgatgatgaggatgaggaagatgacgacgatgacgatgggtcgcttggttccggcatacgattacgaggacgtcggccgggttctcgagaatcctgtcgtcgtctcccgttgttatctcggcgtcgatctccatcatcatcgtcattatggcgacgtcctagaccagtatcgcccggcacccgccgttcgcgatcgtcgtgatcgtggcggttgtggcggttatcacggtctcggtcttcgctcgaacggcctcctcgttcttcgttatcgtgacgccgtgaagagacgcgatgtcgggaacggttctcattgtctcgtgtgtgtcgcgcctctcggcggccattcgggtgatcgcggagatcgccggtgccacgaggtggaggggtggctcgatgaggcgattcccgctgttcagggttttcaccatttgcatcgccagttggtggctgttccgggtgcgctgcagcagcggcctcttcgaacgcgttgctgaggttggtcactgattcctgtaaccgttctgtccatcgtgcgagatcgtcgttcagaacgggatcgtagggggtttccctcagtattgcgttgacggccctgatgtgctgggtcggtgtagtcacttgattctccgcttccgcattggcgcacgctgacgtgccggtctcgtcgatagccagtacctcgcacggcgtactcgttgacgatgagccatagtcttcgagcaggtgcaagactgatggttcgtgaggatcgatgtcgattaccccaacaaatcgatctgaaatcggcgtcgctccttgttccttgtcctcatccctgagggggatgtgtgactgctggaccttaggaggtgacgttttcatggcgctgagaaaggccttgcagcttgagaggtcgtgattctttgtcttgtgaataggacaatagacatcacgagttggagaagtacgctgaattccacgctctttgcagtcacgaatttcagcgtggatgttgagaaaaacccagcaggcttgcaaggtatgttttttagttttgtggataggacaccaggaccttgtcacctcggaagtcatcctcgtcggctcgtgattcttgtcgaaaagacaaggtttggccgcactaggatccttctcgggctcggatgtcgtcgacgttccgatctccgcttcggcgggaggatccttcgacatggagtcgtcctgggttgcagccactgcgttctcgtttccagccattgatagaccagccgagattggcaccgtggtataaaccgggaagactatttcgccgacttgtgtccacaccagcattgttgaagtaggaactccttggttaaggttggtgttggcgctgttgtcgacgaagttggatgacatagtagtagaaccttgagcaccaagtccccctacctggcgcgccactgtcgacaggggatacccgtagaccggatatagagggtattggggtacgctggtacgaggatctacgtaatacgacatcgagttggtagaaaacaaagattatactggttcaggccccttgataggtaatagccctaatccagttgatatgggattatatgatggaaaccacatgttacaaagggaatagcggaactcgacgataccgacgagatcgtagtcgagttgattcgactagatcacccggcgacttggctcctgtaggctccggcttcgtaggttgtggtggatgtgttggcggtaagattcgatgccttaggtcctcccggggggtcccttttataccgcaggtcaactggtctccaagtaggacccggagacatcggacccagtacgatacaatgacgacccaattctatccgagtaggactccttccgtctgtgaactccataatgaatttccttaacgtatgccgaaaacgtccgtatacacgcaagtataccatatcgatatgtaacgtatatcgaagggtggagggtataccttacccgtaaccctgacacacgcccttgccacttgaataaagatttttcgatttatttgttgaattatttttttccttctagctttcgagaggggattgtctacagttttttcctacctctttgaaaaaaaattgggtttacttttttttatatatttcatgaaaaagttgactctaaaaaaatctaatccagtttgaatttttttaaatgattttaaaaccgagcggcttgtgtcctccagccagtccgaaagaccgagaattttttttttcgattttgtaaaccctggtcatagctacttcaaggacgtgtctacaacgagaccgttctttgtatggtcataaccagctatctcaatctcatatctaattgctactagtatactcaaaagtgcatgtatttttttcttcttatggaattttctcttagattacccatccgatttacgatccgattacactattgtgttcataacaattaaatcttataacaagatctcacatcactatatttttatgaaaaaatagaaatcaattttataatatatctaaattacttttagattccattaaattacttcttagtcataaaagtaatttaataaagcttgatagtaatttacctatattatagaagtaacttaaaacaaaagtgaagtaacttgttacggcattaaaagaaatcttacattcatgttgtgagttgtttattttataatcatgtttagtcaatgatgtaatttgtgctgattaaatttaatttttatatagactcatgtttttacctccataacggatttacttttaatgtcgtgataaggttactttctttttgttctaagttacttctataatatatgtaaattacttttaggctttattgaatttacttttatgggtctaagaagtaatttagtgaaatctaaaagtaatttagatatattataaaagtaatttctaatttttcatcaaaatataatcatgtgagatcttgttataaagattcaattcttacgaacacaccggtgtaatcggatcgtagatcggatgattagtttaagataaaatcatttttcaagccggcgtagcgtagagcatcacatggcttccaatttggattcctctggatgatgccacgtccgtgaatcaccaggccatgtacagacgcaccagcgcttgtgggatcagacagccgatgagcgtgtcgcgtgataaggcaaaacagagagcgtgcgcgaattagatttcgccctacttcaatcatgtgatctttgatgaagttatagggattcttgtttgccgggttgtcaatgattcaattgatagcacctacttacagcgcggatcgtcaattttattattgtgccggcttgtatatttgtcaaaaggagcaaagatggtatccgatgctcgttcaaatagttttgtgcgtgtggggagctcagtattgtggttgtgctcgcctgctcacaaaaataaagtatctttgttcttggttgacatgtttaacgttctttctgcaacaataagattgtatgggtctcttaactctccgttggttatacccaacaacggtatttgtagagtattattatcgttagtaccagggtatatgtgatgagataaaagagccagtggacaaagatttatcttttatacagcttcgagtctcctatttacgaataatagctccactcctatactgaaaccggtgttgccattatatactaccaccgtttcatattataaatttttttgacttttttattgattaaactttttaggtttgactaagtttataaaaaatattataaaactatattaaatattagttttaatgaaactaattcagtgttgtagatattgctaatttttttctacaaatttgataaaacttacagaagtttgacttaaaaaatcaaaactacttataatataaaacggagggagtatcaacatcacactagtacaatatacaggatgggctaatctagtctctatcagcctagagacgcaaagctctcatatttggttgacagctagaggttaaggtagtcaactttcttgaataagaactcagtgatattggaagtagctctagattccttttatcggtttttatgactccgtattgaggttatatagttttgtgttgatctgtattgggttgccttggattgccccctctttttctttgggtctggaattttaatctccggatgttcccttgtccaaatataactagggaaccatgtatggatacgattcgagtaaccttgtagtgtctaagttagactctgtttctctttacttatccggaacgattttattccatataagatttggtatatggtgagttccaccaatgttaatacataaatatttccaatatcctatatccatgacactagcatgcgtttggtttaagggttgggatgggttgggttgggttgaacgtatttttcggtgtgtttggtttgagcacaggcgagatagatggtccctaacagagaatattcccataggatctatattgggatagtccataaaaaaactggctgaccaatccaacccacttttttctatcgctgtctcgctgatctgtgagttattcctttaaaagtaggatcatctgatcccttatgctaaatagatagatcggatcatcccatcctaaaaacacggatgagtccaaaccatatcaccttgtttccaaaccaaacacatgctaacagtaaacagtctcttatatagttatatttaatattatcatccatgtttctaaaaaaataatgccaagcaatacataggccggaaatatactcgatctgcaatcaaggaacaaaattggctctaatctctctcgccattttactacgagaaatggttgctacatgtaacatgtaccgggtaaaacggcggggacaaattaaacatctcccgttacagagtcctgtgtgggactagttccaaaggacgactacaacgaggacaaatcacaaaaccaacgaaatccaacaagtagtctacaaggattggtccctagctcgcactaaattccgcaccgccgggaaggtaacccacagtcatacaccgccgtgagactgtgccgtactggtccagaagatcacaaaacttcacatgcacttcgatctatctgctacagggaattgcagcttgtagcattgcgattttcaagctgatcttgtactgatgtactgaactctagctctgaatttttctagtctttcctccagttctccacccgattcggggaggcatatggcacgggccagcgagcagcgcaattacggtacagaaacccacctccattgatcatgacatggccgcgtttcttgttgcacatctcgttttctagttacgtcctcgtcaaaatgatggaaatgagcaactggtcgtggctgtctctccgttacggtgtacttaaatatataattaccgttcaatcaatcacttgtaattatagctgcaccatatcgtcctgtgcattgcgtgtttgtgttcacagcgtggccatca

SEQ ID NO: 32897 - DNA, 6268 bp, Oryza sativa
agcgaaaatagttttgtttaaacaaccctcataaaaattatactataactgtaagcttatagctaaaaaaacaaaaagacaaccacacgacacatctatgattagaaccctctactgaaaacagagggacacgacatctcaaagagaatggatctctacataacgtcttcaagaagaatatgacacttgagattatcgttgctgctcaccccgagacctaggacatggttttcactctaagaaatccatcagggagggtaggaaaaatcaaacaacaacaccccaagagaaaacgatgcccacaagcgtggccgttgcccacacaaagaagtcgggttttcgcctgttatttttctgccaacccttaccgaggtctcctcctggaaaaagaagccatcaccaactgtaaacctttcaacaagtagccccgcgctagcgcctccccaccagtcgcccatcaagtaggagttctaacatctgacgcgctccaaaaccatccatgtagttgagctaaacgagagggtgagagataagaacggatcccctctacccaacactagcccgccaacgtgtccatcttgtggcggcaaggcgccaccgcaagacgactagtgtgtagatcggagcccatggcaggactacacgcccacatcagggcaccatcgttgccgccacctcggctggactgcccactctcaatccacccgtctgcattgctatcgccttatcaagttgctccttgtcgccgccaacactgcctgccacgagccgtgacctctttttcccccggtcgcgccttgccgctccgatcccaccactatcaccatgttggagtcacatcacatctgcttgcgccgtgccagcctcctgccatcatcggctgtgccagccctcccgcgccacgctgtcgtttgccccgtagtgttaattgcagcccccgctaaattcgacgtctgtgagaggggggaatccagttgcgggggactagatccggtggagttagcgtcgaatccgttgccgcgctcaccgaggtgtgtagccgctgccggtttcgctcttttcccccacgccggagaccgagcctagctgggttttggccccaccatcgccttctcagcatgtcactcggcttttctagtagtgtgctccgacggcgacgtggcggagagggaaggagcgggcggcagctaggatttcgcccagtgttgcctgcacgtggacgatgcgggaagtgctcacaccaacgaaaataattgagtagatttcacaaaactatagatgttttgatccaactactataaaattacatatttaaaatattgtattgtaaaactacatgtttgatagtagatttgatgcatgctaattttttatacatcgatttagatttttaattttgtagcaaattactcaaagtatatatagttttaaaacttttataatccaacagtgcgcttaattagcatcgaatcgaacaggccatgattgttctaaaggaaaacccagcagtccattatgcgtgccagatcaagattgaggtagtgcaagtgtagaatatgcatgtgagtatctgtatacatgttaactagtggtctaacaattgaaaaagacgtatgtgtaccaattaaatggggggcaagatcgatcatgcataattaagctctctccggcatggattaatcaatggcacaatcattagtggcatgtcctagtaccaagccaccaaaattagttggaagctgcgtctagactactctagtgtttagcttgtttcatgtccaaccggccaaaagggacaatttggagccaacatatcatagtaccttaataagttttttcttttccgacaaataaattggcccaaattaatttgttgatcaatcaacatctctgttgtgaagaactagcactagtgtctatatcaaattatcaattcatgcggattttgatggaacaattaatagtgcaggctttttgaaaaaaaacaattcttttttatagtagcctaatattcctaggattgttttttaagagccgggttacccatggtgagctgtttcgtagttagtgaccaaaatcagaccaggaacatatatagccgagaaaacaaatgcagacctatcacttatactattattttgccttttccaaacctcaacggttgcaagtagcgatttaagtcatatgaaattgcagcttcttacaaaatcttctgttaccttaaatagtttagatttttcacctaaaattctgagtatacgtaattgtggaatctagaaaataaataagaaatcagaaggtaagaaacccagttttttcaaattatcagtatctactaattataagttgttccttagaatcttaattaagttcccaaaatggccttgattctgttttgcatcatcccgattccgatccattcaacgttcaacgggaaaacatttagtacgtttcgtgtgacagcgtgtcaagtaaacaccagccttgttagagcaagtctaataagtagacgattagccagcagatgatgtctcgagctgacgtggaagagaaaaagcgatgtgagagaaggaagccggcgcttctgcagccgcccgctaggcacgagcgcctagacgtgctgacagtttggacccatatcaagagaaagaaggtatttgacatgtcggtcccaccaaacatataaaaatacttatttatttgtagtagagtatgtgtacagagcatgctattatatgcactggctataacatcttgcataagcccatagcaggctcctctattatccctgctcttatactacagtactaattaatcagctagcagtagatgacagtagctagacaggattcgcaagtaagagatctatctcgagacaatggagcctcgaggaaataattggccgctccatgccatgatcgcggccggccggcgccggcgctataacgcgcatgccagggtagttggaagaaccccctggccggcataactgccagctgaataacttggcagcgcgcgatcgagggcccctcccaaatctcccatggttccatccatccccatcgagtgggtaaccggcctagctatacgtagtaggagtcagtagtaccccgacgacgacaaccacacgcgcgacgcatgcacgcacgctcccccgccttgtcagtgagacgtcgcgcgcggtggtaacaaaccgcgccaagccgaggggtatcgtgttgtcgcgcacggcagctcgcgcaccgtgcgatccaggaattaaacgcgccgccttttccctctcggtttctctccccggccgatcgaatcaccgaactgccccgtcccgtacgtacgtgcatgcgcgttgcgttgacgtggtctatataaggtcgccgcggcgtcaccaacttcccacacacatcagcatccatcgcagcgagcgaccgtcggcatcacaagccatctccctctctcttgtcttgtgatctagctcccgtcgcgatcattgtgatataggcatggccaggtcatcgtcgtcgctgctcgtcctcacggtcctggtggtggccgcggcggcgtgctccactacggcggcggcgcgcagcgtcccggcggaggagaagaagacggctgcgccggtggcggcggcggacgtgaagcagccggagacgttccacgaggggacggtgttgatccctgggctcgggcggttcgagctcggcagcacctacgtgccggacatcaccggagtcgaccacagcgtcccggcagccgagcacgggcagttcctccccggcgccgacgacacatgggtccccaaccccggcttcgaggtgcccaaccccttccagcccggctcgtcttctccctgaatcacccgccggctcgccgtcgtcgccgagctagctagctaggcggcggtttgccggagtaataatgtgtgtgatcccacgtgtccccgtcggtgcacggctgccgtagtggagtcgtttagtttttcaattgtgtgtggatgcgtaggatgcattcagatgtttggcttgatcgatcgcgtgcttttgttagctttgaactcgtaataatgtattaattggtgagtgattatgcaagagctcggtaaagtaattactgttcacgtactaaattaagatgcaattggaagctatacgtctgtgtgtattcatcgtgcaggcaggacggtatatccaaaacactgtgcaagtgtgcattggaggcaggaccatgcaagtacagaatgaaggcagctaggctacgtaccgcatactccatgttgtactcatcggacggtccgtcatcggatcggacgccttttcaccggcttaatttcttcgcaattttgctatatatttgtcgacaaattttcccctaaaaatttgacagatgtaattacagtacaaccgtaatgtaattacactgtaatttgcatgtaattacactgtaactataatataacttgtatgtaactttcaaaaaatctctccataacatattattttggtaaaataaaggttgtgggaacaattttttttcagatatgtgtgtactgtgattttttttcttcctcaccaaaacaaatctttataatagatctaataatttaaaattacgtgaaacttacataaaagttacactgtagttacatgcaagttacagtgtaattacatacaagttacagtgtaattacattacgattatactgtaattacatctgtcaaatttttaggagaaaatttgtcgacaaatgtataggtggtccccttcttcgagttgaaaaggagtaaagagagtagatggcccatgagagctgaggcccatgacagcaggattcgccggtacaaacaaaagggttggtatgtgggccatacggctcaggttttcggtaaacttagcggtccaaagaatgactctggtgaaaagtgatattttgataggatggcaatattaccaaaattttaatatgatttattatgtgtttatcaaagtttagcaaaaaaacctaaatgaaggcacatttttagcaactttgaaaaaaaaatggtatggttgaaaatatcatcaatctgaacagcccctaaattttggttccaaatttgttttgaaaaaaagttaaattggctccaattcaaaccaagacccctatattggaagtttataagcagctcatcttagagcctccagctctcctcatacagcctacattcttattcagattttaaggattgtattatatatttatatatatttatatatatatattctcccaacttctattctctcgtttttcatgcacatattatttataatgtgtattttacaaataattttataggaaaattgctttaaaaatcatattaatgtatttttcaatttttttactataaattcttactaacactaattcgtcgtgctatgagtatctagattttttttataactttcatctatctaaatcaaacagttgagaagatttgtcagtaaaagtttagtttgaaaattttagtccgtgtaacagtgctctcttttcagaaagcccaacattgtcgataatttcgctatcgcattaacgggcctgttagaccggaggcacgagcagttccacccaaccccaaaaccgaaacgccgaacgaaacgaatcgtaaactcccctgctgctacgcaacgactccccaactctccggccaccaccaccaccacctgttccccatccgcacgccacgcaccggcccaaccgattccccaccatgccggacggcgagcggcatgaggaggccccggatgtgaacttctggggcgagcagccggcgacggaggctgagtactacgcggcgcacggcgcggatggcgagtcgtcctacttcaccccgccgggcgggcgccgcctcttcacgcgggcgtggcggccccgtggcgacggcgcgccgcgggcgctcgtgttcatggtgcacggctacggcaacgacatcagctggacgttccagtccacggccgtcttcctcgcccgctccggcttcgcctgcttcgccgccgacctccccggccatggccgctcccacggcctccgcgcgttcgtccccgacctcgattccgccatcgccgacctgctcgccttcttccgctccgtccggcggcgggaggagcacgccgggctgccgtgcttcctgttcggggagtccatgggcggggccatctgcctcctcatccacctccgcacgccgccggaggagtgggccggcgccgtgctggtggcgcccatgtgcaagatctc

SEQ ID NO: 32898 - DNA, 6845 bp, Oryza sativa
ccaccgacgagctcggcgcccgcctcggcgaagtcaccgtcccgttcctcgtcgtgcacggcagcgccgacgaggtgaccgacccggacatcagccgcgcgctgtacgacgccgccgccagcaaggacaagaccatcaagatatacgacgggatgatgcactccatgctcttcggggagcctgacgagaacatcgagcgcgtccgcgctgacattctcgcgtggctcaacgagagatgcacgccgagggaggagggcagcttcctgacaatacaagattagtatccaggattcactccactctattcagattattgtgaagtagcaaatgcacaaaaagaatgattaaatgtgcaaatttgcagtgattctatatataaatttgatgaacatttgcagtgattctatatataaatttgatgaactgctcagtcaggtttacatgatttatggtataaaatatgctaagtctcctgaccaatgaaagaatgtttccagtttgcgaagcttgccgttgtatcagctctctgccggcgcttctggaggcagtacaaggcgctctctaccttgtacaagcttggcagaacgaattatatctccagttttaatctgcgacagaacttctcttccatctgtggtatacctgcagatgtttgatcgacacagttctctgttgttaatccacaaaataaaccaagtttgctgtctagtggtcacagttctgtaatggcaatcactacttacccgaatactgagaattgcccttcatcaaaagatattcctcctaaaccagactgcacaagataaaggaaaataatcacaaattaaaatatttacgcaattagttcttatacatagggcacgctatgggtctagaaaagcagaagcattcagaaatatggttcacaacacaagaggtagacgggtgcactgttgaggtacatgcacttatgcaatctgaatttaaaatactgtgctagcgaatatgtctagttctaaagatatatccatttactcacatttctcttgtcatacagatagaagaagaattggcttggtgacgagtattcatcagaatccacactatgggccatagcaacggcaccatatacagacatcggaaggactggcaattctccatcctgtattggatcaagtaacaaaggaactgggttatgacttacgaaagacggtaactctcagatttcactggcatttacagggtagtccagatgagtgggctttctttaatatcctttttacatacacttccagtttgaactaaatcgtaaggattttgattgatgatttagatccaaataccccttcagaacagacctaacagtgtggaatactgacctgaatacttagcggagttctgtataacggttcaaactgcccagcaggcatgacctctaatggaacagtgtaacctttctttccattctcgttgtctgcaataattgcctgacttgcacatttcagttttatcccatcatatgccccatccaacacctgaagaaaagttcatttcattggatcagatgatgtaacctaactactgaaaagaaaatcaagagctagtaaaggaaatttttttagcacatcgcagaaacatgaaatcttaaattgatgttctcgaagatgttatgtcgatgaacacaatcatttcgatgatctttatcatatatgtcagaaggcagagctattggcaggaaataatcaatagtgagatgaggttggagttaagctaccttaccaatttcgcaaagtttccagcagtcagtggggcagaatatccatcaatcactacctggaaattagtaaagaaatcaatagctgacacgtggaattttataactgcaactgtatacagaaccatactcttgcacaccatggtatgacaaaagataacaaccaaggataaggttcttatttctcaatgtcaaaagactgcagtttatgataccagacaattacacagccattcaaagccacctgaattgtagcaacactttttggttcaccaccagcagttggaaagaatgttgaaccatcacctttctccactgagaattcaacaactcctcttcctgctagcctattaaaagcgagctgtttaaattaaatgtacaaatgaacatttcgttacagactggaggaatgattgcatgcttaatataagtgccacagggatggaatgttcaaagcaccattacacttagggcctgtttgggatgggagggacttattttagtccccctcccatccaaacaccaccttacataatctgctaatcagctacacatactgagtgtattgcttgtcagcgatccccctgggattgaaggaacactcacaagaacaaagaacagagacgcgaatgaatttggcgctgcgcaatctcactgtagcttttctcagttttctccactgttgtttatacggattacaggaggcccaaagtagtttccattgaggccttcatgcacatgacacgttccaccgtgtcgtgtgccatcccacatgatcagaatgtgccgggcgcgacaaggacacgactcgctctggcgcaaaagtgcgcacctaaaatggacaacttggacaacaacctgggcccatacttcaccgaccccaaagacccaaaacagaagaaaaacaggggacctaaaggacgactaagtaaactaaaaacatgcgctcaaatttaccgacattgctgctgaagcgatcagccaatcagaacccaagaaaaattcaccattcctcaagagttcgaaaagaaaaatgcttgtgaggttttcttgccaccctgtaccaatctggccttaatgattttataatactatgtgatgatatatgttataaataaaaataagttcccacttggaattaactagaaagtactttttattcgacagtttctactccatgaaatatatgaagggtgacaccagcaataaatagtgagtttgcaaatatgataaaatggcaagtttgtcaaaaccaattaatttgcaacaatggaaaaactggtaagttttctattgaattcattttgaaaacctactaatagcggcagctttgattattaccatcaagaacttgggggcagagacctggttatcttaaaacttatactgacatagagcttatacttgtttgcaggacatagaaccatgcatgtcagtaactcagtataatcaaatgtcaccttcaatcttcggacctatctctgcccttccctcacaataattctagagacaaagaaacatttagattttaagctttggagagatcaacaaaagttaccttggatattccaaatattgttgtggtaagaggaaggataaacctggagcctgttgaaagaaatttccccctttaagtaatccgatcatcgccggagtataatcatcctcctttaaacataatgaaacttctattcagtttagtacagttacctgtaacagctccaattcagcaacagtatcaagagaagaagcaagtgcaaccgaaagtctgtcaggatcattttcctttatatatttcaagagagtttgcaaaccaccctgcagttgattccaaagtagctcaggtataatttataaataagtacaagtgaaaaccagaatttgatctgtttcataaactgcaattcaccatgagcacatcctagaacctactgaccttctcttcaagcaaggaggtatataacttcgagcccttttccttgagttctacaggtatacttgccaagatcgcatccttgttgtccattgctatctgcatccagagcgcatttgttctatatatcagcattcaggacaacagctcagcaagttcaataagaagttcacaatgcatagaagaagcaaaacattgttgctagaaaaatgcttatgaagaagacacagagtcaacttattaccttcatggccttttttacgtctccttccatggagccatacggcttcctctgcggtatcctcagcaaatacgaaatgtcctccagcgattcctggcaaatgggctcgcacaatctaagaacaacgcccagccaaccgtactaagcgatatgcatcgccgccgattctgatgcagtttacctgtatggtcttcatgtttgggttcgcggggatggccctcctcagcgccagctcccccgtcctcggcacgttcgtgtccggcgagtagaggatcgcgtccgccgggagcgacacggaaatctgggcgatgacggcgagcgccgcgaccgcgcccttgagcagctccaccactcctccctcctgcaccaaaccagacaaccacacgattaaactgaagcgaacgctacagctttggaagccatttggatgaggagagaccagcaaccagcgcgtgctcacctcagccgcgcaggagggatggtccgagcgacggtgggaggagcaggagaccctcccgcgaatgccgccgtcgcagcacctggcgccggctgcgaccaggggacggccgggaaacacaggaagggcaccggcgagcaccatcgcggccgccgctcgcgacgccatggcgtgcggtggattggtgcgggagcgcgggtgcttttgaatggatttccggtgggttgagacgcggggaggggaggaaccggagatgggggtggtggtggggatgccgttgctgccgtcgccgtcgtcgtcgtcatcgtcatcgtcgtggtcgccgtctcgtctatccccagccagtgagctgtgatccggttccgaaccgcctagttttgggccagcggtgaacggcccagggacgatacaagagcccaaagcccaatactgtcccgtaaagagacaaggctgaaatgccttttgcggccctgttacgtcaacgaggcctgagatggtaataggactgcattaatcacaggttttcagactctatcccaaaagaaagcacacacacatatactgccatacccagattcagtgtactttccactaaaaaatcgaagtgtattttttctcttaaaaaagactcacggtgtaaatgcttaatgatcggcaggtgatgtagtcacaatcatccctctcttaaataatattactgctaggtgctgtagctaaattaaagactgaaataactcagaccacggaagtagctggagagatctattgacatgcacgcatgtcatgatcaccgcacgagcgtacagccgcaacccgcagacatgccatcatcccgcaatcctattccaaccagcatccgagcagcccacccggcaccgcacgctcacgtacgcgacacggtcacgttcgcgccacgctggacgccgccgccggcccgccgccacatccccgagccccagaccaagtgccaacacctcacaccgctccgctcccgcaccgcacggccccaaagaaaccgtttccatcaaaccgccttgcggttgcagctgccacctcgccttgccggcttgcccccacccgcccctctgtccaccgcgccgtctcgccgaggttgctcacgtagcgcgcgctttgctagtactagtatcgaccataacttgcgtaaaatccaggacggtttcatcagtcacactaccacccacggaccacagtagtattcggcgcacgctagctatgacctcgcgcgcattgacagcgtcgtcgttggggtatgctgcgtgtgttaggtgctctcgacagcgcgggattcatggagcggtggcgctgatcggggcacgaggggtgctccccgtcctgcatgccgcctcccttaaactactagtactactactgctcgatcggcacgagcggtttttttcattcggatgatgacgacgacttcagtttcttctcgttgataggttaagttagatcaacgcgacctgattattgttttggccgcgcagcgctataagaatggtggtggcaccgtaccactcgagggaagttagcttgcacgcaaagatacgtttaagatggcacgaagctagcgtactagtagtgactgtagtagtacttactgtttcaataattgttttggataagtactaatgtagtggtagctcgtatgtgaatagtttagtagcaagattagtacgctgtgattgcgttcggtgaacgaggacggccaatgcaaagggcactaacatttgtcttgacaacgaataggtggcccatcattgattgctttgttgacctcgatcatccggaaccgtgctatgtcgtgacggtaacaagcagaaacggacaaaagctcttagctgatatgctacctagcttcctcgagccctgcctccgtccgagctccagctgttacgacttgcgagtactccgaacaaggcatgtgtttgttgggactatggggttgattggttggcatactcacattactaaaacttgctatacttcatttagctaatatgtctaacatgtggccaataaaattaaagccacacttcagtcataggagaataaacttgccacacttttatatgccaatgatatgtgggacccacatcatggtgaatgaatcttgctaaacgtatggcaccaaccaaatgaatgactaattcaaacatggctaacttgagttgtggcatgatgaggcaaattgtggtagtgaaccaaacaaccccatatatattctagtctcttttaaactacagtattcaggagcaacgaggaagagtacttctcggtaggaacggccgtatctatactttctgtttactactctctccatttctagatgtaggtaaccattttcggtgtaaatgagcacaagatcgaggaaatagcccatatctgttagaacgtactcgtactgtacaataatagaaataagcaatgctgtagtactgtg

SEQ ID NO: 32899 - DNA, 3080 bp, Oryza sativa
tcctgcatcacctccactcgtcggcggcggcggcggcggcgcggcgcagtgcggtgcttgcgttggaggagagggcgggccgccgagaggtcggcaatggcggccggtgggttggcgtgaggcaggtgggatcggtggtggtggggagggaggagaggtgggaggtgcgggcatggagcgcgggccggcgatggctccggcggcggggacggggtcggggccggggacggtggtggtggggtcggcagcggcgctggcggcgcaggaggagatgcggtggcggcagctggacagcggcgtcagcgcggtgtcgttcgggttcgtggccaccgccatcctcgtctccatgttcctcgccatggccatcctcgagcacttcctccgctccccggcccaccgcggccacgctgggatggggccgccgcccccgcacccgccgccgccgggagggatcctctctcgcctccgcctactcctccaccgccgcggcgccggcgaggccgccttccctggcggctcggatctcgaggcggccaggaagctcgacggcggcgcgtcccccgaggtatggccgcaccggcgcactgctcccgcacgctctcccccccttcccatccatcgctttaatgattccgtcatctcgcccttttcgcagctttcgcttttcgcatcgcatcgtattgccttttcacgcattgtgtctgctcatttgatgacccggttgcgaaacttgtcccgccaccttccttccacatcttccactctctcactaggaagaagcagaagcagggagtgagaagtcaaaccctgacatttttagatttcttgacttgaatatcggttgtgaattcgtagtctctaaactcttttgacgattaggatgatcttgaaagatttgacgattcctcacatataaaagcgaggtgcagcatttgagagcttaagttagatctttccaattccgttcataggtgtacggtcattctgaagaaataggtgttgcagcattgttccaagacaactcattaattagtttggacggcgtgtctgatcacaacaagccatatccatatgtcatgtacgatgagcccgaccagctgcatatgggattcgtcccaatgttactgtagtacattagtatcgatttgtcatctaagatcctgtctggaagcttgggatttggatcctaatccttaggattgcttccaggcgggtctgaagtgttttgctgctttcaataggctatgttggtttgttgtgttgtgaaaagaacgggttaaaagcgttattgttcaagagaggctagattatcaatatcatgcgtaatggacctgagaggggaatatgggagacagcagcaagcagacaagggcccatccctgtctgcagccaccccaaggtctgaatcatcctctggcttgcaatgttagctgtccacagccagaggtctcattcattgctgtttgagaattattagcatttgtggaacatcttgttaagatagatcagcagcagaatttgattgagttataatggtccacatcatagggatcaaaagcactcagtaacttcaattagatgtgaaatgtgcattgtatacttcatataattttgtagacttgtagtgattgctttccttctcttagggacgttaaactttgttgttcaactgctggcatcaactttgctagtttgaagttcattccttgcttgtgcagaatccacacttatgaattccttgctggtgcagaatccacacttatgaactagtactagtgattaggactatgctctattctgtatgctaagttacttcattgtgttgtctacattgagctgatctttttcctatcataggaaactataataatggcttccttctggcatatgcttctgtttttggtagtctagtggtagaaagagcaataggtataatgaaattggtgcactcatagttggcaatcactcccctgaagtggattgccctgctgcatgttgttttctactctattcacaattttttttgtttcctgcttattaagatgctagtgcaaatttgaaatgtttaaatttggactgtgttagaagagggctggcttgtattgtagtgatagaacactagactgaattgcaaaagtccatggtttcgaatccccatacttattcaaaatatagatgtgtattactccctccatttttaatagataacgtcgttcacttttgatcattcaccttagtcaaaaaatttgtatgtgtcatttattttgttgtgacttgttttatcattaggtaaactttaagcatgattcatattttttgtgtatttatatttaataagacgaatggccaaacattatgccaaaagtcaatatcgtcatttattacaaaatggaggtagtacttcctgtgtgctctgttataacaaaggattgccatggaagagataaggtttactatacaattgaatgggcatcaccaatgttaaaaattcactattgccatttaatctgttagcctaccaataaatcattcttgtcactgtattattaaaaaaattacccgagcaactgttacccaatctattccacaaaaagattacctgatctagctgtttagtgtaactgcagtaggagccaccacatacttgaaggatcacctgctaaaaatcatctctctcactacggtgtgaagctagtggaggaaataggaatactgacaatcttttaccattgatttttatttgtgtgcatgcatatgtggtgggtttttttgggtgcggggtgggaggggtaaaaaccagccacttaccactggactactttaattatgcatctgtttcgccttaagtggaaagtatgtgtcatgtgatcgagatttttgatcggttagatctttggggggtgtactagaaaacttgcttactaacccggtcgagaaatatttagatcagcttcatagttgtggatcacaacaaggcttcactagcaacgttccctgttaaatgacatcatgcagctattaaatattctttttcttgatgccaaatctttcacgatagctttaaacatggacaactgatt

SEQ ID NO: 32900 - DNA, 761 bp, Oryza sativa
aagactgattggaaaaaaacaacccatgctcaagcaagccaagcatgtccataaagcatttagcttagggtttcctattgatcaaattcgttaagaccctattgtatttgaaatttcctgtggagaaaacagtctcaagttgtgaattccttctggaatatttttaatagggtgtgttatgctgggttacctggaatatgtactgaatgctggaaagaggtatccaaaagaatgaaagagaattagtgcctgcttacgttagcagtcatgattactgcttaatgatatttcctacttagttgcttcttttatcatcacataagactagttagaaactgtcttatctatttgaactttgcctgcataagagatattatagcattaaaatgatttaatgggagcacttatggaacttgattaattgccctttcaggtatgtcccatctgtgctacaagggttggagtggacttgataggtcacttgacaatgcagcatggaagttactttaagatatccttttttcttctctataatgctggcaatgaacatatgcaattttacatttttacatcatattcagttgaagatacatggcattattggtacttgggaaaacaactgcacatggctttccttaatgaataatacatgcaacgcaggcgaagagtccgaaaaatatcttcagggtccattctttgttgtctttgttgagaaaggacttaagagatggcagtctgcagtcctttcttggtggatcatc

SEQ ID NO: 32901 - DNA, 306 bp, Oryza sativa
ccacgtgtcagcttagcaatctacatgctcgcccttcttcacacaacatcttgcctataatggtttaggatgaagcctggcatatatctgaccaggactaacgtgccatctctaggaggtaacacgctagctccagctggggacgagcgcctagaagccctcgtcctgacgggatggggcgaggcgtgcatcagatcgcctgtcgccacctaacccacgatctgaccggtctgtgactggtcacagaccggataaacgagtgcactgcactgcgttacatgcggcgtgacacgcttagccaaaccg

SEQ ID NO: 32902 - DNA, 21997 bp, Oryza sativa
  unsure (1)..(21997): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttaccggagtactcccgtcgccgtttggactcaagctccactcccgctagagcgcgccgccaccgcaggtagatgagaccgcctcccacctagagcccatcaccagttcaagtgtccatccctgtcgaaggtgcaaaggcatctatccaccagcttgcttctcgcctgatgttgccgtcgtcgctgctccatagaaccgtggccagatcaggagaaatgagtttgtgggggagacagggatgggcggcatcgctgagagagagagagagagagcggggggaggatgcggcctcgtcggtgctccagcgagtctccaccatggaggagtgaagtggagggcacatgggagaggtcgtcgccggtggggaaaagcgagcgagggccggccaccgtgagaatagtgggagaaagcgagagagggagaggggaagggcgggcaacagtggtgggctggcggctagggtttgggggaggtcgagggatgtccgtttttttaaaatgacccttcaagagcacaatcctattattcatttttttttcttcttagcataagatatgctagattctaaaggtcttctaggtaagaatacataacttagaaacctatatggttgaggactgccatcaaaatatcagtaacattaagtttttttttgcaaaacggctagagtcgacgcggaaccacgagtgctcgcgaaatccagcagcattgggcatccggggcaacgtggatagcacgggaaacggccatgccgccccgaatcgctgtggaggctccattcggggcatgttttaatttaaccgatatgcagtggtaaatggtaggatatgcacgcatgagcgttcattgggactatgtgatacctgcacataggaggctttaggccgagttttttcccaactttcccaactcacttcccccgtgttccgcacgcatgattttcaaattggtaaatgatgtgtttttttaaaaaaaaaattatatacgaaagttgctaaaaaatcatattgatttatttttcttaaaaaataggtaatacttaattaataacgcgctaatggaccgctccgttttccatacgctggaaatatgttcccaacactgtggaaacaaacacacccttaggtcctcaatggttctatagttgcatgtgttggacgcacacgcatgtgtgtgtggtgttgtatatgtggagtgaattcgtgtgcgtccttagctgtactatctctcaaaaaaaaaaggtccatgaagaaacaaattatttttccatgacacaaaatattacttttacatccaattcatattataaatcgttttgatttttttctagtcaaacttatttaaatttaactaaatttatagaactttagctatatctataacaccaaattagttttattgaatatagtattgaatataatttgataatatatttgttctgcgttcaaaatattgctatatttttctacaatacttagctaaacttaagaaaaaataactagagaaaaagtcaaagtgatttatcatataaatcggagtgagtaccatataccagtgtactcaacacagtgttcaatggaccgtatcactggctaaaagtaaaatacataaatctcaaaaaagaaaaaagaattaccatcacgccaagtgtgtttttggagcatgcatatacgagttcataccccactacacactaacacacattacactcgcacactcacaaatgtatctcctaataatgcaaatcaatagaaattgatagcaaatccctactctaactaatttttttccaggtcactaaaatttgttgaacaccaggctttgaaactttctaatctaattttcaagtttcacattctatttcggaaaccacaacgatagccgatcatattcttttgagcactaccacacaaactaaactttttccttttacagaactcttacaaacaacaatatcaaccatttaatttatcaagataaataagagcaagtttaataatatagtcaagtatcagctctgaatcacctatagtcaatttaatagctaatttatacatatttaccgataaatatatacaatacactagtaatatctgagcccacctgtcttacacacattgctcttctctttccttatttatcttatttatcttctcgatatatgtactccatctgtctcaatatattaaaacttaggaccggatgagacattttctagtactacgaatctggataggctgttagaaaatgtactatctaatcctagattttaatatattaggacggaggaggtatgtgtttacagcaagtttttagtgtgctattgtacctgctgtactaccatactcacatagtcacattacgacacgtcagaggtaagcataggcgttatttcatcggctgcttgatatgctgctgccgcctgcctgggaggcacatcgggcagtttaattaaggcaattaaggccgtgtttagattttttttttttaaaaaagatcacatcaaatgctttgacacatgtatagagtattaaatatgaaaaaaaaatcaattgcacagtttgcatgtaaattgcgagacgattttttttatctaattacaccatgatttaacaatgtgatggtacagtaaacatttactaatgatgaattaattaggcttaataaatttgggcagtatataggcgaaatctataattaatttattttgttattagtttatgtttaatactttaaatatgtgtctgtatatttaaaaattttctggccaagggacttaaacacagcctaatagttgtcctaatccatgcacgtttgcatagtacgcttccacaaggagcggaagcatcgcacggatgattgattgattaccaagatctctcccaagttgatttgattttgaccaactgctacagtatataatcacacctgatagcaccgggccaccggccaaaacacgcgtgcattttctactctttccatcggaggaacacgagacacgtacgtcctcgttctgcccagccaacctaattggaccaatccgatgactaatctaagtcattacggggatcaaggacaaaaggagaatgaaaatcgcacttcatttctatggcgctcttttgaaatcgagacaatttgcgcaaatttcacgagaattttaaactgatctcaacaaaaatccgctaaaacaacatccattgagctgtgaccgtggtggagggaggaatccgtgccacgtgacccaaaaccgaactcgaatcctttccgccaaagctgggcccacatgccagccagatgcacacaattccgatttgcttttcaaagttccaaaactataaaaacttcctcctcccttttcccatctctctcctcttcctcgcatttcccgcaccacgaaggaatcaaacggaaaaaaaaaagaaaaaaaaaactccaattagatcggcccccacgtatcgtcttcccgttccattccttctcgaagcttccatgaacgtggagcgcctcgtccccggcggcgccggcggcggcggcggccgcttccggtacgagcggatgccggctaggggcccggcggatgacggggagggggaggaggaggaggaggaggcggcggtgccggagcggcggccggaggtcctggcggcgtcggcgtcgttccgcctctcggaggcggcgcgggtgttcgaggagctccccagggcgtcgatcgtcgccgtgtcgcgccccgacgccggggacatcaccccgatgctgctgtcgtacaccatcgaggtgcactacaagcaggttcgcggatcctcccctgccttctctcctgttcggtttattcacggttctgagaaacatcatgtgaaaatttggtgtgatgagagggggtgaattagtctagaattgcgtccttttttttttggttggcaaattccacgatcatattacatacatacacgttatagttcaatttgttggtactaataactacagctcatgattttagttgctgcgcgaaatgtgccttctgattgtgagttgtgatctctacgccactacgaacttgtttgattttaatggcctgcaattccccatgtagaaagggaaagggggttaatgttccatgattgatggtaccagtcaactactagtaggatttttcacaatctcaaacgttacagcgtgtccatggcattgtgggagttgatattaatggttcagtattggataggcgtgacttttatgcatggatgttaagactacatcagatttactgctgatcagcctgtctcgagcaggtctgctcttaaattaatcatgtgcaaatacagtctatgtgaatagattaaacttgtgtgtggaattttttggtgcagtatgcgcctaatcgatcattgtttttgattggatgatgtggttacttgcactgtaaacggcctattaacctgagtataatgggatgtttgttctacctgttatgcgctcatttttatctgctcttacttggtgaggctaactgcctagagtactcacctactcagtcagatgagtactcagccatgtagacttggttttcatacactgaagtttatggtggtttctggttaagcatgttccatgaaccgatatttgctgctttgttgctagatgttcatatgaaatttgtggtgtgtaaaattgtcatccccatttagcatttgcaacaacgtgcgtcctcacgtacaacttggtagaacttctttgtccttttatatttattgtaagtacttgttttcttttgttacaagaatttataaatggaccacttttaacttttattttgtgttggatttagattttaggtcctgatgtttcctgtaattgacaggtatttttggtcctaatttctgatgatcattatgatccattggaattctaatatggttacctacatatacagaggtacttaattagacacaatcaattcaagatcaagaaattgactaacttagaggatatctcaaatatagattggagtgccatggtgattttgtttgtgccaatttgtaactgcaatagatcctaaactgaaatgatttctatcatcttgacttgtaacgttgcaaatcaactatctagtattgactactgaccaactcggccttaacaacttggtacatgcttaatttctcaaaactcgaggctgttaagaaagtccgtgttccctttcacttcacatcttattatcttaaaatgtgataaggaactttgtggaacacatgtttatgaccagtttgaaattaatggactgcatgcactacacggcacaacctgtgtgcagatgttttatacatgcacacacggacaaaggcaaacaaaaaatgttgaacttgtgaaatgcatgagttttatttcttaatacttgtcatatataatttttctacttgtggtgcatacttgctttcctgtgatggacattttcttctttacactgttctatttatttccattaaatatgaatgtttcatatgtgaactgagaaatgtttcactgcttccaccagtttaggtggcgtctatataagaaagcttcacaagttctctatctacattttgcattgaagaggcgtgaatttcttgaagaattccatgagaagcaagaacaggttggttatatgaccattatgattcatgatgcttttcagtactggatttcaacctgtaagttccttaaagcaaactcgttgagttgccgtgcagttgtgctgtttgattggagatataattaatttttttactcttaacttctgtacatctcaaaagttagttagttttaggattagaatgggccgcaactatttattttagaattatatgagccattaggtcataataaaaacaactgttaacagtatggtattagagctaggttgaatagagacatccaattcataatatggtattagagctaggttgaacttctccttgttgctagtgtggatatggcatcattgccttatcctcttcagatttaggtcgtccttgttgtcatatgagactattgacgactagaggatctcacctatttgttgcctgcgcggtggcacacctgctcctcaaaaacccctggtgacaccagcaacaccaatctattgtggttccctattgatgtatctccaagagattgttcctggcacaagtaaagatctttatgatgaggtgcagggcatgacatcttctctcccccttgcttcaagtgtatctcatattatatattctatttattgttttaaggttcttgccgatccctttttattttttttctcgaaaacgcaggatgactgcatttcatttaaggagacccctttttattttaaaatgttaccgtaacatcttgttattagaatttatcatcatttaacttttacaagtattgatgcaccctatggaaagtggaggaggcataaatatgtgtgaaaataggatggggtatagaaggaagccattgcatctggtcagatttagtttgttagataacagataataaaatagcttattatttatggctcatacttcctagtccgcttagtggatcaatatttacatattcctcatcagttcatcaggttttgcaaatttttatgttttttaatattatgtccaaacaaaaagaggcagtttccacaaatataaggggttgaagggaaagattgggaaagcagcactccaaaatcccttatatttgtggatacaggcagggagtaagtctttaagcacagatttttatgttggagcaactcacctacttcttcctcgttactttaacttaaatatgacacgttttaaccatttgatatctggagaaatgtcattaggatgggaagcagagttaagcggggagtactaagttgatttctttattttgtgattcaaggtcaaagagtggctccaaaatctgggaattggggagcacatgccagtaggacatgatgaggatgaagcagacgatgtgaatgttcctgcacaggctgaagaaaactccattagacataggtaaaaatttttatacatcaacgacgcactagtagttgatgtatagttatgctttatcatattgcaaatgttgaattagagcagttgagtctccatatgttatcccatgcatgcagtaagcaagacattgaacctgttgtggcagaaatgttccttcaagtgctgttttgcctgtcattcgaccagctctggggcgtcaacactcagtttctgatcgagcaaaagttgccatgcaagaatatctgaaccattttttggggaacttggacattgtcaactcaccggaggtactcattacccaaatctttatacatttcactctattgtttccaattagaataaatgttgaccaaaatatcctatctgcatctagattagttttatcgtcaagagtcagtactaaaatatctttcaaaatacaggtttgcaaatttttggaggtatcatgtttgtcatttttaccggaatatgggcctaagctaaaggaagattatgtatctgttggacacttgccaaaaattcagaaggaccataaagaaaactgttgttcatgtgggttgtttagctgttgcaaaagcagctggcaaaaggtattatattttttgtagttcagttttgtatttagctatcttataatcattgtatttaagatattgaattgaacaatttttcaataggtttgggttgtcctgaagccaggattcttagctttactcaaagatccttttgatccaaagcttttagatgtccttatctttgatgcactgccacatatggatataagtggagagggccaaatatctctagcaaaagagatcaaggaacgaaacccgttgcatttcggactccaggtacatattccattttatgatctcatgccaagttagcacgtttgtttgaaatgcaatacttttatttttggttgttgacgatggaaacatttttatatctattgcaagaatgttgagtttagccagattgtgattgtttagtttggccttgctgcaaagtgacagctagctagatatcagaatattacttaaaaaatcttagtgatttttttgttctgggcctaaaaaagatgcactcagttaattatttcatcttacagtaaatatataagtgcttctggaaagccaccacaatgcccaatagagccttaggagtctgcaggattatctctttctccttttgtcgtatggatatcttaatgaatacataacatccttgttatgaaaaatgctacttttacagaatatttttgtagtgaattgcatactcataaaaaaatacataaactctaaaacaagttttgaatgcggcgattcttttcttatttatgtgggaactgaattatttcttgtggaattcctgccttccaatcaattgatactatcttggtagttctgagctggtccacctgttcatactattttgatacaagcgttaaccttatatttctgtggagtctaaacatatttgtgcttttttggaggaaggtgtcttctggtggccagactttaaagttacgaacaagaagttcttctaaagtgaaagactgggttagtgcaataaatgctgctcgacaaactccagagggctggtgttaccctcatcgttttggttcatttgctccaccaaggggtctcatgccagatgggagtatggtacagtggtttatagacggagaagctgcatttcaggcaattgcttcctccattgagcaagcaaaatcagaggttaactttgtgttgcttcaatagttacatatggagaaaataactccaattgtataaatcttaagataaccgaatatttgatgcagatatttattactggctggtggctctgcccagaattgtttctccgacgccctttccaacatcatgggtcatctaggcttgatgctctactggaagctagagctaagcagggtgtacaggtatcataatggtttccttttaatcaaagttgcagacctgttatatgatgtgtgaggtgcttaagttatgtagcaatgcttgctacttcatcacgtgtcaattgcatgaattgtagatgcctgaatcatagacattttgtatcttctgaaaatggcttactttgtgaggttcaagtctgtttacctttcaagctcaaacaaaaaagaaaaaaaaaatccgtgaatcccatctgctgacaaactattcaaatagacccctgcgatcggggcttctggcccttctgcctcccacacaccgtcatcctcacttcctcttgcatacgcttacaagttatgtaattatcaattccttagagacagagatcatgcaagaagatttcacgatccataggtccctggcactaatctttctttgtgaaaatacattagaagttaatgacttcataataggtccctggcactgatcatttttttaaagaattgtcttaatgcctggttttgtcaaatttaaccaagaacaagctataggggtgtttttggattcacaccatgctttggtgcttatgagttccattgcacacttttgttgtatttattcttattcttaatttttttattgtttttggtgcaaggcaggaatgataggttcctgtcatggcctctggtcattgataaaatatgaacttatcacatgacttgaaaaagcaaaatgagtcaaaaactagatggctcataaaaaccgacagttactgactgtctactctgaattttggtaattatgcagatctacattcttttgtacaaggaagttgctcttgcattgaaaatcaacagcttgtacagtaaacaaaagctacttaacattcatgagaatgtaaaagttctgcgatatcctgatcatttctcaagcggtgtatacttatggtatgacgaatccgtttttgtctccctatgttcaatgcaaactatttaattataacaacttaactccttattttcactttaaggtcacaccatgagaaaattgtgatagtagataatcaagtatgctatcttggaggtcttgatctgtgctttggtcgctacgataattctgcgcacaaactttcagatgttcctcctgtgatatggccagggaaagactactataaccccaggtaactatggtatttcgtttatgatggtatttatgtaggattattcccaaattattcttacctgagttttcctgctgtacataagggaatctgagccaaattcctgggaggacacaatgaaagatgagctggaccgaacgaaatatcctcgcatgccttggcatgatgttcagtgtgctctctacggtccaccttgtcgggatgttgcaaggcattttgttcagcgctggaattatgcaaaggtttgtcttttccattgcatactcatcatagtcttccccttcattattgtaaataaaataccttttttttccagaggaacaaagctcccaatgagcaaggaattcccttgctgatgcctcatcaccacatggtaattccacattacaagggcataggccaagaaattaatagtgaggctgatggtaaacaaaatcatgacaaggattgtgatgttaaaaaaccagtctctgtggactcacgggagtcttgtcaggacattccattgcttttacctcaagagcttgaaccaccggcattgcccaatggagatttaagagtgaacgatttagacgccaaccactctgatcacctacacaaaacaagcttcaatcagcctttgctcaaccggaaggcaaagttggattcttcccgacaggatttgcccatgagaggtttcgtagacaatataagttcccttgagtcatcatctattaggcattttgattcttccaaagaagaaaagtatcacatggataagaactggtgggagatgcaagaaagaggagatcaagttgcttcagtacttgatatagggcaagttggtccaagggcaacttgtcattgtcaggtcagtattgaagttaattttgaattaatttgttgatgccaatgaatgagataatgagcaagagtttctcaaagttttggctattttagttatataactatgctacacaagttacgtggtttgctatctgaagattgtaattcattggaagtttggagttttaacagctgcattattggtagacagtaattcattaggaaataatatgaaatcttttgttataacagatgcaacatgaatgctataggaaaagaggcaaacatggaaaatctgaaaccagggctagtaactatgtatgacgtaacatgtgatacttatctagttcgaaactaagtcgatgatcagtatgagtctaatgactgacacaaaatgtgattcttatcagtttagctacttagcagttctgctgcttttggtgatgttgtcttttcatattctgggttcagattatgttggttatttgcatatttaattggtatcgaaacagaaaaatagctaagatcagtttgttagtctattcataatttattaattcttttgggtgtggcataatgtttttattgaagttgctaaatgtaaattctgtcttcatgatcaccatttcttcaaaagggctgacatataagatgttcctgctgtatattcagatatgcttgtatactaaattactaaactaacattagaaaccattataataattgcatcaaataattctagtaagttaatgaatttatattttggttcaggtaattagaagtgttggtcaatggtcagctggaaccactcaaatcgaaggaagcatccacaatgcctatttttctcttattgaaaaggcagaacattttgtatatatcgaggtccgcgttttgcatttattttaaacatcaaaaattcaatttctaaacaatagtagattagtaggttttactagataatgatctttaaataatgttcagtaattgtcactatcttattacacattattctgtccagtttctttggtataaaaaatcttttttttttgcacacatactccataagtatgtaattaatatccatgagactgccaaattgttaacatcctatttgcgcaccttttttgcagaatcaatttttcatatcaggcctttcaggagatgaaacgataaaaaatcgtgtattggaagcattatacaggcgcatacttcgggcagagagagaaaaaaagcgcttcaaagccatcataataatacctctgttacctggttttcaggtaattttctactgcagtgattaggaatgtttttgttcctggttactcacataatatcgtggcagggaggcattgatgatggcggagctgcatctgtgagagcaatatgcattggcaataccggactatctgtagaggccctaattctatacttcagaatctatatgatgttattggtccaaaagcacatgattatatctcattttatggtcttagagcacatggtagactatgcgaaggaggtcccttggtcactaatcaggtaaagtatgagtcttgtccatttctggagcatgttttgttttctgccagggtcctggcactttgccatttaagagttgtgattcaaagaattagcatgtaaaatatttggcattgcagatttatgtccacagtaagttgatgataattgatgaccgcatcacattgattggatcagctaacataaatgatagaagcttgcttggatcaagagattctgaggtatgcttttctcatattcctgtgtccactatattttggtacgttgcaccttaacttgtatggttatctgatgaggagtatttgcttttcaattaactctatttggtaaatggcaaatcgcttacatcaagtaatgttttaatgttggatgtcgattatctgatagtttacccttgtcaccttgtagattgccgtggtcattgaagataaagaagttgttagttccaaaatgaatggaaaaccttgggaagctgggaagttttctctaagcctacgtctctctctctgggcagagcaccttggccttcatcgaggagaggtttgggatatattgcatttatgctttgattcttccgtcggtaatcttttgttaatagacagatgttcttagtattgcagaatctccaatgtactctttaaccatttttttctaggtatgctagcgattcacataaaatatatggtatgggaaatgtatttttaattaaatatttagtaatatctttccattagatagtataaatacatttgaatctcattccaaatggtagtgaccttgtgaacatctgccccgtgacaaaattccacatacatttcacaatatatttacgtcttactgtactaatgtcttatgtaagccgctataaacttttgacatgtgataaacaatttgatattatcacgatatgcttgatgaagctttcttatattcattgcagcagatagggatatcatgtgcattattttgattgtttaaaatataaatgtgatatacaggtcagccatattatggaccctatcgatgactcaactttcaaaaatatctggatggccactgctaaggtgagagaaaacataaacgttttttcctgccatagtcaatttaaccctagccacttgtatcactcaaaactgctaatgctactcttcctagaatgtagaaatcgatttgggatgtctaacctggtacttcatataatgttaggatgttgctttcttcagttgtaaaatcctaaactgcatggtgcatattatatcaaatgctttagtcatggcaatctccactaatactcataaattagttaactgttttttttggcagacaaataccatgatttaccaagatgtcttctcatgtgtacctaatgatcttatccattcaaggtatgaattgaccattcgatttcagttgctctttttacaaattgctctagactctaaacataatgagcatgcagggcccaatttcggcagagctttgctcactgcagggataaaatcggtcacaatacaatcgatttgggggttgcccaagagaagctggaaacctaccaggacggcgatctcaagggtacggaccctatagaaagattgcagatgatcaaaggtcaccttgtttctttcccgttggatttcatgtcccaagaggacttgagaccatatttcagtgaaagtgaatattatacgtctccacaagttttccattagcttctttttcatggaaaaattactcccctactgccatagttgtacatagtgcagaggtcaacctttaggtgtttcacatattttgtcaaatagggaaaagaaagaaattatcaacccacagaccggtggaaaggttacaagtacagtttagtcaccggtacgttccttctctttttgggcaagagaacactctgctcagttcattctgttcgacacaaagaatataggagtgtagatagtttatacggcaccttttttccccttttttaggcaagaattactcctgttgagttaactctttgttgacataaagaaaagctttcccccccttccaagctgtgtctcagacttccagtacgtgcacattttagtctacaactaaacaatggcattcgatccatacattttggttgaaaccaatgacaatccatgtaatcatgtactggtatcgcctctggaaatgttcagtgttttcctgcatttgtaatgtttcacgcccttagcttctgaagagcagaggaccagggccagttaagactaatgctttcatgtcattctttttttttttgtcacaatgaaagcttacaaaatacaaaggaaacctatacgtgactattgaaattctggaatgcaaaatggtgtaactaaactaacctgtaagcaatttattagttgatctagggttgattgtagtttttccctctaatgaaggtaggattatgattactgacatgtcttttgtttccaaaaacattaattttttttcgtaactattatctggtgtgtagcttttcccctcagatttatttgtaattcttagcacatgagagcgaatatggtagtagattcttttcaccttgcttttataatatattagtcatatctaaccaattatcttaaactcaagaagaggtatgaaaacacatgacctccatatattctcaaccactacctttccatatacctttaaatatgtatccacaaaggcgaaatctcttgttgttactgctgatagtctgctaaatacatgtgaattccgtttaccactcgactttgagttacaaccattggcgcgtgattcgcccatggttttcccacagaattcccggtgctaagctagctacctcatctgtcggtgcggccacttttgcggtgattcgcttgcgttggatgaacaacagaacgaactgggctatacagcgtgcagacgcaggattgtccagcaaaaactccaatctccagaagggttctctttacacgcatgatgtttcatactgacgtagtactactactcatctcatcaaatttaaaccaccaaaaccaaaatgctgactctgatcaacctgcatcggttgatgccaaagtgctcgcttaaattaacacggggcatttgtcccattgtgtcatcagcaacatggatgcattatgcatgatgatggatatacgcagatgcaggtatagtagtatcttccaagatccgacactaaagtctgtaaagaggagtggttgcagaagctagcgccgtacgtgtcacggttgttagaggggaaaaagggacaccatatggtatcgtacgtgttcagtactgcaatgcgccggccgttctctagggtaagtggatgacacgtgaagaagacgacgactagatgcatcgtctaacgtacaaggtgtacacagccttgggtactagggtgtatattatgtgtgtcaagggttaattgctgtgcaacgtcgtaccatttgatttttagctagggaataatggcgatcattgcatcatgcacattcatccattcatgattcatcttatcttatatatttgagtgcattcagtgctgattatgtacatacgttgattctattgatcattagatcgccatttgagatgtacagaataatcaaatggactaacgaatatatgacaagatgctacgtatatatagctcgcctgatgcatcattcataggacacaccaaataattttttgtctagattcacctgtgtgattatggtgtgcacgcccctttagtttctcactatacatgtgtatacgtactcttataaaaccttaacaatatacgaggtttttattgtgcttacaacctctcacgtgggtttaaaattaaaaactgacatgtgtagcaccttataaatgttgggtttattaaacaaccaacacggataacatcaatatttttttaattaaccggcatagtactggtttttaaaaaaggcacgtacttttaacgatggcattgagccgacctccaccgagctaaccctggttttttcaaagtccaccctcagcacgccatcttgctcgctaccacacccttagtaccttccttgttggcacctcgtcctctccaccgcggccgctagcctcctcctcacccacaacgcctctttctctccgctgaactgctggtcctccttgttgcccgcaacacctcatcatctcttgactctctctccctctcctcttcttctctgtgggaggccaccacgtgagtaggagtcggtggcttgaggggtaggcggtggtggtagagtggagacagtgttgcaagggagggagcaattggtctagccaactggagctcaacaacagctcaatgagcaggcattggcgattatttggaaatcgaggactacgtacatgatctagctgccacgtgtttggggttggccagattttgccaatgcgatcagttcgatggcagcagccctcttcactagagctacggtggttccttactccttcaccatctcgttcatcgatggccgcaccgacgctctagcttcttctccctcctatgattttgtgattgttgactttgtggggattgggggaagggttggacaacatgcctgattcttataattcggctcgatgggatgttgattctataatagcaattggagattattgattctatggggatggggagggagggattggctcaattcattttttttagataatggaataaaatatcccggcctttgctcatcagagctacagccaattattacaaaagtaacacccaaacactgagtgtggttcaaatgaattaaacacacccaacaaaataaaaaatcaaactaacataaggagagcacatttattcaagtctatttgtgaatctccatccatagtttgcaaggagttgcatgaccgttgtctcaagcctacgacatgcaaccttcataagctctcgatcatcttcacatatttgcagctgtgcccaaaatcggagccaatatgttgccctggaaattacctgcatatatgagatagatggtgatttgtcaaaaaccatatcattcctagtcaaccatagagtccaacaagtatggcagaagctcgattcatataactgttttttttttgtcaccttgtcggtgatgattgtcaatccggtacttatgtgaaattttgaactagaatctattagatttcttttaccagtgctagttaggtagccaatgttctctctactgcgatactacatatatactattcttatatatatgatactgttgatatgatgtttaaccattcttattgatatttagtgtaagtatatagaatataagtaatacttaaaatatatttaatataaaaaatgttcacacttttctgtccagattcgttgtagtatgaaatgtctcatccggtactaagattgttatattataagatagagggagtatatatctcgtcgatgcacttcttattactgtgtttacataacaacaacactcatccacctaatggcctaatgccctaatctaggactcgaatcgtgcctaggccgtaccagatctgattaactagctaggagtagagccaaacaaacaaacacatcacagctgcatgggacgcgattgatgtcatatcatcactcattggcgcctagctaagctactcctaattagcgcccaggctagcttattagactagtccattaagctagcgtgccgtcacagtggcatccacgcccaccgtcgtcagctcgctcgatcgatgtggatccatgtcatccatatcttggctagcttttccttcagtcgaagaagatgcggtggtgttttttcctcattaagattacgatcttgcctcgattttcataagcaagcttttcaaactactaaacagaaaattttctatataaaagttgttttaaaatataaaatatattcatccgggaagtttgtactcccttcattctagaatatactacatccgtctcatattatttatcgctttgagttttgtttataatttttttatcatttgtcttattaaaaaatttgaaattattatttattttgtttgtgacttgctttattatcaaaaatacttgaagtatgacttctctttttttatatttgcactaatttttcaaataaaatgaatggtcaaacgttgcaaataaaataattaaaacttaatcaatcatgtacagcttttctcgtattacatgtgacatcttaattttaatcttcatcttcatatgtttcaaacgagctagtttgtcatctttcttttcaataatgaaatgttatatgtcggttcaaaataggttcagcctctaaaaacaaaagatatcggtttgacaaaccctcttcctaaggtctcctttagatcggaggattttcatgagaattttagatgattgaatttcttaagattatgtttctatatggccatttggattggaggaataggcttaggcaaaatcctatcgaatggcttcctacctggccccttcattccaaaggaaaataggaatgacgaagtaagaactcatgtttttgttttcttttcctaagtccaatgcaccctctctttctgtctctacttcctctctcattcatatgatatatttcctgtgaaccatccaaaggctttagctcaaacattcctgtgtttcaaaatcccgtagtattcaaaagaacatgacaattcatttctctgtttctctaacatggtcccatatttcaaaggtgccctaataagaacaaatcagatatatagatttctatcacagaagtctaaaggagcacacctaacatacaccgcaactgaaaattttgatttatatccgactaattataaaattatgctgtacaaattaaggctgggtttggtagagtgttttagctcagttaataccttgtttttagtgtatgcatttctcaaactgttaaatattgttttgtgaagtataatttttttaaaaaataatacaaataaaaatttgcaaatttatagtaattaataccccctctgaaaaaaaactacttatataaatggatttagacatatacatatctagattcattcttacaattacttttaactgcacgggcggtccctaaacttattcggatatgtcacaaatacatttttggttcctcaacttgtcttgggtgtcatataagtctaaaaggctccaacccgcttcgtgtgctgacgtggcatgtcatggtggcgcctacgtgtcaatagaactcatatatcagtcacatataaaaacaagtaagaacatattttttatcctctcttttttcatttattttttcaaaatgaaaaacatcattttctcctctttttcctctctttttaaattttattttttctatgtaactaacatgtggatcccactgacacataactgtcaccgtggcatgacacgtcatctcacggagcgggttggagtctgttcggacctatgtgacactcatgacatgttcgggacctacaaatacattttgaaagcttagggacctacaagacatatccgtacaggtttaagaaccgcccgtgcacttcccttactatttttttcacatagaagagtatttaattaataaatcattactaactactaatctgaaatcagcgtaaattcgactttggcttatagggacaccacacattaattaagtggtgtatattattttgattcactgtattttgttctcattagagtaattaagacaacgtacacaagacgcatatttggttgaagagtggccaacatccacggattaattataatggggaagggcgagtacattatatttttctttgtcccatacacaataaatttcgttggtactaccacagccatgtttggcccaaacgcacgtacagatgatgatagccacaaacaaaaccactcgtgaagacgattgcgtcatcttttggatctacaggttgctagaaaattaaatttatatggcgccgaaattaggtgcttaatttctttagaggaattagatgcttagttcgacgtatatatacgacgagcgaccgatgaagagtgtgaataacctgctatagcaggcaaatcggcgatcgagatcccgagatcaatgaatacgccttcccttttaaaataaattgatttctgactgtagacttatactcactccgtactacaaagactctatttttttaatttttagatacaacgttaaaatattcatcgtatttaaaaaaaattatgattactattattattattattagatgataaaacataataatattttatgtgtgactaatttttttaaataagacggtcactcaaacgttgaacatcaaaacccaaaaataaagtcgtagaggaagtattttacgatcaaatcaatcccgctagtcgtacggctcgtgcccatctatgtcatattcatcaatcagcgaacttgttctttaccatgcgggccatgtagataagagatctatctgtctccatttgtgagatttttataaaaataccatttcttaaaaaaaatataaaaaaaaatttgtgagattttcagagaaaccactctacccttcttagtcaactaaattagcgtgattacaatcctcttataataaagatctgaccgagagccaagtcatcgactcattgagcagtcttctttcctaccgtatgagcagttttattcgccaatctctgaactcgttagattttaacctcctgaaaagtctttcagcctatatatccttcggccagaagcagctccaagaggttgatcaccacgtagatcatg

SEQ ID NO: 32903 - DNA, 6283 bp, Oryza sativa
ttatggcaactaaaaaggtagcccgcgcattcgcgcgggtttgtactatacgtaggataaatttgagaaacttataaatatgttataccagcgaaataatatctgcaacgtttcaaaattgtgtttttttcatgaattttcttcattagaattgcatgacgaatttaattgttattatttataaaattacctattggagattagggttggtaacttacggtataaaacggtacctaagacatatgactcttgaggttccatagagaaagagagaaaacttaagtaataaaagacattgcatacacaaccatatataattaatggctctactgatttatattgaaaaattgataattaatttattaaacataatatatgaccctcgattttagaccattatttctaaccattggatatgtagatgatctaacatattgtgcagtatccaactaaccaaattattcgtcttccctcaccacggacggtggacatgttaattcgtgcctccgacaacatactcgcatcatcatacttagaagaaaaaataagtgccctgcatgtatatgcataatacatgtaactatctcaagcccctcttttcatctgagaaaaatattctatacccatgcatgcacaccgggatgcaccggctagccctgcaatttgttcactccatgaacagtatgttcctttgttctagtgattagataatttaataagtacaataagtatctgaaatcaattcttattagtaaaatgtacaataaggacagctctgtagacgccatctctccttcttttcttggtgtattagttggatttgagcaacgtgatataggtattttgggctataagttaatgtccaacttccaagggattaagtttcccaaccctcaacgccgaactcagcataagatcgttcgtttatccttaaaaaagattatatcttttatcaaggcattgggattaagtaaatagcatccacataaacgttgagagatataattaagttggttatgagtcaataggtccattgatgctataattaaggttaaggttaatggtttataggttattttgattttattaaaaaaataaggtggatattttgatttttaataagaacttttagtattttttttggtatggatgtgggtccaaaatataataattttattagcaattaaatatagtcggtatagatattaaactattgatttaattaaaaaaatacaatggttcaaacagatcataaattgaatatataatttaaaatttacagctattgaagatcctcatacataccaagatcaatatgtatgaggtatattatctatatctatatgtgcaagtgcatgcagtctttgaaagtacgatgaaattaacttaattaccttagaaaaaaaaagggtggcgagcaagaaaaaaaaatcacacagactcttatcatgcgtatggatggaaacatgtacgtgcgttgggcggactcgtaccaccagattgatcttaagtttgttactaaagataaatctaatggtatatgatggtaaaaaaaaatattaggtccatgagattaaataaaaccaatggttcgatgttctcctttttccatagattttctaggaattaattagagcgtcatgtgtcaatgtgtcatctttggaccatttctaggaatctcacgtggcagtttaggagcgtttttagaatatttaatggactcgggtttgtgaaatttactccataatatatattgccatttttaatattttgtttttatttggttgtcatgcaaagaaaaatggtatatattcaaagttaggaaagtgtttttcttaaatataaatttgataggttcaccagtttaaaccatctatatacctaaatctaatggtttttattgtttgttcatatttggttttcatgcaaagcacaatagtctatggtaaaatttaaggaagtgtttcttttatatatagattaatgggttcactggtttaaataatcgttaaaataatttttttcagggacaatggttaaaataattggttaagagcgtttgttagagtggcatgtgacggcttaagagcgtttctaggatgccacgtgacaacttacgagtgtttgtagaaagtttcgtggacttttaattaatacaaatctaataatgacataaaatattgtgttcattgatcttagtggaaaccaatggttggatgtttctctaatttaagagtgccacacaatggttaaaaacattgatatgatacttaatggactttaacgcgtttgatgtctacttgtgggggtattcttttcgataaagataagttcaattttaattgtgattagaaaaaggaaagaaaggaacaaaggaaaaaaaaagagagaacagacggatggagtagtacgtgcgtactgcacggaggtggggccggtgggaggttttggttttgaagatagatctaacgatgtaaaatagtgggtccaccgatttaaatgaaaatcaatggttagatttctctattttattagagtgccacgtggcaaagagcgttttgagagagccacgtggcagcttgagagcgtttatagggagtttaattaatggacttttagaatatactccctccattccaaattgatctacatataattttttttgagcttatttctaaatgatctacatatttgtgttcattcattaggtctattcgttatttgtgtattggagtaaatgaacattgatgcatccatgcacacaagtatttataacctacatgtaatatcttgatttgctattggctaggaaataatggggatggtgcatgcatcgagtttgttgctagaataaatatagtatgagagagttattagcttttcttagttttgatgtacctataaaatatatagattaatttagaatggagggaataatagatagacagatagatagatagatagatagatagatagatagattttcaacacggagtagggcacacccaacgaaaatttcctgtcctgaagccgccattgcttgaggccttggattaattggattattgacaagttaaactcagactgagttaacatcttcaccacctccttacaattttgtctcagttatcaccctttctgcccccagttcatttgcaagctcagcagctcttttgcacgccaacacctcactaacaaggacactgattttgcactttaaacacataccttctctatcccataaaaaaccaatcctaactacgaacctgaacacatgtgtgtccaaattcattattaggattggtcttttcttttttgacgaagtagtatttatttagtttgttcagtgtattatcattcgagatccaataagcatgcactgtttcggtcatgtatttgttgcgtgatcgatcgatcgattcatgtactagatgcaggaccacatttttttggccgtaccaaatctgataaggttttgtacctttggattgggtctgctgattagttatccatctcaccatttcttcaggattcatcatcattcgttttcaattcgttggtaccaccacacaccacactgttacacacaaatcgcacgcctccccactaatccatgaccaatcatctcaacatgtactaaccatttgatcttgttggaaacacacatctcttttcataaattcggaatgctaatcatatccaacatgctaacctgcttcatgcttcaattttcacgaaattgctttcctgccaacaaatgggggtgagtgctgtttgtgtttggcaacttggatagtagtacaattatctgcagctaaagaagctagttgcaggtgttaattcactatcaaacgccatcaacttctttgcctgatactgacggggactttgcaacgtaatcagatcgaaggaaaatataaactcttgtagttatcgatggcacgagcaaaattatctaaaactatctaacacaaaaccatgtgcattctctctgctttatgtacatcaattaattagccgaatgaaagctagctagaccgaggcaccgagctagaaacaaaaaaaggtttattcggtgacaaatgcagaaggatcctagtgcatttatttttgaacaacttgctgtaattaaaggttagaatgactgcaattaattagtaaatttctatgtatgaaattcaactagtgatgcaagtggcactgaatcttgaattgcgtcaatcctttttatctgaatctatctactagccactagtgaaggttcatagtggagtccagaaatgcaaaaaatatatccttgggtgcattattatactccaccgattgcatgattttttaccagtggtgtttggtcggttacagttcacaagagtagctgagacagtcagtcagtgcgctcattggctgtcaaaaaagctctctgcatacatgtaagcttctagagtatatggcacactctaactacttgcacccaaatttgatactagacgtctgtcatcccaatatatatactaacttgttcagatacataaatatattttgagacagatgtggtactgaaaagtatggttcttaaagtgcgtggtataatgtttcacctaaatttttttcgtcgctgataatcgtttcttagtagtatactcgtgccttcatgttcttgggagatcatagaagcactattcataattaactagggaaactatcgactctttagcaaagggagagcaaacagcttttgatgtgaattcttttttcttaaaaaaacacttggtataaattcttaaagaaatactagtagaacttttaatgtgaaatcttgaaaagagaacaacttttgatgtgaacaaactgtaacatgtgcataaaagaatactaattaataaagagtagcgcaaaagaaaactaaagaaagaacactacttaaccattggatatattcagatatatatatctgatatctgaaaaagacaacaaaaggacaggaagtgcaacgtcagaaaggcaaatatattcagaatatgtataatgctggcgccgtcttcaggggagaaagaaactattctgagtgcgatcgaatatctgaaaattcttgaacacttgcacacttgcttgactgactgcctcctttaattcgatcccagctagtggacacatctgcgatttggatcattctcagacactctgagtggccggccacctgcaaattctgcaaattgcatgaaaagatatggttttcttggaattccgttttgtttggttcggtgaatttggagctctatatgtctgtgcttttggaatatagaatatggttttcggaattccgtgtgctcattcagtgaatttggattggtcctattataatcttttgacgatgcgccgcttcgacctgttgcatcagaaatcgaaacctctgactgaatttcgtacaaatctaaggcttgggtgggacatataagcatcgcaaaatgaacaggttcagaggaatgttggcccttagtcatcattccatcaacatcgtttgccaccggacaccttgatggatctctcatgacaaatcattggtaacaacttgttgattgttggtacttgtatagtcatcattgtagttcttcgatttaagcatgatctttgattttcattttggttcgtctatattgattgatttatgtctcaacttgtggtcaccatgatgcaggctagtctagtcatcctggccagcaggtgaagagttgctctgggaatggatggaccactgatcgatcgatgctgccactgtagatcgaatactgtctggatcgatcgatcgatagatgcatcgacacaacaacaacaacatcagctcatacagtcacagcacactgcagcattagctagagagaataaaacagtacatggattggaacatgtgcagacaatatgatccatgagtgtccattcgatccattgagcatttgcaggcagctggtgcttaatatatttgccttttcatcatcatcgtccgatcgatcgacgcatgactaccggtttcagaaatggtggattgatcgatcggtgatgatggttgttggagatgacggtggtgatgaactactgatgatcaacttgcattgctgccgagatggagatgtgtggacgtactatacgtgagatggatagatactggtagaaatacgagatctgcctgatatgaaaatctgaaatggcatcgcatatgcctgctgctgcttctgaatgccggctttggtggacaactttatgagtcagaccggtgtcatatgtgcac

SEQ ID NO: 32904 - DNA, 12654 bp, Oryza sativa
gatggatggatggccgggcgtggttctgtgtttttgaggcgcgggttggggatccagatcatcgttcgttcggggagcagttcacgctgcctatccttttccagcgttgggatctggtttctagccccatcttttcgcttatacacgttttgaatcgcttattagggtgtgtttagtttcagaaaaaagttgaaaacttgaagaaagttaggagtttagaaaaaaaagttagaagtttacgtgtatagggaatttttttgatgcgatatgatatgatggaaagttagaaatatgggggaaactaaatacggccttagtgactaaaaaataatttaaggatcaaacttttacatacatgtttttagtgattaaaaaaataaaacttataatgtatatattcttagcgattaaaaaacaaatactataaaacaatgatgaaaaaatcataaaatcaaaattttaaaatttgacttaagaggtacaagcatgagcggaaaaataggggttcttttggtctacgagatgtgaggagtaaagtatagacatgcatattaatggttgaatttgcatataccttaaatggtagatatgttttggagtaaattgcatgtgctggtgatcaaaactttttaagcgttcgttttgtctattatttcccccacgttcttcatcttttactgtacaattatcatgaattgttataccgttgattaaatatgtatattgcctatataattaattcattgcatatatgacatcctaataagcgtctaactctataggattaatcatagtgtatagtttttaccttgattcatacacagatattttttcaagtttatatagtaccataagtaggacagataagcattattttttcctatttataattttttttattacacgacaaacacaggcataccattacacgcagcaacagtcacaaccctgcttatcataattttagttaatattttttactcaaattttatactagtacgtatacgaaaatgaacttaatttgcatccgtagtgccaccagcgttttgcgtacggatcatgcaaatttgtggatgcgcgttttggattttttggtagtaagtgagaccgagtcgttgaggaaggggtgatgataacactatacttttaacacagtaattactagtcttctcggattcgatcgtcgacgttagcgtagtgctaaatctaatcgatccccatgttgctgtcaaacctaactttcaatgatgctacatgaatgagaatatatatatatatatatatatatatatatatatatatatatgtgtgtgtgtgtgatctagagcttaagcaatactagattacccacaaatcagtgtgataagaaagcgacacaaatgaattaaattcactgtaattaaagaaggctagctagctgttcaactctggagagtgtactgtgacatgagccgcctgtgcactgctagccacggactagatttagtggttactggacaggattaattcagtattaaactgctagtgtactttgctcattgtctgatggcccaatttttccattagtttgttcaaaatttggccacctttttcctgaaccacttcagcttttgacaaggacaaaatgtgtacacatgcatgcatatggatggatgcatgttgttttactttgccttgaccttgtgattaggtaaaccttgatgtttattaattagtctgcatgcatggtcattatcgagtgattagggtcgctgttattcaagtgttttcttaatagttgaaggaaccatgtcgatcggtcaggcatgattaaggtagcttaatttgtggacaagattgaatgggttcccccatagtttattatatctctggttacatctagagtgagtgatgtgaaagtgagctatatgtgttttgtttttgtgggatatttttggtaaatcaagatggaaacacgaagcgaccagattatattgtatttcattagcacaagaaaaaaaatctacacttcactctctctctctctctctctctctctctctctctctctctctctctctctcaaactcctctatttcttagcacacactttaccacctaattaaattactgatgaaattaattcactttattacaacattcccccttatgtttctctttatatacaagttatatttcaaggagaaattttgtgtcctattttaatcttggtatctcagttacataggttggaacttttgcgtacaacaactaacttaaatatcaaaatttataatagcatgcaatatgtcatgaaaatatttaaaattatttgtgacataagaaaattgtctaaaatcatgttcatatgcatatgttaaaaaaaaaagaagaaaacacttctagaagagagagggataggagattggcaagtggatcgatctggttagggtagtattttctttgttataggaagcttgaaagcctctcactagtcactaccaccaaaaaaaaaatcgaaactggcccatcactgccggttcttttagaagtggaaataatatttggtagcaaaatacgaaatactttttcaaacttttttggagcctacgaaatccagaaatctaggacaccactattgcctctagttaaatactccctccgtttcgaaatatttgacaccgttaactttttagcacatgtttgaccgttcgtcttattcataaaatttaagtaattattaattctttttctatcatttgattcatcgttaaatatatttttatgtaggcatataattttacatatttcgcaaaagtttttgaataagacgaatggtcaaacatatgctaaaaagtcaacggtgtcaaatatttcgaaatggagggagtatcaggtattactcgtagtttaaaaaccagcaatgatactccgcgaataccatttgtcgacagtgcgctgccagttaaaaacaaaaaacataattgatgcagtgatgaggcttgtttggttggtagtgcccgtctctctgtggcatgacaattcatttgcacgtagctctcaaaataactagaaatttaactctttcaaaggaatagttagtccacataactgcagtaccctacttaattacgttttcatatatatcatccgtttatgtaaaacgttgtaggcccactacgatattctctattgctaatagaaagcagtttgaatcgttgatcctattcgatagaagagttcagatctatttatacaattatactatcctctaattagcatagtagaaacgcggaggagcattattgtcaaaaaaaaaaaggtgtgaaggggtataatcatcatttagccatgaataaacatttttttccttttctttttagctttttcaatggaatatgagcgatgctagcgtaatggattaccacatattgatctagccaaaaaaagacaaaacgacaaagttacccctaacaatcgtattagtaaattactgatttacccttaataacaaatggttcatatcatttttactgatagtatataatactactagtagagagcaccgagtatcgctcaaagatgatatgataggaacaaatggttttatgtgctaacacgcttgcctatctaaaatgatctttatgtgtgactaatctcgctaccggtataatattgaccacaaggccagggctatgtacttattcccttcgtcccattaaataaggcacgcacgtattttataattcaaccctctaaatatttgaccaattatattttattataatcaatttttatttaataaaaataatatatttatattgatatttaaatttactttcatataattatgattatgttgctatagacatcgtaatatttaagaaattcaaagtcaaagattagttttaaagaccgtgttatatttgaccgtgccttagtcggtggaacgaaggaagtattagacatgaataataggtaaatatatatgaaaaggtgacaattttgacagaaaataagaattgttttgcataaaaataaagcatgtatggtttgactctgatatatgaacatgtccaatggtttggactattgatttcgtgatcgatgctggccctacgtagatggagaggatctgacctgaaaaaggccagtactgtgtgccactgtggcaagtgattgcatcacacgccatactttgccgacaaatagtgcatacgtgagaaatgcctgtgctctgaactatactcctatatatgtttccaaatggacgtcggtgtcgatcgattattattgtttctgttatgaccaccaaaaattttaaaatggttatatttataatgcacgaatgttgcatagcctacaattaatgtgactcggcattgatgataatgatgatgttgctcaattataaattttttatatgggattcggatggtccagtgtgaaatagtaattttttttcttcagttttttctttgaaaaattgtgactcatctggaatcaagcaccaatgccgattcatgccaaggaccgatagtaatgaatttgtattgccaaatcctatactagtagaaattaaggagtaaaatctcatctccaacaatagccataattttatagaataaaaagaggttgtcctgatttcctgagaacctcgaaaataccttctactcaatccagcaataattttcatttccaatgcctcattttttttctcgattatagatgctaataacctaacaggcaattttctgagctcattcctgttaaaagtatacccttaggcaattcccaacccaagacactagacattctttccatcaactccacatcatcaagaaattagtactagacactaatcttccaatgcaaacactactattccatatttcaatttaatgctacttatctcacatgatgtcttgaatgttgtgtagaaaccatgtctgatgcaagacatggtttccttctctttcctcatttattcacctgccacatcatttttcatcctaggtggcagcttatttaatgctatggacactatcctagtcattgggttgggaatggccttagagcacccgcaatggtaaagtaatgtgctatctataaaacatgtacatctcagcaatagactagattaatagtaaaccacttcaatggtatgtctacatgggtatctatagctctctaatccattgcctcatttttctctatagactatctccatattagtagatagttttgttctctctcttcatttaatctcttccaagtaggaaatatgctgacatggatctcttgtagaaaggctatagataaccattgtgggtgcccttatatgcgcaaattaatattcatgggaaccaaggaactttgtatggacacacgacttaactaccacacacgctttaggccctgtttgattcagcttacgattattataatctagcttattaggagtaagctcaaacaaacaagtagattattatagcagattattataatctataagccagattattataatctgataagctgctctagaggagcttttttcagattattgagtggctaaagacccactacccctacatacttgagaaaaattacccacctatgctatcaactgaacagatagctgagggcattatagactttagcctttcaaacccaataatccagacaaacaaacaactcacaacttattctatgccagcttattataatccaacttatagtaatctggcttaataatctagattataataatcataagctgaaacaaacagggccttactgtatttataggcttatagccaatttaatatactcctagatcgcatacaagtaaaaacatgataaacatatttgagcacaaactcaagatagattacatacatgcattatctctacttttagtacatgacactgtttactttttaaatatgtttaagataaatatataactattatttattttgttatgatttagtttatcactaaaggttctttaaacatcacttatacttgtttatgtttccaaaaaatgaataaggtgaatggttaaacatacgtttaaactagaaaaatatccgtgcgttgcaacgggtgaatgttattttaatcttagtattgttatacggtttagctaggataaaattcattgtgggaatttgcttggatttttttttagaaaatcatgagctgcaattaggaggcggactttcatcccaagttagcatgtgagttattttaaagaaatttcttatacggcttattttgtatttccaaaagcaaatgaacttaaattctgactcaaacacgaatttatatttccaaaagcgaacgaacttaaaaactgactcaaatacgaatgacatatcaaaataccgacaaaaacatatttaatttttataatagtagagaagtcaacagtgtcatatattaaaaaataaagagaatatcatctaaatctgatcaagtacgaatttgacgatctgatgacagattaagcatgtgtttagtttaggataagatgtaggataggttagatcaatccctattatttggataagatggtcccatttatttgtttggcatgaagtataaaatgatcccttttttcgaggaatgggagggtgtgggtcacatgtcaatgaaaaagaggaagtgggttttattggtctgttacttttttaagtatggagatgaacgagatctagatagaatattcatttttagagatcatcatatcccacatgtcttcgaaccagagattataggtttgctcttcctcaacccgtcctaaccctctatttccaaccaaacacatagggatgaggtaggatggttggactcattctatttttttaataggatgattcggtctgtccgtttgacatgagagatgggatgtgatggttcagtttttagaggatgtctcacatgtcagcgagactgaaaagtgggctggattggtccgccactttttaaggaaccagcccggatcttagggaaatatttcttttcagggatcatctcatcccacctatttttagaccaagcaccttaaaaagtgggttcgacccaacccaacctatttcatcccttaaaccaaacaaatgcacgcacatgctacagctaccatcgacgatataggcacgtttcacatggagagggctcctctaagacttgggtcgctgacatatggtcccacaagctatggggtccaaatgttagcccccaaaatcagagggcagtaagttagaggatcactttcctgtttcacacatacgtttggtacatgatcatggacaccttattaattaaatagttagcatgttcttcccgtgtattgcttgctaccatcaaaaattatgaatttaattagaaaataccatcgtatatattattgaaatgtggatgtatatgccccacatgtcattcttgtatgtcatggtattttacgtatccatatgatgttatttcttaaacttttcgatctctcataaatactcccttcatcctaaaatgtttgacgccgttgactttttttttaaatgtttgaccattcgtctaatttaaaaaatttaagtaattattaattcttttcctatcatttgatttattgttaaatatatttttatgtatatatatagtttaacacattccacaaaaatttttgaataatatgaaaggtcaaatatttaaaaaaagttaacggcgtttaaacatttagagaagagggagcatatgtcaacgtacatctcttttaagccaaaatctgcagatcatcaactggtgcgttattgctagctcatatttcgttttaaaaaaatctggatgcagatttcacgtgctcgttttagtatttcttttcaaaaataaaaatttttattaattcaaatggtttccccgtaaccattgtgattaattcgtgattagttcgccggagtactagttttgcacatgcgcattattattgttcattactaaggcccggtttagttttttttttcacatcggatatacggatacacattttaagtattaaacgtagtctaataattaaataaattacagatcgattcagccaggaaactgcgagacgaatttattaatcttaattaacccgtcattagtaaatgtttactgtagcaccacgttatcaaatcatgacataattaggcttaaaaagattcgtctcgcaatttccatcagaactgtgtaattggttttttttcgtccacatttaatactccatgcatgtgtccaaacattcgatgtgatgggtgaaaagtttttgttttgggaactaaaccaggcttatttccaccatacagtaaccgccagttaattaactaagtaatcagcagattggacgtgtatacaagttctgagatagccttcaattaatcgagatattatattcaagccgtttgatttgccatttgtgtgtataattgcgtcaacgacattagttgagtacgcccatgcctttcgccaattagtaattaaccagacgcttaaattaaataaacatgtttttttactacagctgtatgcagcgcggatcgtgcaaaaatcattaaggcatgtacaaccccacatataggggtgcgtctccaagagcctcgaagttatcatccaaacagatataaagacagctcatacaacccatagacagaggtatgtctgtaagctgtttaatgctttgcatatagttttgatcaattgcaaatacgtttgtgtataccattgtgtatatcaattgcaacctgccgtgctgtcgcctcgggacgacgagtttgtacaacgatgctgagcttgcctcttccgcctcggagcacgggtcgtcgccgtcgcctcgcgagaggacgcagctcccgtcgcttgactcaaccgggttttttttttttttttgcataaaaggcatcacagagacagggcaaaaagacccgctgtacgtgcccttagtgatttcgagttccggccgtatgtttctgatgccgaatttattttaaattcatttggctccccttctgacttttccctaatttctttatgtacagatcatcagtgcataattaatgttgttgatttgatgtgcctacaaagtactcctatatgccttaaccacacataatatatacccggggaatatttctgtttaattttctttaccaaatcaatatatatatcatacgactgttggaggattctcttctgttcatttcaggtatgaactcaactcactaataatttctgtaatgattggaacaacatgctacctaagctagctagctaggagaatacctaagggtgtgttagctactggaggttcccaaccgggaacagggtgcgcggaaaacggaacggtccattagcgcgtgattatttaagtattagctatttttttcaataatggatcaatatgattttttaagcaactttcgtatagaaactttttgcaaaaaacgcactattcagcagtttaaaaagagtgcgcgcggaaaacgaaagggggaagttgggaaccagcagtgccgaacacaccctaaatcactgctacaaaagagatttttctgtgcggcccgaaagaggttttcacatgtggtagggctagcagcacgcgctcaagggtctgcaaaaatcgatatttttgtgtgtgggtgcttatgtcatccgcacgcaaaaataaaaaaccgaaaaaatccaaaaaatagtcgccctcctcgtggtcgctgttgctgggtccggcccgctcccatctctggagccagatccaccgcccccatgcctccccactatcagattcgccgccgccgtgtgaggggagggcggtcgccgtcggatccacgtgggcgacgggtaccatgcctcaccacctttagatccaccgccgccgccatgtggggggaaggcggtcgccgttggatccacgcgggcgatggccgccatgcctcaccaccgccagatccgtcgtcgccgcgcgtggggaaggcgacgccactcccggccacctcctcttccccatcgtcgtcggcagcatcggtggcgcggatccggccatcgcgcgcacacgcggcgaacgaggtggtggatccagccgtcgtgacggtgatgggagtgatacggagccggctgtcacgcgtgctcccaagccgcccgccacccgaagtcacgttgctggagaatatatttttccatcatttttaatttagataaaactgacggggaaacatattctccagatatagccacattgcatgtggccgaagaaagtttccgttggcagccttctttacgcagctgcaagacctagcaattaccctacatggcccaccagcgaaaacatcataacgctagcagttggcggacatcgtagaaagttgtgtattttcattggcttttggtcactggtggcatcgccagctgcccattttgcagtagcgatggtttcaatgttttgttggtagatcaccggaatttttcgattgacactactagaatgtagggcaatcttaaattactattttcctccctccgattccataattcttaatgttttagacaataattaacatggtctccaaatatctttgactagattttttattataatatatacaataaatcaatatatatattttattatattactttgtaagataaatctatatatgttattatagtgccttttaaactaaataattttaaggttattgataattaaattataaaagtttaacatcaattttgtctaaaatgttaagaattatagaatcggggagtaatagatacatgtatgattcttttatgtattttaataaatacgataacataaatatcatgtgttttcttgtagccgcacacaaaaatagaaaacgagatgcatgatccagaaatgcaaaacctcacgcggagtacaatataatgtttagcttgaatcgaaagctaaccatccatttcatgtccctgacaactttcctagataagcttgcttagctctagacgaaacgaacttgaagcattaaatatacacccggatgctaattgagtcgcagtcatgcgtacggccaaacatttcaataaggaatttggagttagtatttgactgatgagaaattttttttaacctgttatgtctctatctcttggcatatcaatgagctattccatcctgtttttcctaaattttcatcgtttaattatttgaaaaggctggtgggacaaagacgaggattaattagacaaattaacatatcttctcaaagcaccattgtatatatttggaaaagctagcaattgatgcatgcatggtgacatcttctgtttcttgggttagaaacaaaaggatttcgtaagataatggagtactgagatattattgtttaggatttgagtccatatcagacgatgatatatattgtccaattttaaagggaattcgtgtaattctctttttggtgtagcttgaagaaaaaagagagtacaaattaatgctccctttcttacatacttaacatatatacatattgttctagctgtgatgtttggataaagcctaaccaatctccacatggatataatatacccttaattaggctctgtttgaaagctcattaagatattttgcttttgtgctgtacgcgaaacaagaaatattattagcttataattaattaagtattaactattacaaacttaaaatatgtttacttaattttttaaaagaaacttctatataaaaaattttttttaacaaacacactgtttaccagtttgggaaatgtgcttatagtaatatggagagagttgcaagagcgaaatgaaacaaatgaatacaccctaatactcataaaatattttatggtttgaacaagatttcgttacactttagaaacttaatttgaccatcaataccttttcaaatatttaatttaaaaaatgatgtgtatttataccttgaaaagtacatcgtagtttcataaagttattaattacttcatccatttcatattataagagtttttaggttttaaatagatacatgcatgcatccatgtatgtgcttcgtatatgtatctaaattcacataaatattactcccttcgtcccaaaatatatgtatttttagactaggacacggtctctgagatgtactttgaccaataatatatatataaataagatgttttaaatgaaaagagttatatattatgatagattatttgatgataaatctactaacatcaattttacatgattgatcttttttattttcttgttattaatagttaaagttgaaattgtttgacttttcactatgctaaacatacttatattttgggacggagggaatactaaatatggacaagaaatgaacagaccaaaacatctttacaatgttaaacagagaaagtagactttataagctttttctaacatagaattgatagttagtgttttgaaagtttgagtgaattttatcatgaacatgtttagaacatttgtgaccagaaggagtatgttgatatctctaaaaaaaaactattgaagtatcatgtacattaaactatgttttccgagctaggttctcctactacatttttttccatttcttttggaaagaatcacaatatatattgtagaagattaaaatgtggatat

SEQ ID NO: 32905 - DNA, 3970 bp, Oryza sativa
acaccattgactttttagtacgtgtttgaccattcgtcttattcaaaaaatttaagtaattatttattattttcatatattcattgttaaatatacttttatgtacacatgtaattttatatatttcataaaatttttttaataagacgaacatgtaaacctgtgcttaaaaagtcaacgatgccaaatattctgagacggatggagtatttctctccgtctgttgtgcgccatatgtcgtggcctgagtggattggagcgatccaacgaccgtgctgcgcccggtgggccccagagtacagacggccacgtaggacaagcagcaccacatccacacgtacgggcaggggccagcgcggcggtggtggccaggtcggtcagccagctgcgtatcttgtctccacgtggtgggcggcaggcaggtgtaaaatgattatttttgctctccgatcttttgcaggcgagtaaaatgatatacacgggctataaaaatttggcacatcgtgccgtacttcggtagagcagaaagggtagaaaaaataaactcttaataagctttaaagaaagatataaattggcttagatattaatgggtagtgtgtagatacgattaagaaaatatatttgttctcgaggagtagtcctcttgtttttacctgtcgtcgaaaacatcatcaaaaaatttgagaaatttaacaagatggatctgaatcgctccaaaaacatacgaatccaaattcaccttatacaagtagaaacaaaaacgcttgactatgagtagaaagtataattcacagtcaaatatataaattgtgtttctgattgtatgtttttaattgtgtattcaaatttaaacttgtatatttctaagtgactatatcatatatcgacatatcttacttttttttgacttaccatatatcaatctatcttatcattttttatgacttctgacatgatatgtacaaaacaaggagatgtccgcttaagggataaaaatccatctccatctatagctacctattgtaccaatgaactatttaagttagttaattaaatgatatgttaatccttgtagctagcagttggctatgtatcaccaccactgaactgtagtctacttactaagtttgtaaagatttttaataactgcggtagatttttcatctggacccatgggaatgggggaaattgcaaataaaaagaaaggaaaattgtatgttctgttcaagtcacagccttcgaaggcgcagctcccatagatgataccgtgagtactaattatttctttcaccaattaatcaatattatccctttctgaaactttggaattggataaatatataaaccttatcatggatcttaaggataggttttaatagtatgcatggttgctagtgctgaccgtcctactattcttcttggagagtaatggactcatgcattgctgtatgatttgattcatcacaaaaaagaaaaagcaatgatctatctagctaattctgtccagctttttcttgcagccctcgcatgggcggtttggcagatccacaacaatgcaagacggcaattaatataaagaacaagaaatttcgtttgtaccattctgaatctctgatgcatgcatgttatgtttaaaattatttcttgcctgcagtcttggagagcctagctagcttggtcaaggagaggatgatatacatacagatgcatgcaaaatcaaattttggatgaaatgttgagtggtatgcgatgagcctttgttgcacaaacttctactagctagaaacatgtgctagcttagtgacatttattgttttttcttctttttttaaatcctcatttatccgtacatgttcaagtgcaactgctatattccctagttgtctgtcattttgtaatgaatatatatatatatatatatatatatatatatatatatatatatatatatatatatattcaacaaaaacaatgaattatacataaaaaaagtataaatatgacaaaataagggagtgtctagatttcagaagaatgaaaatacattcactttcttatcacctggatgacaatctaataggtctcatcagtctccctattacttatttaaacaaaaccctttttttgttaaaatattgaacaacaaattattctaatctaaattcataaaatttagataataaacgtgactaataaaaaattaaaaccatacacaacaagaaaattgcagcacaaatcatacttacatagcactgcaattttaggcctatttagcaataaattttaggtgattaaaaaattatatacaaattttatggcacaaaatctaccaaataccaaaaataaagttttgtatcacaaataactaaataaataaataagtatgcaacaaattcacctttaaaatatatacatcttaattcctaatccatatttttttgagggaatagattcataacgcatatatgagttccgtactacactcttaatcgataaacgatggagattctacatctcacttatttgtgtgaaaagagtggtccaaggcccggcttacccgggatcgctagcgggcacgtatatgatcgctgttgtttatgtgtttacctagactccaaagtatttacagattgaccgcaatatacaattgatctatatttattaatctagatctaattatctaaagatatatcagaatttccaattagccagtttttatcaagacccatacctaaataaatccattgcccatattagattcagagacatattacgagtgaaatgccacacctaacctgacataccccccagcacattgaagaagggcaattaatagagcatagtatattcagtactacccctccttatccagtcctccacgtcaacaaaagaaagaaaaaaaagctcccttgtggaatatccggggtccccaaggggctatccgcgaaaaaggccaagcgcaccgcgacgcacgccacggacgcggggcgaatgttgctctcagtgcaagcgacggccccccgccatggctgactcccccccacgcctcttcctcctcctcctttataagctctcgcgctcgcgctggagctttcaccacgctcgctccatcgattccttgttctagtgtttctattttttatttttggctcaagtttctagcgtttcttgatctgctgctctgcttggttgcgtttcttgatttggttgggattggttgttcttgggcttatcctgtgtagcccgtttcttggattcaaagctcagctcaggtgggaaggaagtcaaagatcccacctggtgaaaacgtacggcgcagccgcagatcgattaattttcgcggaagcgtccccggccatggttgctgccctcaggccgcaggtgctgatctcttcttcaagataggaagcgaaacagagcagagcctgctcgtggaaggagaagctgagtttggctctgcagctgagactatccatctgcgacgaggaggaagaagaaggagctagcgaggatgcggcacatctcgtcgctgctgcaggggctggcgcgctcgctgtcggtggggaaggagaggaaggcggcgacggcgacgacgggaaggcggcggcggcgacggcgacggcggtgctgaggacatcggggacgctgtggggcgagggctctgagacgttcgccgccgtctgctcccgccgcggcgagaagggcatcaaccaggactgctccatcgtctgcgaggtcagtcagattctgctctcctctgcttcttgttcttgctactttgctctctctctgatctgcttgtgaaacaatgatatgatcacaattattggtggcatattagcacgtagtaactagtaacaacaatacaaatggcacatgagagaattccaacatgttaagaaaaagaaagaaattatttctttggttcatatttacagctgatttactactagtcgtctcaaatatg

SEQ ID NO: 32906 - DNA, 5747 bp, Oryza sativa
ttctcatttctgaccacacaagaaagcaaacaaacttcctgttcttatgtactttctattgacttctctctcgattgttcacctaatcttgtgttttagttcgctttgttctcttcatgacaattaacactatttttattattagtccattaactaactagaccagtgattgattaacgacagggtcaatttcagggtcagttaatacatagtttttgaggcatgttgttttaccaagttcttggatctggtgtttgtttttggcttctaggggttttctgatctgtgccaaaagggtcactgattacgtgtcatttatttgctgaagaaacaaggtgttttgggttctttggtatatctcacctttttcagtttgttggtgtctgggattctaaagctgcttttggttagttaaactctgtggctaaggtggatgcatggaaagtagatcacatcaacacattcttgagagttcttcctagatatgatttttggatataatagtttgttatcatcataaaaaggagagagaagagagagaaggaccttcaattagaggatatgtttttcttttcttaatatttacagcagtcattatgtaatgttcacaagcctttcttttttctttataatattgtaaaccagtaagaggtatcatagaataaacagcactggacaaatttggaaggacaggctgcaattagaaaaaatgatcgctcttttctattttatttatttatttattttgcaaccaaaggagtaaggacaaccatgacctaccagctctcaaaagctggcttggttcagttggttcaccatgatgtcacaatggaatctttaattttttgcattaacatgcatgattgtaccctagaacgttaaacaaatactcagagcagaaccacacacgtaatgtcaaaacaccgcaaaacaaaaacgaaaaaaaaaatcaacaagaacaatgtacaatttgatcatattggcttcgtactattccatccatttcttattacaagacgttttattttttttcctaaagctagcaacatttataatatcaaattagtcttattataacagcatttaatatattttgataatatgctagttttgtgtcaaaaatattttttaaaaaaattgattaaatttttaaaagtttaactagaaacaaatgaaaaggacttgtactataaaatagagggagtacaaaatttgacaaaaaaaacaagtaaatattagatttttgagctgaattctgaaccaaagcaaatttgtcttgtgtgtggtcagggattcgggtgcgaggaggggagcgtgttgtgcggcatcttcgacgggcacgggcagtggggccactacgtgcgaaggcggtgagggagtcgctgccgccggcgctgctccggcggtggcgggaggccgtgacgctggcggcgctcatcgacggcggcgagaagcggctctgcgagtgccggcccgacctgtggcgccagtcctacctggccgcctgcgccgccgtcgacgccgagctccgcgccagccgccgcctcgacgccgtccacagcggctgcaccgcgctgtccctcgtcaagcacggcgacctcctcgtcgtcgccaacgtcggcgactcgcgcgccgtcctggccaccgcctcccccgacgacggtggcggcgcccgcctcgccgccgtgcagctcaccgtcgacttcaagcccaacctgccccgtaagttcgccgtcaaacactcacggagacatcttccagtcgtttacatgttataaaaaaattaaaataataaattaatatataatagattactccctgcaaaaaaaaatgtttttctacaacttgtataagttatttattttaaagacaacttgtataagttaaacttgaatggagtcatttatcacatattaagctacgttattgttttctaaaacctttttataaccatttacatgacataaccaacgagaggatgtctctctggagtttagaataatttctctgcttaatataagagtatgtcctaccgctattgctgatgtttgcattgcgtggatgcagaggagagggagaggatcatggagtgcaacgggagggtgcagtgcctcgccgacgagcccggggtgcaccgggtgtggcggccggacagggagggcccaggcctcgccatgtcgcgcgccttcggcgactactgcgtcaaggattacggcgtcatctcggcgccggaggtgacgcaccgccggatcaccgcccaggaccacttcgtcatcctcgccaccgacggggtaaacaaacaaacaaaatacatatacttatcatctctattttttttaatatatgacatccttaattcttattaaaaaaatttaagtaaatatcttgttttttttacttgatttatcgaattttaagcaatattaatatttttaagatttgcatatattcttttaaataagacgaataatcaaatgttacaaaagaaaatcatcaatgttatatattaagaaatggagagagtacaaaataaaattcattccatttttttaggacaaacatctcaacttgttcgtcttcgtctgcgcggcaggtgtgggacgtggtgtcgaacgaggaggcggtgcagatcgtggcgtcggcgccggagagggagaaggcggcgaagcggctcgtcgagttcgccgtccgggcatggaggcgcaagcgccggggcatcgccgtcgacgactgctcggcgatctgcctcttcttccactcgccgccgtcctaaacaacacacacgctgacacgcacgcagccaacaaaaaccgcacacgccgacgacaatgtcgccgtcgtcgttgagaggcgccacaaaaaggaaaaaaaaacgcagattgttacatgccagaagaacaatgcaatttgccgccatgattgggacggtgcacgattgacctgacctgccggtgatgaactctgctgctgctagtggatgaccgggaaaaatccaatcctccggctttcacaccaccgtcattgtcaaaaagttgtccgagattcaattcaacagcagccacaagaaaaaggcagggaaaaaaaagatgcattttgtcctcatttttttttttctgcatgtatcatatggctccagaatttctgtggtggtggtggtggtgacaaaatagtcactgttattgttgtggtacatcaatcattcaactctcccatgaagagggtcatgaatcacaatcttcctctgaaagtctgaacactatgtggcccgaaaaattggaattttggtagtattatgcactgaagcatcagggattatttagcagaattgtgaggaacaccaccaaccgtcagatttgagcgacagcgaagcggatggaagttcgatccatggtggctgtgggagtcgacggagtcgtcttcgtggagctagctagctcgctagctacccgccatagcggctttttagcgattctggaggctcctcttccatgatgccggctccggtagtggccaggtattcccttattgtggttgtccggtcacccagataggtgtggtctaggaagttgctgtatgctggttctccaagatttttcgcagcgaggacactgcaaattaagcaatcagtatcgtgaaaggcgactctaatagcagaatggccaagattcaacatgcctaacaaagtaatggctgataatgacatttcaatagaaaatgtgctgctaatggatagttcaaaacaatgatttccctttgcttcagaaatgcatctcactttgagatgacccaaagcaatagcattttggttagaaatgcatcttgctttgacatgccatcgatgggctgtacccactggaataaaaaaataaaatgcctaaccagtggagttaatcagttgataggtgttcagtggtttcaaatagaacaagatacattttatgatgttaatcataggccaatttaagttactaaaaaaacaactctgcagactgcacataagatgttagaacagaaagcactcaccaatgtctaagataagcacgacagggtaaaatatcgtctctccatattctatcaatgttgtatcggccatagcgctgataatatatttccttgcttcctacagaaagaatcatgtagtatggaattagacacaaaattataattctgagctgtctactgcaatccctgaaagtaaataccttacacctgcctaagaatgcattaatttgacatggacgtgtaagggaagcatccaaactaacacaataaatctaatatctgacaaaggaaatcaactaaatgtcccagtattcacagttaaaaaaaagcacacataacaacaatcttatagaatctgataggatgtcagatgaagtcaagaacagattagtctttactcaaaacacgaacaatttatatcctgtaatagacctaacactgtaaccaaattatgaaacctcatcaacatacgaaacaagagtaacactaactgtccagaattgtcataacacagatatccataccagtatagtcaatggcaagatattaaaatgaaatgtacaactgatgagaaaatctggttgtgatatagattcaacctttgcatctcacttggaaatattcttcatcgctatagcgtgcacagacaacctgaatcaaagcagaaaaaataattccattgcagggggcagcagctgaacaaaacaagacactacagctagaattgcagtaacagaatataagcccttactgctggatttgcataaggcaccccatccagtccttctggaacaacctgacagcatattagagataaagaaaaattaactgcaaataatcataaaagacagcctaaattacagaccaggacttaaaaaatctaagctccaaacagcttgaggtttccaatgaagaaactgaaaatctaactaaataggttagcatccaatgaattatttggcacctaccgcaagaaacctaaactcatgctccctctcgatgaatgctgggacctgaaaatatcacttttcaatccttcctcagcaaaaataggttcaaaaaagctccattcctttgccttaacagatgtgaagcattatcacagggtataaaccacaatacctcatcctcctttatttcaaacacagtgacaacgatcagttcaccctcacatggctccacacttaagcttgagaactcctacaagtcagtccggtgctccagtgaaaatgagagatttatcataaatccaagaagcaaatgcagattcctaacaaaagcacttactagactacacaacttcaatcaaacaaatcaatcacagaatttttttttcatagcttaaaaaagcactctgcttccattcgttcactggccataatgagcaaaagcaaacaatccccaaatgcatattgcagaaaagctcactcaagcagaaactaaattttatcatgcttgtaaaatgcaaccttatagcctaggtagtagtttcccccacttttgatgtcacgccaaactataattccattccaaattgagaaacatgtgattcgatagtttcatttcatatggtaatcaacttgtagctccatttcttttgcttctttttagcatctacagtctgcagcgcacactctaacagtagcaactgagtccctgaccttggtggcctcgatggcgatgccgcgctcgaagaagatcggggcggagtgggcgaagacgcggcggaacccgcgcagcgccgc

SEQ ID NO: 32907 - DNA, 2493 bp, Oryza sativa
taaggcgatccgggccgttggattttgatcgatcggctccgggtggcccagggcggagcgtgcaggcggattcggcgacgccaagcattattctgttttgatgactatgctgtaaatgttggatatgctcctccatataccagttcagacttcagagacgaaaattagtactctgtatatataatttgtattagttaaaaatagaatctttatcggtatttttattttttttcttcagtcactttactctattatattaaatcttgtttgtaatcgaccgacgaccatctctctatctataagtgtgcctctaatccatttattcatgtctctaatactactactcaccgttgctcactgctcctctttctctcctaccacacaaatgtggccagggacggagctagaacgaaatggagggtatcacttgcttaatttactttaactttagatcaagtttaaactgatttaggtgtctaagtttgtattgagggagtgcacacatggtaaaaataggtgagattcagctaaattttttttaccgggttcctgggcaccccctcacatactctaccttcacccctgagtatcgtgatacaactaatagccgctcgtcctcaccgataagggtggcgcaacttcaaacattagcacgtccataaagctttaaagtttagtagtttggattgttgccatgaggtatatgttgggagcagagtgaccttctatctattttatcttggtccctattcccaataacaaaaaatgcacatggagaataggggatggtggcaaggtgcatatttgaagagatcagtggatcccaggggccgctaggctaaatgttatgggcaagaaagagaaatcaagattaaagttacagatgaaatcctaataatcaagctttcaccctgaatatctgaacattttgttgcctggcattacgagaaaaatggtatctcagtgcacagtgcttataaattgacgctaacagaaatagaactaaaagagggaaattcttctagcaacactaataacgggagtagatattataggtccatgatctggatagcaaacgtgccccagaaagttagagtgttcgtttggcgcctcgcacgagaaaatctgcctactcaggctaataagtttcaacggcaattagtgacatcaaaaattgcacaatagttttcatgtagtggtgagatgcacaaaagccaaagctttgcgacatgctctgcgcaagatttggggtctcccagggggaagctcttttttaatttttctgggtcggattggctgcttatgcttctaagctccgtactagctaaatccctttagctggtttggagagcttggtatttacgtaatgatgttgtccattgcaaaggtgaggaggtgttgggtatatctgcaacatttttacaagctaccatggctcatttgtgcaagccatgggacaagaacctgatcagaaaggaaaagtagttttgagtgaagtatagattagttccctaaacctgaagataaatagaactttaggcattggttgcagttcatgggaattgccagaacttggttgggctaatattaatgttgatggtgctttttgtgcaggctcaggcaatgcgggtattggcataatcattcatatagttccggttcagtcttgttatcgtcttgaaagtacattcgccacagggcgtcggcggaagaattagaacggtttgcttgtaaggaaggtttagagctggacgtcgaatgggtgcatatacaccagtagtgctagaaacaaattgcatgtttgtagttaatgcactaaagccgcactaagagaatcaatcctaatggtgttatactatcgccgagatgcaaagtacagaggagttgctagtagaggtgaagattcgtcatgttagaaagatgttgcaataggatagctcatgagttagcacggctggctagtagaagaaaacattgtgcggcatgatgggagtatgtttccacttgcatacaaggccttattctcaaagattgtaatagccatgtttcttgtgagtaaagcacactctttctaaaaaaaatcgccactagttcataggggtgggcgtaaaattaattatggaaaaccgatctatcgacttaaccaaacagttttccgatcttgcatttttttcgtcaattttagttcaatcttgggtgttttcgcatggttctctattttgacaaacgacgaagccaaacaattgaggcccgcttaatttacattattaagtgaattattgctatagattttatgcacgaaacaaataaatcatttcaataactcggtgaataagttaaaaacaaacaggcccgaatcacatatgtgcaccaaaatgaaaaggtacactggaggtccctcatcttgtcaccttacaaaatcgtccttgaaccacaaaaccggatacaacacatccctcaacttacaaaaccagcgtaaacgagatccctcgc

SEQ ID NO: 32908 - DNA, 5201 bp, Oryza sativa
cccgatccccccaacttccccctccccagcgccaccttcccccaccccaccccgaaacccaaccactaaccctagttgtcgtgacgcggtcggaaaacgcgcgcgacttctctccctacctggccatcgccaccccggcgcggcactgcccttctgtgtgctagtaccttgatctgattgtgtgctgaatcttctctctctctttctctctctgttcaatgctctatgctctatctttctctctttctacttctcctttttttattattttcttcgagcgaaaatatttttaagttctttgctagcagttctggtttattagatgaagcacaaaggataacgagtagctcttcagtactccagtttgttttttcaattccggtgatgcattttgtcctacgtttgcctttgaaagtgtgtaacgaatggtcatcagttgcagcctaaaatacgctgtaatttcatttcctctatgtttcacatcgacgtttttcaaaccaagcaccatctttatctcatcgtactcttttttgttttctgttttaccagtttttttttacagttcttgatctgaaacggagacaatggcgagagaggatgagaaggctgacgcaatggagattgatgggcagcatcagcaagtggccaacaccgccgtaccagatggcttcaatgctgattacctcaggatctactatggtacagtagtgcttccctttttcttctaatccgccactgaaatttaagaaactaggcaccagacagtgtgctctttttgctgattattttctctttgtcttggataatccgcagaaagctgcgatcttgaagcaaaatatttttctagaacacactggagcaaaatattttggcatatatatacactgtaatagtggttgtaggtaatctatatgctttctccatggaaaaatgtcgcaacttcttgcaactgcagtccagaataatagttattggtctgtgcagttcaaatggttttaactaaaagatgcttaatttaatatcacagttgatctgccatataatttccacttaaacaattgtgatggccaactgccagtgctaatggttttgtatgtatgctacaattgcaggaaagctcttccctcatgttgatttcttcaagtggctttcatatggaaatggtctgttgttgttggttcaggatctagttgtttactaattgtttcatctatataatacgaatttgtccttttttagacgggaaacatccaggatgtgatcagtcgtatgttggacgtcgagagttctcatttacactagagaatgacatctacgttcgtttccagtcctttgatagcgtggctgaaatggagaactctatcaaggaaaagtgccctttcaagattgatattggacctgtatatagtgtagatgtatgttgtgtaatcacttaacttggacattattttttttatgtgagtttgattttccgcattaagctctgttttttcaatatcttgatgaaaactgtttattttgtagcctgcaaagcggcatgcctatgctcaatcaggcaacaacgtctttgtgccagttgagagagaacttattttcgatatagtaagaaacctgcaaaatttctcctgtggattttatttgtatttttcatcaagcatctgttccaagctgtgaggcatttcaacatcacaggatatatcagattacgatgatgttcgctattgctgctctggagctgatgtctgcatggagtgctggcctttaatgaccattgctatcaaaatcttggatgcttcacttagaggcatgttgttttgcaatgcaattaattaaacacacatgcaaacactcgcttttatttcagtttaattgacttgaattgcagatctttagtcaactattttcttggttagtttgacttgtaacaattgaaagtatgtgtttacagatgattttggtttcaatcacatattgtgggtatatagtggtcgtcgtggtgtccattgctgggtttgtgatagtagagcaagaaagtatgcatgatgtttttccctttttcatttctccatttagtttggtgatcctaaaatgctctggtactttcctgttaggctcaacaacgaacaaagggctgcaattgctgattattttcgcgtctacaaggtggtattcctttattcatgatcctagatgtcgttttgttgctgaaatcttcctgtatggatcttttgcagggtggtgaaaatacgatgaagaaagtttcattgactggagctgttctccatcctttccttgcgtatgtctgaatgatctcagttccttgtttttcaatcataagttgaaattgtatatgttttatcagtacaaattgaaatatagccaaataggctgtaatgaaactctattttcctacagacggtcatacactgatgttctgaaaggcttctttgaagataagctactacttagccaacaactatttgcatctgaggagagatatcagaaaatacttgatcttatccctgatgaaagtaagaatgcaaaccttaactagaacaatatattttagtatcatcctgctatcaaaccatttctcatttgtcaagtcttgaatgtcttcaatcattgtaaagtgtgtgtcatttctagatgttgctagtgagctccatgataagtggcaaggaaacagacgatcttctatttcaaaggaagatgtaaatgctaccaggtgggagcaactaaagtcaaccttgcagtcaggaaaacacaaggtccatgcataatctctcgcaatcctacttaattttatttgcacatttactggtgtatcagttttaatcatatcgagtattgtattctcgaggtttcatcacaatgttacatgtgggattggttgctaattttcattctattttgttgaatgcacaatgatgttttttttttcatgtttcttccacaggggcttcgaagatgtatagaagagattgtcttctcatacacatatcctagacttgatatggaggtaaaagcaaaacgatcaacagcacatgtttgcagcaagtcataaattcattttctgattcctattcgacattctggtgcatatcaggtttctaagcacatgaatcatttgctgaaagcacccttttgcatacacccgaagacaggttagacccaagtatatttcctattttttcatctaatgaatgaagatacttgtttgcactagaaactgtttttgttggctgtccgtgtgtatacacttcgtgtatccgttggaaatctctaatgcaaatgttccttgagtgacacatttttcacatttatatgcattcatttcatgcttacacttatacgtaaaatatgttctgcctaatgagttctaagttctaacaattgttttgaaatctttccctaggccgtgtttgtgttccaatcgatccaaataactgtgatgattttgatcctacgacagttccaactctgtcacaggtgtgtccttagagccaagcattaaaaaaaacaatattctgagatctaatttacctttggaagcatcattatgctaaactgacttgttgaaactgttgaacttaaccagcttttgggtgagctcaatgcagctggtcttcgtactgattctgaaaacggcaagtgataaattcttcacttttaggaatcctgtgtttaactatttcatcctaaaactttcagtgatcttttgataatcctttaatggactacagattgggaaagaacatctcttgaaaaatctatcaggtttttcagggcatcgtttctgcaaccattgctgaaagcctgcaaggtatgcagtatttccttctacatttctatggcaggaaactggatatgcttgtttagttcccagtcaatctcttccatatcttaaactgaatggatcgggccctatactcgtatctactctcgctacagcgctttgcttgcaagaaatcgtctgtgttcttctggttccatagttttccagggtcaagtctcagtttctgccttgtaatgttgcaggaggaattagaaagctcatacaatgccaagctccagcagtccaagaataccttgacttggtaaaattcactcaacttccagctgatcttaccaacctagtgccccatgaaaagcttcttctccatgagacgaaccactgaacccggcattggctgtgttaactggttaaccacaacgctctatgaatgaggagcaaaatactctccgatgctgctgtcatgttagctttgctccaaggaagttgcaattgtagaatatccagtgaccgtcttagaggcagcttggtgctggcttgaaccttttgatctttcatgttgctgacttgatgttattaggataaattcctttaattgttgtgaaatgaattttataggattcctataagtcgctgaaaagaatgattgttaaatgcttcataccaagctagtagccgctataagatctagactagaattagtaaaattaaccatcaagattgcttagagcaatgctcggtttgtggttgatgactgttgagaatttctgtaagatgctgtaaaaataaaagtttcatcgtagtttattttacatatagaatttaatatggcaatatggcattcaattaccatattctccgctaataatatgttgctatgtttttgtcaaactgaaataagttctaaccttaaaaaaacaaagttaaaacatctcatggcctgtttggcggcttgtcaaagcgccgcctagcagccggacgctagttctgtggacacatttgttaagaaagtaggtataattaaatgatgaaaatgtgtgattggttgaaaattggaggtaggtggggaaattgaattgtggaggtttgtgattggttgaaaatgaaatgttggtagagaagttatattttaggataaattctaaaggctaaatgttatatttttgggacggatggagtaaacaactgttggctgtcaataagcgctgaatgttgcagccaaacagacccttataatataaaacggaaggattatttacaagagtggttgggtgtgttactgtccaaactaatttttttcatgtgatgctaatttatacaattatactacactgttaaacagaccccgtctctgtctgatccattccgtcatggatggaatcatgtgaccaggatagtgatgtac

SEQ ID NO: 32909 - DNA, 3661 bp, Oryza sativa
atatcttcatgatatgttgaccgctgacaaacggttctttggctttggcaatgggagcaagagcaggacgtgttagtgacagtgttgaggatggcctctctccatcgaactccctccggcgtcaaatccaagtcagcttcgattccttgcctcctctgctgccatcgtccgaccatgccgctacttggccttgtcgacgccaaaaggtgttaatggccgggaagtccaacctgttcctcttccccttcccctcactttgctctcaccatcaacaccgacacaccaccagctgttgacctcatggtttcacccactgccagtccgccgcctcaccactcgcccttgttctcctccaaccaccgtatcgccgcctcctagaccatccctctaagcctgatcctcacctccccatcccagcatcacccttctcccaaacccacccctgaaccctaacctgagcatttatcataacgttgtcaggacatgttcacgagatgcccatatcgcatacgtccgtagcttaggctttctgagataggtgcaccacatatatgtagagctagtcacttgtgtaggcttgtagttatatactagctcgttgctggtcgttgtctgaatgtgtccctaactcactaataacatatttctttatcaaacgaactgaaagacctagtattatattgtgattccattttacagtgcccttacatcggtaggccttcagcttataacatatagccaaatttgaattttataattaatctagaaacttttcatctatccctttctattttctagccttgatttttgggtgttacgagtaagagtgtaagtgtatggaaatctttgccctcggatgatttttgttgcttcgttaatttttatcaacttataatcaataggagctacgtgaggtaattgtattggttttgttaaaaaaatattagcatcctggtagctacactggaacataattataatgttgcccatatttccaacacgctaacacaaaagtactgagtggtaacaattatacaagatcgtgtgtactaatcgatagattgtggctcatttaacgagccagatgggggataacttcagaactcataagtcatggagaatactcacataaccgggtctatctacaaagcgcggtttctttgatcaatcgacataaactgcataaaaagcttgggcttcgagaaagtgtgaactctttgattgactaatcgtgcaaaacagagtttgggcatatgatatattggcaatccgttgttagccaaatagcacttactaatgttgggatacacataggctacaatagtataaatcaaaatttttttaccatgtaaaccaggaaccaagcaagtataaaatcatgaatcgttaccactcgacacgttgtgcagtggaagtaggtgctaataagccgaaggaacattggcgacgtagcgtgcgtcaatgttgaggaagtagtcgatcgcagcagcccgaccttctgctcctcgtgcgttcgcctcactgtgctaccacgccaattagcaccgcaaaccagcggcgcctctacaggtatccacacgtccatggatggaacgccatgcgcggacgtgctagcgcccgcgtgtggctagggtttggctcgagagaagagtgacggctagggtttctcacagaacaccagtcacatcacctcaagaatatatagaatccataactgggccttcgaggcccataagagtcctactcagattcctatccgaattgagcacatattgaatctttatccaatccccttattccgacccgttaagtgtgcgaccccatagattcatgtacactcggctgcaacccgaaaactccttttcggtccacatgtcaacagcggctactagcagaatatattgacccatcagacatacataaagatcatatcggctgaacctctagtgtacacttgtatgaacccttttgcctcatgatatcgattaggcttaaggctagatatgtgccatcctttaatagctcaatcattcactcgatcttgtgatagattatttaacctgtgattgactcctcaataatttttggcatgatcatatatttccataatctataacatcgagggacccatgatatcttttcatagaagaggcaaatcccatcatgattattcatatcccactacatgtttcatagcataccaaaagattacttttataactactcaatcacagagtagcatttggcagcccctaagtaagctactgcatatgttgggaatcatgataatcttaggactaaaggattctacaccaacactaaatgagatcaccgatggcacgtcatatataacttttacagtgtctcatgttgggtctatccaacaacatgttccctaacatgtgtccacattattaatttggtatctccataccatgattcatgatacatgatcgtcaatcaatacacgtgctgatcattaaaccatatttgttccatatatgatatttgatcaaggatcctttagaaatagcaacatacaacataaagagtcttatgaacaaataacatattcattaaccaataatgagttatatatttcaaggaacaatgtatgataaatatgtaaacatattatgtgatacaatcatctctataattgcctttaggacatatcaccaacaactgcctcctcagccgatacaccccgaagacatcgttccacctgcttgcaaaatgccgatatacgagaagagtgtggtccctcttatttgcatagaccacacatgaatagctacatccggtaacgtggagcgcaaccaacacggtgcacgagtgatggtttcttagtggcatctacataagggttgccaaaaaagagtatgtatgcttatcctgttgactataagaaaattttggaaggagaaaaaactagagagtttttctttttttaagggaaacaagcacgagagtgtgcaattttcattaaatatagcgggagaaaaatacagcccttaagggcaagaaaaggtaaaagctaaaggaagaaaatctatacactatacaaggtgtggtataagcccacgtaggtattttgccaccaccagaaaccaaagagtttttcagcccaaagaaataccggcactgttttcgctcacgaaaatcaaggagataaagacttggactctagcaggggcaaaacgtctgtctaagttcgttccttatgagagctactatacgtacgatattccacgtacgaagctcatacgaagtaatgtttttaacggaaaccagtcatgttgtccagccgtttcctagcgatgcaacgagtaacgttcgccaccgtcagcaatcatacgagagtcgtacataacagtcgtatgcatagtattttcacactactagaaaaagcattttttccaacgtgagggccttattttcacaggcggacatgacccttagagccaaatgactgtctataaaaatataaattcgggtgaaatttgatgcccgcttgattttcgcaggcggaccacttaagcggcgcctgcgaaaatcgcaggcaccatcgcaggcgccacttaagtggtccacctgcgaaaatagacttgaatataaatagacttgcgggccctaatttttttctaagtcctcacactct

SEQ ID NO: 32910 - DNA, 9741 bp, Oryza sativa
tgtacagatcccatgtgaaaaaaaatcagggcgatgatcccctgatcccatctggacgtacacgcacgaacgtcggcatgcacccggttggttggtagctcctcggcgaaatcatcaaacgaatgaatgcgcgcttgagtcagtgcgcatatgcactggagttgggacacgtggccggggcctgcaggctcgtctcgtcacagcaaatgctgctagctatactccctgcatcccagaaggtagcatgggtctaatcctatcaagatagaggtagtagtgatactctttatgctaaaataataaatataaaatagattatgatatatgctcagattaattatacagtgcaagacgatgtatgtttatattgtaaaacagaggaagtagtagtatttaatttaaagttgatttattttgaaacaaatacgtactacgtggtgacgaccggttggaccgggaccggattcactgcgatgcagccaaagcagtagttccatgattttgctctccgttattgcttgcagagtggagcagcgaaccagtggggtttggtatggtttccagtggttgcttccgctacctctttgcacctactttcgggcgcattgaacaactgccatgtcttcgagcaggtaaaaaggctataagccggctataaacatattttaaagaaataaagctaggaagagagaaaaaacagcaggctacagatctgtagctagctatagcacggactccaagatgtaatgtgtgtatgataggtgggaccatgtattaatagtatagtaagcaactattatatgaattgactattatattggctatagatgatttgaagctactactagtaggctacactattaaacttgctcttctcaagctacttcaagctttttatttctggtgagtggtgaccattcctagtttcctacccctcatgtttttctttctttatttttacagcggttaaaaatcatcagtgcgagcgacatggaatggaggtaaaatgttgtgacaatttgttagggaaaaacataaaatgtaactttgttcaggtgattggtaatccgtaaaaaaatataaacgaagcaactaaaattaatttacgaatgaacctccatagctgtattcccatctatttagaaggcaatgatatataaaatataaattactcctttccaatcctaagttaaatattttaatttttaactatccatttttataaactcatatagtttaatgtcataagataacttaggataaacgtggaacaaaagttacacttttcaatctgttaaacaatatgtttttttaaaagttttctttacgaaagttgttttaaaaaaaatcttattaatctatttttgaaaaaaataactaatacttaattaatcatacattgttactctgttttacatgccagagggatgagttctcaattcaaccgaacgaacacaaccgtaatatgattaaaaaaaaccccttaaatcaactctagaattaaaattaagttttaaaatttaaattttggttgggttggctggtaaaccacaaacaaacgttggagctgaccttgaagccttctagaagacaaagggaatcagagctaaacataaccaaagggatcactagcttctcttcctctctctctctttgtttttaagatagatcatgcgtttgactctagtacaagtgtagtgccgctaccgaattctcgctgtcctcctcgcagccatttttatacgccaacctcctcttctcttctcttctccaagaaaccacagccaggctagcttagcgcgcgccatggccggaggagacggcgccacctacaagggcggcatcaaggcctactggaagcgccggggctacggccggctcgatcccgcctcctccgcgcaccgccgcccgcgcctccccaccgcggagctcggcgacggccgcggcgcggcaggaggagcggggcggtggcggcgagggtggcgagtacgccgccgcgggctcgggcggcggatcctgcgggcgctctcgccgcggcggctgctggcgcgcctccgcgacgcgtacgtgcggggcatgctccgcctcgcgtcctccgccgccgtcgccggcggcggctccgctctgtacggcggccccgccggcggcgccgaccccttcgggcggccgcggccgctcagggagtacgacgagaaggcgctggtggagatctaccggtccatcctcgcgcgcggtggcggcggcggcggcggggtcgtccccgtcgccggcgacgccgccgcggtggtcgccgtggcgcggctgcccacggtggcgggagcgtgaccgccgccggatttggcgcgaatccgaagctttgtcacgctcttttttttttctttttcttccctttttcccctcttaatttctctcatgcaagacttgtgatccagaattttcgtactgctgtcctaatcgtgtctgttaattaatcttctttaaatctgggggctgcaattttgcagtgtattattcgcacgtctaattatgcgatactgggttaaattaatcttcttaacggacagcgattaattgagttcaagaacgagtaaaagtgtaaatttacttgtatgttttactcatcgatacaaagacttcgaagaaatcattttaattatacttgcggtagaacatcctagtatagatatccgcgatgtccatagcacacgcactacggcactacaatcctaatagtgtaatccattttttagaaaattgaggtgctagcggccgcatccgttaatcatttcgactaaattatgtgcatgacattgttttttttttggggtgtgaacatgatcttaaaatacaattagaggcttataggaatctagagatattgatggttgtgacaaattttatttatttgaatagaaccccttctccctctcacaagtcacacctccacctccattatgaacactagaggactattagaggtagaggagcacatcacaataatagcaaaagatggagttgcaaactggaagatgataatgctagtgaaacaaactactcaggtactcgcagctattacaatttagaaaaaaaggttcatcgcttatcctctctaatgatgctttgtaattacaggtcaactcaacgtttctacactctacactgtaggggtacgtaaggcctgacgatgacttctcaggtttattttacggattaagtataatattccccctgtcccataatataagggattttgaagggatacgacacttcctagactatgaatctaaataggctctctgaccagattcatagttctagaaagtgtcacatcctctaaaatctcttatattataggacagaggcaatatttgttcatgatatttgtggcacccggttacacttactgtactgctcttaaataatcgtcatgacattctcacttctctctctggaacgatgtgtacatatgctaaaacaagtggaaaattgcttgtgtcacaaagtctattagccattggttgctaatgtctattagctcatttaaattagaaaaaatatagacgactgttgataaatgatctacttgtgtatagaaataaatcaaatattatatatattacaaacctaataaagctaatcaagaaatgttgctatagaaaggtttggagcaatacttttgaaagtgttcaagaaatgttatcctcacgtcgcattattttatcatttccggtggaaactgagagagaaacattggttaaagacaagtttgctcatgaacccacttgtcaatatcacatatcctctctttctctcttcctcttcttcctcatgttgttgccttctctctcttatctctctcttcctcttcctcttccccttcagtcaggagcgaggcatcgccgatgagcagcgatgggggcagaggggattgcggcaatgagcgacgatggttaagggagcgaagggagccgacaaccccgtcctcacctcctccatcgccacgccctccactcatcttcttccgcgtcactggatcacgcacccgcttgctggcttcgtcgccaagaactgcaagcgcatgggggaaggtgtgtcccagctgtcttcgtgctcctcttccacgaacgcctgcagccgccggaggaagggagtgaatgggacttcttcctttgtccgttggcctcaccacgtctcccaccagctcatcggcctctccgccattagcatcctctcccgcgcccactgtctcctctgttgccaccgccgttgtcgccgtttggctaaaaagctggcccccaaacccatcctttgctgctcagtattgtgctggagcaggaagaagacacagtcaccaggggcacattcgtacttttcacagtttctctcttcatttgcaccaaatataataaaataataggtccgatgtccaatagctaattaccaagttttatctatgtccatgagaatgtacacgttctttgggtggccgtgtctcgtagcaaaggccacattagaatgtactatagcaaattttgccttattgttcctatgcatgggaaaaatctatgggtgttcgttaaaaaaaaaagggaaatcaccgtgtagcccaatctggcccataagcttttacaaggcggaataagtctatattgcctccctcaactcttgccttgaatcgtccccctcaaccgcaatacctggtataacgcctcctctatgtttgaaaaccagagcaaattagcacccttggctgtttagatagcgatttcatcatacatgacacttataggacccacatgtcagtcagaaaaaataaaaaaaaaataataatcctacatgtcagccattctaatcttaattatttttcttttccctcgtctctctccgacgaggcgacgacgacccgtctgcccgtccgtccgctccttcctcggctggagccagcagttcagttgttcggctgccgccacccctgttgccaggctccctacgaaggccacgagcctgttggaacaaatcatgacttgcatatgtctttggtttttgcattagttgcatgtagagaggaacgtgatatgttcatgtatcttgtaagtgatgtgtatgtgtgcatcacgtaggttccatgtttgcatgtagaatcagtcagtgctagtgaatggcagctgcgtgtgttgcagcacaactagcaactaaacaggttaggtgaataacaagattagcggcaagttagttaggagcatgcaggattagtggagcacgttgtggcgtggctcgcggtcagcccggaggagcgaatcttggcgtaagatgcgcagatcgttgtatgagtgagtggctcgtagtcgtgcgtgcgacccggccgggctgttagctatgtgcatgtacgggaggctatataagccgtgtaatcatcagttagttttagcagatcagcaatatcagagaagccagcaaagacgtgcgtcgccgacggaatctgttgtgtgtgtgtccacccaatttgctgctcgtgtgtgttctcccgtgagtttgttgcttacgtgagtttgtgattttcttgggccaaagctaacagagcccacgacagcgcctggggcgagggacgacagcacgcggaaggcctcctgtagcccgttgacctcgcgcctcctggtcatcgacgccgcccaaggcaccatgcccactggatttgtgcgtgacgaggccaagggaggcaaatctggtggcgtcgcgcccctccgccgcccggcggcacatgtcccgtgctccttcaccgctaggagtgcttcgagcaagaataggggtggaggagtgctcgcgacaagaagtctacgaaaaggcaccgacaccggcgagaggtggcaagaagtgctgtaacgcatgtctttcaggctctcatcactcacctctcgtctcgctagcaatgtcacaccaaatcctcaacacctcagcacacattcaccaccgcgccctgcatcggcgacttgccagtcacggccaagccttccaggatgttagcagggaaaatcaccattggcctcttcggcgacgaggtccccgccggtgcgtcccggctcctgtcgcttggtgtcggctagttaagatagtgtggggctacatgcaagcaggacggtgtggtgtcacacccggccatcccggcgctgaccgaccggctagcggcgaagatggacgccgcacgcgcgcgcaatgcgatggggacaggagtggcgtccacccaactcccacggcatatggtgacggccggcgaggcagcggcggctgaacaactgagcttctagcttccgtcgaggaagaagcgaccgaacgggagagggagagagagaggaggaagagagaagcgaggaaaaagaaaaaaaaacaaataagtgccacgtaggacatgtggggttattgttttttcttttcactgacatgcgggtcccctaagtgccacataggatgaaaccgctatcaaacagccgagggactcaatctgctctggttttcaaagatggaggagacgttatacccggtattgcgattgagggaggttatttaatcaggggcaagagttgagggaggcaatttatacttattccttacaaggcagggtccgacatttccagcccaaaagaatcggacccatttattcggcccaatctggcccatgctcggggcctagtttttccaggtaaagttgaccaaaagtcttcacctagtcgtcgtcttccctcggccggcctgaccatgaaaataaacgctacccaacgactccgcagtcacctcaccacacgtcgatggacacggcgcaccagtgaaccccctcggccccaccaaccaccaccaccatcaacatcctaccttacctctctctggcaaccgggtcccacctaaggtccacgctacacccggtccaccaacacccgtgggccccaccgctctctcgtcgtcgcaccgaccccaaccgaagcggtaacaaagccaacgtcccaccaccaccacacgcgcgcgctcgcacagacacacacacagcacagcggagaaagagagagagagagagagaaaggaaaaatcggcaccaccgcgaaagggggaaaaggggggaaggaagcgaggcgaggctagggtttcgattcgatcccgccgctgccatggacgccggtgatgcgtggggccgctcctcctcctcatcctcctccgccgccgccgccgccaggcgcctgcaggcgcgctacggtaagctcacacgacgacgggtcggctttctctcgatccatcggtcgatctccccagctgttggattgccatgggctgcgatttgatgcgtgggtggtggtggtggatgtgtgtgggtgttggctcagatctgtacatggggttcgacgacgcggacgcggcgggcgtggaggaggtggaggcgcgcggcggcggggaggcgtacaactgccccttctgcggcgaggacttcgacttcgtcgccttctgctgccacgtcgacgacgagcacgccgtcgaggccaagagcggggtatatgccacatcctcccatctgacaccgattgtaaccgtcagtatcagattgttgtgtttgtgattggttggatacttggaccgggccttggtttcggaaatgtgcaattcgtaggcacgcgtgcaaattttttttttagaacaggatgcctccgcaggtatcaacagatttcaactgtgacgaaccaagaccagcgaaagcttgcaggttttaggagttggaattttggactttttggttggagttataagattggttgttttggggtttgggtaggtgtcttcgtttgcttgattggagaaaaataattcgtagtggctatccatgtcggggagaatgattgattttaattttggggggtttagttggggacttgagttttttctgtctttggggggagtttgggactggcggaaaacatttcttgtgttgttcatgctagtcattagcctattacactctactgtagtttttatttattttctttcttgttcttagtatctgatgaaatatgttctctcagctttctttattttttgtaaatctgtggtcattttgcagctattaagatcccagctctattctctccagattataaagcacatcagcacttgtttctcttgaaagtgaaacatccataccaaactgacaatattacatattttcatttcaatctaacaatattacatattttcattcaatctaacaatatgatgattgttcttggcttggtggttaggattattatttgtctatggaagaaaagagtggtactaactagtgatcactttatgttttgtgattgggacttgttcatgattaatagtgggattcagtacaacttattacaatatcctttatgaactagttcaccagttcccttgcttcgatcacaaaaatgggcataacttttctttgttttgtcttaggtggtgaagctcattgaaattgcaggaattttcatgttttattgctttcgtaggatcgtttacattatatttggatttgtgagatacaccctttgattaatatttgaaattatgatggtgcttggatacgagggaaggaagtttagatggttactggtattgttttatctggtgctggtttaggaaattctcttttatctatttctattttctaagatgtttttctcagatattggttgttagttctgaccatcttttgtaaataaaaataacagcttttgtctgttgtatcagaatacctgtataattagtgttgatattggcatctttgtggtactatgtaaatattgggtagctgccaagctggatagtttctgggtatgtattagtaacgttggatttgtgacattttatttggtggtgatgtactttggtctatctttttgtgatgctattatttgtgcctcatctatataaccatgcccgagagctttcttgatatattcaagtcagtttatgaattgaaattttcaatgttagccttttcatgaaagatgtgacatgggtgtgattcataactgtttaatgtgtatattttagttgtcttgaattgaattgaatttcgattcttccatctttgtttaggtatattgttagactctttgaaacataataaaactaaattattcactgtgtgcttctgaatgattaaactttttgtataatcatatgcaattgcccttgaataggcattatttgtctttatgttagatccaatcagggatcgctatatgttactaatagaaattatttatctcaatattaggaggcaactaacaaatcattttcaaattcaaagcagaaatgccttcaattgagttggcggttctagccacaatgggcaaacatgagacatcttacaacatattgcacgtgaataatagtgaataggatcatgcggtactgtagcttcatacttcaacataaattggtttattatatagagagagtgttatgttgatcttattgttaaccttgagattaaattgttagattctacataaggaaaggcagcatgtaatttggatcaacttagaatgtaatgtctttctctcctaatgttttctattatcccagtctacagtatcctctctatctgaaaataccccccttcagccatattgtcctggccctcttatgtgcattgttaagcccttctatttataagaaagtgtttgatttcatatctttttctttatttagttggcatagcttaag

SEQ ID NO: 32911 - DNA, 2889 bp, Oryza sativa
gaaaattgtcagaaactaatgaatataaagctaactaggcgctttaagatatttaatataacatcctgcacaatctgcacggctgagtgagttcccattgtgtccatgctttttattgagatctctgaaccatcaaaagaacaaattccattgctgacaattggttgattgcattgtcacttagcacctcacatggtttaaggagaatgcaaattcttagatgtgccatgagaattttagttgaaccttcagaaatgatttttttttgctgcagcttaatgtcctattagatagccatagatgattattcactgtcaaatgttgattaaatatctgtgataatttttcagagctgaaccatctctgtcggagaaggatcagaaggagagggctcaaaggagtaaatttgtccgtgggcttgtgctctcgacgatatttgaggatgataacttgtaagggaggttatcaaccttaatatagcgacggcatggcatggtcaaggaacagaaaatacaggagaacaatctatgcaatgcagcaaccttgttcatgccgtcgctaatgctgcttccagccttcaaggccaactgggggccacccatcatgtttatgtatgcacgtacgtataatgtatgtctgccttcctgcatttgccgagagggcaacaggaaccagctgagtagaggagaaaggtgtttgtgtcccaaccttccacgtcgaataaatgaggacattgtgttccttgagtggctttgtgcatatatgaagagaggagagctactcgcaatgtattaggttctctctattttatttgatcaatgtaatgtaataataggaagtgttgtacaactgtattgtaatcccaatggtatgtgatactgctttgttttgtatttattgaatagccagtgtggccaattgatctagtactacatgccaagagagctagagaaaaaaaaagctagcgaatgcacacaactgttacggctggaaggctagacgagttctttgcctccagcttcactgctacctctcctgaagcgtgcacatgccatctcttcctcaatcccctctggtatgaattggttaggactagtaagtaatgggttcatatcctcttccataatgtcactaccgttatcaagatggaccataatggcactaccattaccatggtggaaataaggtatgtctccataccctatgtccacaatgttcaaggcaagaaaggcaagaatatatgttaagtgggtcccacatttatgtaaacaaattctacttcaaggtaggtcccaccataccataatctattctcatcctctttaatgtgtatctgtgttttatctcattattttatttcttaaggttgagccataagcttatggttatttttagcatttatgtcttatgactaaagcacataatgtatatgactagtcataaggtcttatggttcattcttatggcacattgtggatgcccttatgtgtggggtaatagaagggtgagacccatatactagtaaccgtaatggtagttgatattatggtagaggatacgcactcataaacaacagctcaattgtcactatcctacttcttttacgattaaagtagagggtttgtcgtttgggttaacatgattgaagttagtgtttctcatatttaacagtaaattctatagaaattatttgctaagtcggatgaagctcacatcaaaatctacggctcagcaataaacctctcaactttgtgttttcattgtggcagttgaagaggataaccggtctatcaagcggtatgcacgtcaatagaggccctagaatataatcgtcatggtaatgcctcagtttcatatcaatcacatcttttgttgttgtatggtttcactaggagtttatttcctttgttagaaatgaatagtgagggtttgtttagttcgtaaaaagaaaatttttgggtgtcacatcggatgtttgaccggatgtcggaagggcttttcgaacacgaatgaaaaaactaatttcataactcgcctggaaaccgcgagacgaatcttttgagcctaattaatccgtcattagcacatgtgggttactgtagcacttatagctaatcatggtctaattagactcaaaagattcgtctcgcgatttcctccctaactatgcaattagttttttttatttatatttaatgcttcatgcatttgtccaaagattcgatgtgatgtttttgagaaaatattttagggactaaacggggcttgattgtattttaagaatatatcataaatagataaactaacttatttgattctatatctttataagctaatggttatccacttaactaatatcacaaatattagtttacttaaacaccgtgggattgctggagaggtagggtgccacgtcagatgtcgcttttgcaaaaaagcccccgcatattggtttacttagacaccgtgggattgctggagaggtaggggtgccacgtcagatgtctcttttgcaaaaaagcccccacagttttgttaattacgcattggttcccgctgctatccaccgtcatcgtccgttggatctcgcctaacatcgatctgaccgtccacgcgtccaattgtgcccacccttcctcagccgtgcgatcgtcggttcgggaatgaacggcgcagatgtcgccacgccgcaccaaaaccctagccgccctcctcctcctcttctcacctgcgtagcgccgccaccccgcctcacgcatggacgcaccgcctccgcctcgacctcctcctcccctatgcgcgccgtcgccatggccgccgccgctgccaccgctgcaacgacgacgaagacgacctatacgacgacggcgaggacatgcgatgggagtc

SEQ ID NO: 32912 - DNA, 10174 bp, Oryza sativa
tgtaactgtacatgtgtagagatcgagacaagaagatgaagcttactgtttgtatgctcgctgctactactatattttgtaactgtatatgtgtagagatcgagacaagaagatgaagcttgtgtgtgttttgtaactgtttttaccatgttctttctttgagctggaaattataattgattctggtaacattttgtccttctgtttttaccatgttctttcattgttgctcgctatttttgtacacaggatgataatacatatgcatccatggtattctttgcggatgatcttacgatggcaatggttctcacgaaagattaaacctgacaatcttggcatactatcacatcgaacctttcaatttggccactctggaggtaccattcttttattctccattttttggcttaatttcttgatatgtatgtaatagcaagtatttaccctttttattgacttaatttcttagtctctatgtggtagcaagcctattccaggtctatggattatacattaacagttcttcctagcttcggcttatatcgatttatttttcagcatgtactggcttcaatgcctaaatatatagggatctttggagttgtggatgcgcttttgttgttttctaccagctgatgtactgtgtggttgtgtgattgctcatcaagattatttaagttcagttccatgctagcatctgttgttcatcatattagttagcttttgtttagtgttcgatctattgaatgacctctgttgccttccattttcttaatcccttgccactattgtcgttggcagaatgacagagcatttgcatcgatgatgttcgttatggacaatcttacattggtgatgttgatacatatggcatagaagactctgaaaacttggcaatctcaatatattataacatcatacctttgaatctggccatcctataggagtataggtactgttagtttctatctcctttttgtttcacttaaattcttgatttctatacgcattcggagatagcaaccttagttattctaggttcatagaagaaggaattcgctctagcctttacttaagattggtttttgaagatattaacctgatatgctcggctatttctttatgacaaaggctacaatattaatgtgatctcccttaccatatagtcatatgcttttatatgactcaagcattttcgatgatgctgactgtaatagtacagatactgatattagaattttctccaatgtttcatttttctaattctttatctcatcgaatgattactttatgcattgctaatagttgacatgtacagctcagtgcaatgcaagaaaacaaaagcagtacttgctgctcttctcatgcaaatatggtgtaatagcttcctacataaggtaatggtctgaatcccaatgtggagaaatacaactttttcttcattttttgtttgcatagatcaatttgaacttatttccataagtgagacagttacttatattccatgcaagctaggtgatctacaatggggagttttcttctttgagtaaggagagtctctgtaccttttttctcccaagttttctttaaaagttttttttttaaaaaaaactctaaaatggctgtatgttctgaaaaaaatcagactaaatcattagctcaaaataatccacatgctctgtattatggctaatatctttgtcagatcaaacctatagattttacaattcaccttatagtcagggaatgcaaatgaacaaccaaattaaatatttctcttggcaaattttccatctatggttgtttggatcgatcaaagatttcgaaactggtcagaaatttaataggtcaacatagctacattgtttaatgtcttatttcgctaaatcagttcaagatatatgcaacaatataacattttctgatgtactatcaatatattctatatatgctcgtataatagtgtgattgactctgtaggtgtttcacatccagctaaccacaaaggatcaatgcataggttaacccacaattattgcagccctagaaagtattgctgaactttgcatcatggaaagagtatatgtaccacacaaaatatcaatgcctttattatatgttggcatttgattcagtataattaatgtgattctacttgagtattactttcgaacgtggtgggcaactttctaaaatatctacctcatttcaattgagtttcgatatggcattttattgtatattccaatatggtgcacatggcatttttttcttacaggcaacattgcttatgtgatttttctgctctaatgatttcctgcttttggaatttactactgatctatccttttgaattgagattttgctttcatggacatgtttataaagtgatgattatatttattcattataggatcacttgccagtataatttcattaagataccatcttttgaccatgcaatgttttgtgcaaccctttttggaagaggaggatatatatgccatgtagaacttacatattattttttgcaaagcaattgctatgttaaaagattgcaacaattgatgaagagaagtatgcgatgatgttgcaaataaagaaccacctttttatgattgtggttatagcaccgtttcagttctctgatccactccattgtatgtttacagtattttgttcattgtatggttgctaattttgccgaaatgcacatgattgtacaaatagttcatagacagatcaatcggagcaattcatatttgaatctttatggaaatcctgatgtatgtgccagtttgttttcactgaatgttgacaactatgtatatatcgagcatgcagtgtagcgcgtgatgattgctagtacttatcatataccaagtgtaatcctatcttaccataaagttgatgtccactaactcataaatcttaacatgcaaccataccacatcgtcatccacttgcaataattatatatttaaccttatgcaagcatacaacatcatctataatttatttatttaattctacaaatcaacatgcaagttatagatggccataaggcccgcccggcacggcccgacccaagcacggctaggcacgacccaccagccatcgggccagcacgacccggtagtcacttcatgccgggccatgctagcccatgggctgcacctccggcccaggcacaacccaccaacagtcgggccatgccgtgccggcccaaaggcacgggtggcccattgtgcctttttttcaataagtctattttccctccctcctctttgggctgtgatatactacctccgtcccaaaatagttgcaattctatattgtttagcatatattaaggtttcagaagaaagactatggtgccccttattaaatggtgtttatgtgagagtgggaagatggttgagggtaaaatagggagaaatttgaatgagatatgattgattgggcaattagtactctagaattacaattatgtatgtatatatatatatatatatatatatatatatatatatatatatatatatatatatccctattctttagaaagtggcatatatatgtctatttttactaccttttctctgtgtgtcgggcctagctgccggcccatcgtgccgggccgacccaacatgccggtggggggggggggggggcaggcatggcccggcggtcaggccgggtcgtgcttgggccaggccaaaatgccgtgccatgggccgggccatcgggcctcgggccttttggccatctgtaatgtatatctaatcatcagccctcacatcattttcacaatattttaacaaatatgtctatcatttgtttgttttatgataagtattgataaaccctcatgtttcattattttcttttccttttactcctagctcgatcatcgaaaaaaatatattaaaaattgcttagtagttgccgtagcaaagcgcgtgaaatcacctagttagataaaatgttaagacaacttaaaagcaccattaaacttgagtcgtgttgtttcaacaaatttaattatatagagtagaacatcctattatcgatgggttgtaccataatggtatttgtatagtatgcgagacattgataccaagttatacgtagtcgtaaaaagatgggagttgtggatttttatactggttcaggctctaagatgggtaatagtcctaatccagtttgataccagcgatcaaccgaaaccaatgaaagagaaaactgtaaatttaccactgatttgaatcgttattttaagactgtcgctagtaaaagattaaaaaataacactagaagtctagaaccatcgttcaagtgatatcatcgcaaatttgagaaaactagcggtaaaattacaaatgcccaatggaagacaatggaatagatcaccgccccgcttgattcacccgtccgatccaaatccaacggtcatccttccatctcccccatccccacgcctcctctccttccacgagtcgccgacgaggcgaccacgccatctccatctcctccacgtctcgtcgccatctcctcatgcctacccactgctagggtttgcccctaagccccccaccctctccgccatggctctccctctccacgacgccaccacctccccctccgaccccgacgacctcggcggcggcggcgaggaggaggaggagaggctcgcctcgaagccgctgctctcgtccccgtccacctatccttccgcggggacggaggagggcgtcgaggagctggagctcgaccggaggtacgcgccgtacgcgaggcgggacgcgtacggggcgatgggccggggccccctgggcgcggcgggggcggggcggctggcggtgggcgccgccgtgctcttcccgctccggctcgccgcgggcgtgctcgtgctcgtcgctactacctcgtgtgccgcgtgtgcacgctgcgtgtggaggaggaggagcgcgagggtggcggtggcggcgcggctggagaagtggagggggacgggtacgcgcggctcgaggggtggaggcgtgagggcgtcgtgcggtgcggccgcgcgctcgcgcgcgccatgctgttcgtcttcggcttctactggatccgcgagtacgactgccgcttccctgatgctgaggtatgtagtccttgatgattctacttctccacgggacgcctcctccgagttttgtgtttaccgttgcttgcttcatatctcagtagattgatattgtgaccaattttgtttacaaaaaatgataatatgtcacttcttaggtagcagcgcctaatggctggttggattatgaatgtcgattttgtactctggctgttgaaattggaaatacatattagagccgttctgcaatttactttatatctactgggtgagggttgggtaatgcttgtttgtgctggcataggtgttttttggactggttcacaagtggttctggtatatgttctgatagctgatgctagaaattagcatgcaaatgcacatcctgtcagtttggcatgtctttatcagtggacttctaacttctgtgaaggcttgcttatttgctgttgtctctcacgacatgatgcatgccttgtgttcatttttggtggaaatgtgctaatattatacagctcttggtgatccttcgaataaactggcacctttaaatagtataatagtgtaatgtgatgataattggttatcgtggtaattttatttcattgcttagttcaatattatgatgataatatgctggatcaggtggtggttttatgcccttggttagcctccagtaggtgagaataagataacgattgagttctagtgaccggaatgatgttcagaacttgttctgaattataaatatgactctgacagatttattttgtttcttatccaagatggatatagattttttggtgatatggtgttgttctaagatggttaaatgttttaaaggattttgcccatattttgggacaagtagtagggaacattattaaggaataatagtctccaagcagctcaattttctttttcttgaagtatgaagttttaatcagtgcctcttgtatctattttatatatccaactgggtactctgttttcttcaggatgagcatcaggaacagtccaaagaattgggaagaccaggggcagtagtatctaatcatgtatcttatgtggatattctttaccacatgtcatcttccttcccaagctttgttgccaaggtactgcaaatatgttgtaactttgtttttgtacttgtaattttgaaaaactgtcattacaatgtactcattttgacttgtctcttttacacatcatttttgaagagatcagtggccagattgcccatggttggtctcataaggtacttgcattcttgtttggatttgcctcagttgtgtctgtacttttggtaaaaaaggaaaaaaaatcttacaattttgtcctgtgtgtctatctctagatacaagtcactattcaatgttttgaccattaacaatattctgtatcgattaaccatgtgaaattaacttcacttgaactttttgcaaaatgacttcatgatgtatatttttatttttattcccttttctactatagtatgaatgtataacaacatagtacagccattttttttaagagcatatatctgttgatagagggagtacagagagtagaaaaatagttgggtttattcagatgccgcatacagccgtacatttacaaaatgacttctgttttcatgcagcaaatgtcttggatgcatttttgttcagcgggaatctaaaacctcagatttcaaaggcgtttcaggtacttgctgaatgctgatgtccatagccttgagtcaatcatttacttgtattgccttaacttcaggtcagaacagcatattttccctttcattaagagttcacatctgagatgtgacttgcacatgagcgtggccacttaatttggccaaattgacaacatagcatatatgcgcatcagagtggtgaaacatgtaaaacataaaggggccttgatcaaaaagtacattttcttcttcataatgaccaaaagttcacaggattgaagttcaaaatagtgtgatgagatatttacaccacagtaactgaactagattacagcactcggtgcacttctactttctaaaatatttctgtgacggggcagctatgtcctttctgttgtatatatggcttcattttctgttgtcatgaatattgttaataccacttagctaaagtattcagtttgttgttgcttttgctaatccattcaatgcacaggtgctgtgactgagagaatccaacgggctcatcaacagaagaattctccaatgatgctacttttccctggttggttcctgattattgttttggaccctttcagttttgttactaacttagattaaggataatatcaatccatccaacactaaatgtataactttagttgcagcgatttctctctctctctttttttttaatttttaatgcaaggaatacattgagattgtttactgaattcccttttgaaaatggaaaataatgaacatatccaacacaatttaacatttttactgaaaggcaaacaagaatgtagaactatggtatatgatctgaaagtatatttaatacatcactctctaaattgcttcactttttatgtaattattttcttatgtatcatatgtaaatactgggctgttgcattcttctattacagaaggcacaactacaaatggtgattatctcctccctttcaagacaggagcatttcttgcaaaagcaccagtgaagccagtcattttaagatatccttacaagagatttagtccagcatgggattcgatgtctggggtgagtatcaatgacttttatatctttttattcatatacccttaaagctggcaagtgtttggcttgaaggccatgcaaggcagtgtctgccttgccaaattttacttctttggcttgtatttggccccacttggtttatcgtcaaattcttctaaggtttcttactttctttagcattggctctacttcattctcttttaaatacttggtaatgattatccagtgctatgcgccaagccatctatgtgctttttagaactttgtgagtttgatgtcatttttactaatcatatgctgaacaatttcaacttgtcgctccttcatctgtttaacgtatctatatctcatgggaaacttgtatctgttcaaccttactgaatctcatgaaaaattttcaggctcggcatgtatttctgctcctttgtcaatttgtaaataaccttgaggtgatccatttgcctgtgtattacccatctgagcaagagaaggaagatcctaagctgtacgcaaataatgtacggaaattgatggcagtggaggtatatacatttatctttcaaaatcttaaaaatggttttcaccatccacattttctttataatccatttgtatcacctgaaatcttattccattctaactaatattacatttttatttttgttctcaggggaacttgattctttctgatcttgggctagcagagaagcgtgtgtaccatgcggcattgaatggtaataatagtctacctcgtgctttacatcagaaagatgattgaaatgccttgccatcgcgcttctgtatactgatgctgagtgacttgcttgtaatatagtacaagttcctggtgttgcatgattcctcatgttgagaggagctatgttaatatcctcccagtaaactgtaaaattatttgtccatagtgtggttcagtaatcatgtcagttatacatgattacattcacatgtctgggacacacttcacatgcaatccatcgatgtgagctttataactgctactttgttacagaaactgaatcatctatttggtcttccctgcaggattattatgtcaaagctaatttggatatgcgtgccgttaattttcctatttgtccctgaaatgttatcgtacatgaaccgaagtcaaagtttgccattagtttttctcaccaaagggatcctttgtagatgaccacagaattttgcagcaagaatcagctaggcattaaaccacaggaattaatacatagggggatgaagggggtaaccatagaaatttccattttcttcagctcaggatcatgtttagtagtgttgatgtgtcatcactaacaatgttgtatctggtgtaccttccaactagcgaattaccaatcaaatgtaatagtttttatggttacctatgtgatccatttcccttttttagcttacaccatcttagtttaatatgttgattggttcttcattaaccttactctttacaatagcagaagttggggtgatgcctacattcaagacacaccctcccactctgtattcaatacatctgttgtttgccacattttcccttgcacgtatgcatttattggttgctaattgatctcatgcgttcattatataatctttaggtctgagattaattatttgttgccttcccgtgcacgtatgcatttattggttgctaattgatctcatccgttcattatataatctttaggtctgagattaattatttgttgccttctctaatttttgatcttatactgtatttatctgccatatgccatctaccataatgaatggggactatactggtcagggtagaaatatattggacctggctattcaagcttcccgttggcagaacgttactgaccagtatagctatcagcggtttacggtgatgtttctttctttgcccagcactattaatgaatgtatattggcttctttaacaatgttgctcctgtaattattattattttgtctttttggtttgaaaatgttctagtgccaggtatgcctgtcaattttagactcatttgaaacgcatgaatttcttagaaatgcagtcggaccgtgggtgattatatggaagtacgacaaaatttctaagaaattcatacgtttttgtcggactttcatgcaatccccctgtagtcagactgcgttccaaataggaccaacctagtagtaccggatttgagatcgctttggggaaaacaaaacaatgtactaaattgctgatgacgtttcatgctccaaaaaatggataaaa

SEQ ID NO: 32913 - DNA, 12639 bp, Oryza sativa
tagtttatcaaaaatttaaaattcagtttgatattttttttaaaaaaatgatggtttaccgagcgacttttatcttgagcaaaaaaacctttcagtattcgtgaaaactgagcggtttctatcgcctcttccagcaaggccatgcaagctaggtggcctgtgtccagctccaatggtacattagtacttatcaataactttaaaaaaatttagtttaaagacactagaataacttatatagatatgtcttacaaagtaaaaacatttctttattgtatataatagaaaaacataatcaacaatatattttggagatcgtgtcattatcaatagcgatcggagggaataaattttcagtgctcctatacgactagatgatggatatgggttaggattggatatccaatggctcaaaatccagctgaatactttggaacttgggaatgcacaaacagttaactgacatggacaaaccaaagaactcgaaacctaatttgctctactcgtgtaacttcgatgtaaatcgacagaatttacaacatagccaacattggcagccgacaatataggaactaatccgacaatatagccaaacaagtctgacagctttctaatctgcttgttacatgtgaagaaatgtaagttttgcaagcaccccatgagaagggcaaagtatcttacatcaaaattttacacactgtaaatttcaaatggccaatagcaggatcaactaaaaacctgaaaaacaaaaaactgagggaaggctccactaccatcaattagggtttgccttgctagttacttcatgtcagcaccaggaggcctgtcaggcctccaatatagaattgtattagctccatctgcaatatccatgccaacaactgcactgatctatcctagaattatatagttttgggctcgtcgcagggaaaaggagccaaaagaaggacaatgaaccagccagaaatgctactgatgccactcctggaacacaaagcaccaggtaaaccaatgtaagaagtagcatatttaagactcaaccatgcttttgatttctcgaaataaatcaaggtacacacctcttttttgtggtgatgagaaaactggcaaacccattatgttacaaaatatgtgggcaacaataggagagacgatattccctgcagtattttttgaacgaagtgattgaacaaccatgttgtcagaacaatataaagcttcaatcaaacaattgaattaggtaagtgcagtggaaggatgaagaaaaggagactggtgtattcaggaccttgctttaaagttcagctcttctagaaacaggttacatacttcataatcagtggtaacaattgaacttactatgcaaatcctagaatcattcacaaaaagatgtcttctcaaatatagctacctaaactaatttgaataattggagaagtaattcccgcaacaagaatatgcatagctggaaacaacaaatgcacaatgtacacatgcaacacacaaaagaaagagtaaaacctgttcgggtgaacaaaaatactgcataccacccaaaaattacagtgtagcctaactggacacctgtgaatgaaaggcaaaaagttaaggcaagcccagcaaaatgaagcaaaagtgatatactttgagaaaaataatgtacaaaatatgacgaatatattgaaagatcaaacatttgtttatagtttaagaacgaatacaaaggaaccactaacaaatattgacacctgtagttgatgttgtacgaagtcaatactttattttaaaaagttaacagtgcaatataatgatgatgataaactaatatgctaaataccaatgactgtgattagatatgaaggtgttgctacatcactataggttgcaaatcaacacggtgttgaaataacttcataaacaaagatacaaaaaaaatcgctttaatttcacatattagaaataaagtaagttaaatatagatcaaacaactttactctaaaaatcattaaaaggaaggcgttacagtaaagaatagaactaaaaaaataagaaagaaaataccaacgatcaggagtgatctcgtaaaattgcgtccctgttgatgtagttcgaataaatggttcaagtgtgctgttgatagaaaggctcagttacaaattaacagaagaaaacatcaacacataggtaaatcttaagggttgtattacgcagcagttcttaattcctatagaaacaactagataaggacagacaacatgggtataaacaagttaatagtaccagatcagacccttagaaatgaaattttggtacaatataaaagctatttacctaggctgaagaagactggactcagaaatataatgttatatattttgaatcctccacatagaagaagaggtaccatgcacgcccggaaaaccaattcctctgtaattggtgcctgaacaaacaagcatactcaaataaaaatcactagtagaatatataaaggaaaccatcgtttcagtagtaacatttgcgccatagaaagctaaaagttttgcataagtggtaatttttcatgaactgttagatggtaacatcctacagatcaatcgtactatatcaattaattgaaaaattccttgatcatcgccacaccacataacattccatcgccggtttacaagacaaagcaaatgcatcaaagcgaaggagagaacaaaccactacgcagttgcgccaaaccatcacatctcctacggaggcacggatccggtgagcaagcctctgtgcccagcctatctccggctcttcatagcctccgccgcacgaattcgccagcagccagagcctcgcgacgaacgagccagcgtacactagcgatgtaaggaggaggggaatcgccaccgcttgaagctgcagccaagcaccaacaatttcagaattgaagcatcaccaagctcaaacctgttagtattactgacatgttcagaaaggaaaaaaaaaaaacaagaacagtaagtgaggtcgcttaggctcaccaggtgatctctccgaatgccaaacacggcgagcacgacggacgaatctccgatgctccacacctaggaaggatggggaggagaagacgctagggacatgagattccgtttagggtttagggttcggaggggacaaggtggggggcacttacgcggaggagggaggcggtggcgaggagggaggccgaggaggagaaggcggcgcagaggaagcggcggtggaggaagacgtggagggaggtcgggggcgggaggcggaggagggccgtgggggcgtagagcaccgcgacgtaggagacggccatggcggcgcacgcggccaccgccgccgccgccgcgccgggtatcgccggctgcggggaggcggggtggtggaagctcgccggcgtcgccattagctccggcgagcggagggagtagagtagtgtccgtcagtcactcaagagactgaagacgggggacaccttctcccttctcgtgtctatacttctcaacataaaacaatgtaaaaactgcttttataatttggagtataatataaacatttttacattgtttactatatagcaaatgataaggcttagagaattttttttattaaattttaaagtgcttaaactcccctcttatacaattactttataatataagtagacaattgggaagattagctaccctatgatcagatggctaagtggtgcgattgcgtacacagtttattatgatccgatatgcttcctccgttctactgtgcaagattttctagcattacacaaatttataaatatgttaatgaatataaacacatataggaaacgtatacattgatcaatggatgaaccgtcaaaaagtttacgatatgaaatgaagggagtattactcgctacattttggcatatcactttctacggtgttcttttttttttcttttctcctgaagatgaatattaagtttttttacgtaaaacgatgtggtattaacatttgattgattgagttttaattattacatacttaaaaaataaattaatatgatattttagagcaactttcatatagaattttttcgcacgaaacacaccgtttagtagtttgaaaagcgtgccaaaaaatcttaatcttcatccaactcttgttggagaaaagaacgggccgtaacattttataatccaattactatctgtctttggccatatcactgtttttcagtgaataatgttgcagcttgcaaagtagcttcatttccggtcgtttcaattcaacatattgccaccaatcggagccgaccaaaggacggtggcaataccatctaaatttgaactgtttttctatctttcatgttcagtacaagccttatactcactttataagacgcatcatccgttttgaattaacggtccagatttgagcttgtgccatgctcctcatatatgcatttattagttcatggttgcactgcagtgagcatcttcgtccacattggatattggacattatcaccacattctaacacaagcgcagcacatccatttgccgcccgtatttgcaatggtgcacagatacacaatgatgttcatagttgcactgcaaaggtgtgttctgcagagagatacaggaggaacggaaccaggcgagtactcaagtatggcccttctgaaggcacaaaacagggctccacattgaaaaaagtagcgcacagctcaaccagctccaggcaaaaaagtagctctattttgatgttggcacagccgacaaaactgcggtttcatgtccacattcaggtcttcagaggagctttcttctccctgtcggatatgcgagcgggcgcgtttgtgtgcgacttgaagcggcctcgaccgccgtcctccttctcctggaagtttttaggtcatagatttagcaccatttcaattattgatagaaacaccaccttaagagttaattttgatgtttttaagtgtgatgaaagtaaaccttcttctttactatctggacgacatcctcgtcttgaagaacatggccaagcccacaatgttgcgggtaatgcctcgcacttgttccccatacaagtacatacttcacatccttgaccaaactcctatggatatggttgcagaagtcttcaactgtgcagccacctctatcctgttgacacaaaacccaagtcatcaaacatattgcagtcctttagaacaagtagtgcaaggcatgacaacaaataaagcttacagtagaaagaacaactggatctgtgaaatcaggttgctgtccttgtggctttgtatacactctcactagccccatttcctcccacattcttgctagtagcctgtccaagtttagctgcaaagaaatagtttatgttaaattcaagataaagaaccacaaaatggaaaagagaaccaattggggacagaaaactcaatacttctgcgtgcactgcggttttcaagatgctcacatcacacaaggcccaagggaagtaccagaaataacttgagaaggatataaaggtccccatcgtttggcatatgcttatgcttatcagccaaaatttgaattttcaatgttaaatttggagctgattttggggttttttcatcgaagtttatttttcagcctttgcttttggatcgataagaacacatatataaaagttttattcacaaactgctactcgtttgcaaatatgccatttggcatattctgaaaatatgccaaacgatggcagccaaaatttaactgagagagtaaacagaagatatataacatgcctgcaaattgcagctgatcacaagcgaatttggttgccgagcaagcttatccacatcatcaataccaacaacatcaatcttgttatatacataaacacattttatgtacttccgatttccttcaataacatcgatgaagtcatccacggtagcatcctcgcggaataacacctaaagaaaaccaaataactgtgttaatcatgcgtgcacaaacacacacatacacaatcataagagtgcgtgtgtgacctctgcgttgtgaattttgtactcatgcagtatctgatagcagagcttctcatcaacatgggtcaagggaatcatgctgttgaaagaaattccaccagtcttcttctttttgaaatatatctgttcatacaagcagaagtgattaataatagaccagggaaaataaacagtacagatacacatacgaaatgattcattagcaacaaagaatatgatttagaaagagcaacaccaactgtataaacatgactcaggtacaccatatgtaagacttgattcaaggaactagtcagcagagttacatggttcaaatagtccacagaagcttgctgaagagtgatttatgatatacttgcagatctatgtgcagaatgacttagcactgttatatttactatcagtagtttgacaaattatctgacatggcaaggggaatctgcagtcaaccctggcttgccactccacggttcacgtactgttttcttatgtaggcaaatgtatattttaccaagatgataatgatacacctggaattaatcctaatcaagcacatgatgctcaagatgtcatgcaaattggttcatttgttggaaatggaatcagatgaaacgaatgttgtttgagccccaaattgtccatcttgcgttttcaatgttgaattctaatttcgccctaagcactacctgaggaggccttttgttcagacgaagtccaacagcttccagttctctagttaatatttggcggtgtccttcactctgaaatgaaattcagaacaagaatccaataagcaaacagagctcaggtaaagcttggatcatgttcaatcacatatagaaggggaaagattggatgtaattgtaacatttttttcattaagaaaagaaaaggaactccatcaaaccccgcctcttgatttgcatcaatctaaccttaacaaactctccactaaaatcttctaagaactttcaagcaactataaaattgatagattcatttaaagacagtgtataaaatttcctgtctttataggacatatttacaaaatagcaaacatgagcactcaactgaacttgaagttcacctattttactagtaatattacaggagtttttattaagaaaagagaaaaaaaacatctagtgaaggagatatgcaatgttaaaaaagaaaaatggccttggtgaataagtagccaagtgttgagcttatcacatgattgtttgccctatattgtcaactttaaattcataatttcccctatttatctattgtttacaggtcacaaccccttgtttcttgtctcctaacttttaggttttcaaacttttagtttcctaaagctcaaagttacctcaagtaagataattttatcattataaaatatatgcaggtgcttgcagagtaagacagttgagcattctaacaacagaaggcttaattgaaaatgtggatactttaaaatattctgctagtaaaaggtgttgtttagctagtcctgagttcagaattatatcaaaactacgatgactgagactgattttctagtctatcatgatggatggacaatcacactacaaaagagaaaaaagtacatcggaccctttccaatctttaagaacattagctcttcaacaaagtaaaggactagaaaagcaatgaagcaaagccgatacagctacactacttacttttgaggcatccagaaccatgagcacaagatctgatgactttgcgacagcaatgacctaaaatgattaaaataaaaattaaatacaagttatttttgggtaaaaagacacagatgcaccgtacacattgtgataataaaaacattcacaaaatttacctgtctaccacgccccttgccttctgatgcaccttcaatgataccaggaagatcaagaagttggattttggtatcattgtactggataataccaggaatgcaagtgagggttgtgaactcatatgatgcagcttcagaatgggtcccagtcaacatagtcaaaagagttgactttccaacactgcaacataaatttcaacacggaaatcacagtgatttaataaacctgagaaaagaaaaagattgggactcaacagtttttagtagagagttgggacatagatgttttcatcttaaattgaacttaacaaacaacgtgctcacatgcatgctagaaagtatatggaatacaacatggaataccaatttatcatgggtaatccatcgttctaccaattaagatatttagatatcaaattcccatcgttctttttcaagtcattagatggaagagttagaagacaggcatgcacaagaatacaaggcagccaatagttcgtaagagctggaatggcatgcacaagaatacaagggaggaaacaatatatcgagaagattatattacaccaggttcttatacagttatactgatcataacagactccatgaattctaaatctatcgctacaaactgaaaggcttgaaacacaggattttagggtactcaatttatagggatgtaggcggaggagagacctgggaaatccaataagtgcaacacgaccatgcccaaactttgtgacttcaaaaccatctcctccaccagtggaaccctatgtgaccaaaatgatgcagatgtgacaacagaaatccatggaattcccatgactatgtcaactttttatattaccaaaagaacttgtaaggatatgatcaagatgaaaaataataacaaaaggaaatatcaacatgatatttcaaatatttcaaataacaaaagaacttgtaattccataccctacttgcaacaaaatatttcaaataaatgctcaaacgtcataaataccttagggggctctaataattgtgtcctcaactttgctatttttgctttcagttgtccaagatggtattctgtatgacaaccagaaataaaaattattcccagataacaatatgcaagacatttctcacacagtattgagtatgggtgggaatgtaagagatcagagataatcgttcattagctaaatacaacattgttaatagcaagttcacgttcagatacataaattgcatatatgcaaacagagatactcaattactcagttatgcctgttcttctagcaacaaatttggcatctgactgttgatactggacgagtatagtgtgtgtcaatcagaaaatggataaagcagggtatgcagtaaacataaatcaggcaataaaagacgaattccctgagtccactcgtcataacatggatgaatttgtgccaagcaaagaacatgtggcaacaaatcaacaatttcggatctgaacattgactagtggatgcacaaataaatggcccactggccatcattgatccaaatgtccataacactgaataccaacatgaagagaaattttagcaacaaaataaactggaaggttgagaatcgtcagtggccagtataactaattaagcagcaaataatgaagtaaaaaatcctgaaaataaacatatacttgcgatgctcatttgacatccatccaatccaccaagttaatttttatatcaatcactgacccagtgaaacatgctagtatagtttcatgatgaaagaaacgaaaaaaaaataatatgaaggaatgaagatgaattacagggttgtattaaaataaaaaacaacctgttgctttatttttctgtgtccgagccatctcggcttcaatctccttgatcctctcaaggatacccatcttttaacttgtgacgtatgcgaattactccaaggtaggtgaatatacgacctgtcgcagaataaaagaaacaaaagaattacaatgcagtgatttgtgcaagcatctgaggctgcccgacagctccatccctagacccccagtattgaaggctagactttggcaagggcaagacggaaaaccccttaacactaacaggggcggatccccaaactttttgggtgaacaaacaaactgttactagttgtattaagaatagaggtttaaggctctcagattaaagaggaagaagagctttcttccagatctacaagagaagctagggtttacgaacgcacgcgcgcaagcaaattccagacaaaagtagtcccggtgaggtgggagagagatgaatcagaaagagaaagaggatgtggatgctcaccaggatcccctcccctgccctgctctgctcgctcgccagatggagatcgccgcccctcccctgttctgttcagccgcgactcgtcttggcggcggcgcaaggagcggaggagacgaagtgacgggagatttctctttcttttacgcgatactcgactactccaactttatctcagtatttttattactttaaaactgactacttagagattactccatccgtcccataatataaaagattttaagtttttcttgtaacgtttgatcactcgtcttattcaaaattttttaaaattattaattattttatttgtgacttactttattatctactgtattttaagcacaacttttcattttttatatttgcaaaaaaattttgaataagacgagtggtcaaacgttgcaagcaaaaactgaaaatcccttatattgtgagacggagggtgtcgagggagaaccctcaataacagagagtcgtgagaccccctttcgtgagttcggccgggggcggaggcccgtctctcggaattcgtttgctcgtccctaagactatcaatgagctagtacacaaacggattatacaggttcgggccgcaatagagcgtaacaccttactcttgtgtttgggattatcgatgaagttacaagggttcctttactccggagagcactcttgcctcctctcttccgaagtttgggttttctcgggttcccttccttgcactgtgggcagggtcctccttttatagttctaaggggataccacacgcgccgattctacctactctccaccggggaaaggggggaaaagaccccacttcacctttttggccttcaagacgtgccttctctcggaagctaagccataaccgatccttgagcggaacccagcgccgtcccccgcctgacacggtggtcagcccggtcattccctcataaatgatcgaagacatgcaacagcccttcctcgagcagcactcggatgtgacgggtcacacctacccccattccgccggggtcaagggtgacgtgatgatatgattaccctatccatcggatgtgacggaaacgggccggtcacagaccggtcacatccgactggcaggggttagccagacgcaccacacgtctgccgcgagggacagttggggtgctgtgcatttacggctgttcagcctgtgctcccctctgccgcgtggcggccaggcgagggcctcggggcgaaggtgcgatagggcttgagggggcgatgtcataccccgagggggcgacgtcgtaccccgagggggcgacgtcgtaccccgaggccccccccgctgcttctatgatacgcgtggcgtgtgagtggggccatccggccaagccacgtggccagaggaagagtaattctcctctacctcacatacccccgggcccatatctccgatagagggagtatttctttttatgacggatggtggcctacgtaacatcaatactttaaagaaaaaatattaacaaactcggttttagagattgtgtcgacaacaatctccccagaccgcccgcaaccactaattgccacactatgcaccgccatcaccgttctttcttcatgagccaccattgttcctaggggtgggtaaaaaaaagactgaaccgaaaagatcgagactgagaccgaattttgtttggtcaattcggttagtctcctcagttaaccgaatagaccgaattaacaagaaatgtctaaatgcaacctacaatccactaaattcaataggattaaactctaattttcacatccctacttcttcaaggcatgcaacctaataagagtttttattcatacgtgtacaacatgatatgtaagtaggatatgtcacatcatgtactagattaacttattcttatcggaggtagtaataagagtaaattccctgtgtaccctgaaaactcactcaatccatttcatacccctaaaatttataagatcccttctatacccttcaaatttcaatttgatcccttccatgcccctaccattacattttccttcatttcattattatgtttggttgcaaatgtcttttttgcccttgatgctttaagtttgaatataaacttgaaaaacgattgaaaattttgtttgagtgcacaatatgtgcattttatgaaactaatgtgactaaatgattactgcagaaaattttgacataagtttaaaaataaaaaaaatgtaataaattaaaatatttatttgaaattttaatatgacaatggaattttttgatcgggaacattcataagaaaaatattgtgagcgttggtagtcctatttttgtataaatgctcctcaatttttatgactttttttaaaaaaataaatatattttttatttcattatctaaaagtaaaatttgtgataa

SEQ ID NO: 32914 - DNA, 1276 bp, Oryza sativa
acgatactattgtgtgctgatgtgagtcaagttggtgcaaacttatactagaatatggagtttctttgttgctcatgggcaggtgttgcttgaggctatgggaatatagctggtgatggatcaggactaggcttaggagaagttaaggttcagacggtcaaggatatcatgtgggatgctcaggctagagaacaatgcacgtggaggtgaaggttggagtctaagtttggaaagattggcaatgtggagttgtacggggatgttgtttcccaagtcttataggttcctacgtgattagagtcctagttttcgttggattcgtggctaggggaaaccacgtttgtgggtgtaaatatatgatggattaaagctagaagatatcgactttttggaagagaaaaattaagattttctttgaggtttcaatcatagttcatgagttgagagaggagtgctttagatgcactttgtaaacacatatcgatgcaataaagttgatctactttcaagagtttcatcgatacatgtttttctagatcagacggtttgaccggagttcataggacggtctaaccggaggcatggcgatggtctaaccggtggcgaggaaccggtcagaccggtggcgaggaaccggtcagaccggtggcggcgagaaggtagcagagggaggctgcggtccgattggccggataacatcggtcagactgacggcttaggggaggtcagacctgtgtgcacatggaggtcagatcgcctacgcctacgacttcgtcaagtttgaaggtaacttttatttccatagaaagtttttggtattcctaccattcaccctcttatggtaggtttgttcggtcttgttcgatctttgaagtacatgatacaatatgatatgtaagttgatatgcatgcatgatatctaactttgtcaaatttttcaatcaatcttctatatataagaaacaagggcacattacaaaatgaaaaacaatgtgtcaaatatcactgttggagaaagggtttttaacccggtttgtaaccccctttagtcccgattatacaaccgggactacgaatccaggactaaagatagctatctttaatcccgggtgaaataaccgggactaaagatccatatttagtccctgttggtgttactaggactgaagatggaagaggccaggtcccgattggcagttttttcattgtttttaactccttgcatattgatttcactccattcccaaaacatccccaaattgtgaaacccccaaat

SEQ ID NO: 32915 - DNA, 9562 bp, Oryza sativa
acagtcaaatacataacaaattctcaacaaaagtttcatcacaaatcctaaaatccccagcccggctgccgccgaccccgcctcctcctcgtgcacccggccaccgcctggccctccgcggcgcccctccttgtgcgcccggcggccgcccggccctccgcggcgcccctccttgtgcacccggcctcctcctcgcgcgcccggccgccacccggccggccggccctccgccgccggttgcccgacgtcctcatcgtgtgctcgctcccagccactgctacgctgagaaacatataggggaaagagataaggagttagagtaaggaaagcgataaggatagttagaggaaaaagagatagaggagagaggagtttgcgaggacgatagaagaggataagtattagggattatatagagcgttttgatttttattcccggttagtaataccaattgggactaaagttaggggaataaaaatctcgggcgccctgacacggcttgacatggaatcaaccgggactaaaaatcacatagtcccattatgcttttaaaccgggactaaaaatgctttctagtcccagatttttaagtaaccgggattgttgtggtttttgggcaaccgaccaaagatggtttctccagtagtgtatgaaacataaattggttaagagtagtgcataaaaaagtgaaggcgcaaagatcacatgatgaatggatgcaagctattccaagatagcagcgcttaaagcaatggctggtatgcaaattaatcaatttacacccatctaattcacactaacatgagcgtgcatgtaatgatcgaagaaactgatcaaattatagtatgttgggaatgataatttgaatattcgactgatggatcaatgtatgatatacactaagtaatgcatccgcacttcatcgtcatcaaatgataaatacaacagagcaaaaatgacccattttagttttgttctgtcccgggccaccaaaacctcaggacggccctatgcatatagatgcacgaatgcgagtgagttcttattccttcagtaacctaagctagctactagttcacttgatgatattgaaatcatggtacctagctagtaactcgttattactagctcctataataatgtataagtatgtatattaattatttctctatgccatttcattaattaattttgttgtccgtctatatctccggatcatcgtcgccggcggccttgtgcctctcctgcttcactcctgccgccttcagctgcagctcctgtccttttccccacaggaacgcgtagagccccacaatgatcagcagtgccccgatcacgctacacaaaaatagttaagaaaaaaaaagtctcagattaaacacgggtattcatatattttccgtatttcctaccctacacttagtaacaagtaatatacatgacatatatatagctagcagcgagagtaatatatatgctacgtagtatagggaatcgaggtacactcagtgtttaggtgttacttttgtaataattggctgtaactccgatgagcaaaggccgggatgttttattccattatctaaaaaaatagggaattgagctatatatatatatatatatatatatatatatatatatatatatatatatatataaaattgcccaaactcacttttgaggggaaaacactccataaacatgataatttggcagtagacaccgcgccgattaaaataataattttcgattaaagaggagggagaaatcgcgtgaaatttctaaaatacccttgggcccacaagccatatcttccatctctcttctctctatccctatccgacacggctgaggggatgatggtggccggccgacgactcctcttcacgtgtgcggctagccgggaactcctctccctgcgtggcgctagccggcgaggtccttcccccgcgtgtggccagccgacgactcctctccccgggcgcgaccggctatcgaacaactatccccccccccggcgcacggctggccagcgagctcctctcccgcgcgcaccgaccagaacgaggaccaggatctccccgcgcacacggccggtcgacgagctcccccccacctcgccgaaacccacaggacgccccaccgctccgcgccaccagatcggcaagcgtgacggctcgtcgtcttcttccctccattaaatcggcagatcaactcatcgtctgcatttctcagttctccaaccaatttcccgattcatcgatctcatcgttcgttcgctctagctatcgagagtgatggtgtggtctgttcccgatgatggtgctgctgccgaccatgctgctgctgcggctgaggctcccgggcgacggatcgtggtggccgtggacgagagcgaggagagcacgcacgcgctcacctggtgcctcgccaaacgtcgtctcctcctccagcggtgacacgctcgtgctgctccacgctcgccgcccccgccccgtctacgccaccatggacagctcaggtacctcaatcgaaatcactggacacgcttttgtggtctctgctcctaattcatcaagccaacacctgggttgttgttgcagggtacatgatgacctcggacgtgatggcgagcatggacaagtacgccgccgtctccttccaggtgcgacagacatggggcggcgccggcgattgcaacggcatcggccatggaagtgtgggaggaggggatagggagatggaagatatgacatgtgggcccaaggacattttagaactttcacgcgctttctctctcctctttagccagaaattattattttaattatcgcggtgtccaccagcaaattaccacgtttatgaagtgttttcctccaaaagtgagtttgggtagtgtcctagggctaaaaccacatataaacagtgtcctgtagcaaaatttgccacatatatatgaccatcaagataatgagtaatattggcggctttgctttagtcgccaagaaaattaactggctgccaaaaaaattatgttttcttgtagttatatactcccttcgtctctaaatatttgacatcgttgattttttagcatatgtttgaccgttcgtcttattcaattttttttgaaataggtaaaactatatgtatatataaaagtatatttaacaatgaatcaaatgatagggaaaatattaataattacttaaattgttttgaataagatgaacggtcaaacacgtttaaaaaagtcaacggcgttaaatatttagggacggagggagtactagcttatgatagttataccttcctagatagatgtttgcgccgagcaacagtgagtccatgacggtggtgatgatgagcgagagcgagttgaacatggaagggtagatcggcccgcgacgcgtgattgcccacgagatgagcacgaaggtgataccggtgttgaacaccccctgccacaccacgaattacatgatacatcgataaatttctttagataacggaaaattcattccgacctttactttaagaaagctatgaccaattattattatgattcattatctaaaaattattattattacgatttaagtcaacaaaatgactatgaattatcgatataatgcaactaaggcatatactccctccgaaaaaaaaaatctaattgtaggatgaatatggacacatatatatcctataattagatttttatttttttggagtgagggagcatatacataccgagtaggcgacggcgagaaggcgcaggtcccagctgagcttccactccgaccagtcgccggtggtcaagacgccggcgacgagtgcctgcaggctccctgacaggcatgtcagcaccgtcgcccagtacttggacgggaacaccttggctagcttcgcctgaattcatcagtgtttttgcaaattagtttttgcaaaattaatttgcagtatagctagtgaacattacttggatatagatatttttgcaaaacatttttttgtgtgtgccaaactatcatatatatatatatatatataggaagaaattagatcctatatacagctatgatcaaacatgcatttccatatgccaaaagactcaaatcgattaattaataatgctaattaacctgcacgatgaaccacaaggcgtagctcaggcagctgccgcacagtagcagtgtgccggagatcgtcgtgccggcggggctcgacgacgatgacgacggcggcgccaccgcggcggcatgggaggcgcagcaggtgggtgggccagaggtgcagcagctgacctctgaagaggctgacgaccatcgtgccgctcacggacaggaccgtgcccaggaccttcatcttgccggcgcagcttgctatcgccagcttctcagcacttgatgaaaaagaaaaaaaaaggatgaaaaattgcaaatatatgttgaatgtcaccatatattgacatgacaactgttgattaattattttgtctattagtaccttgtatatggtgagtattaattgtatattttagtattaatatatatcacgaggtaaatttaaaaagtatatatgatgtcatacttctatatatagtttatatatgtgtgttgttaagttttttttaaaaaaattatatattgtgcatagttaaaagaaatgtaccggaaaataacggcgataatgaaagtgacgatagggatgagattcagaaagttggcggaataggcggcgttcgtgtcacgcagaccgtagtagtacatccctgttgccagtagaactctacaaattgtcaaaaggttgttagtttcaaaatgttagtttcaaaacatagaggaaattatattgtgaggtttggttttttaatttcttaaataaaagggcaattcacttttggtttttgctacaaaaggagtcgctaagggaacagacaaggtggcggcatatagcattcggagacgatggtgatggaaggatatttcaagcatgcatggatgcaattaatagcttttgtgctttagatggttttcattcaagcttggagtagcattggtatcattcaagcttggagtagcattggtatagcatatggctaaaacagtaaaacttttcctcccaataaaaaagaggtaaaactgtgtgatattagtagtggacggttgaatgtaggccttattatgcagaggctagaataaaaaaaaaatctctgtctgaaaaagttataatttaatgcaaattttgcgatcatatataagagaataatgttgagcatgacaagtaaaaacttagccttgtcgttgagtataacagtgctaacccgaacgttgcgttgatcgaaatccagccacacactacggcgttcatctttttcatcattcctctgaaacatacagaagaaggaagcacaggtagaaaaccagaaatacaagcacataaatctataaacgagtagcatacatttttccacacaccaatgcattgtacatcgctacatatatatttgtccaatactcaccccagaaataaacaagtgtggtcatttttaagtattgcttccatacatcgtcaaaactaataaatttctattgcatcatggtatatctttagaagccataaagttcatctaaatttgaggcatgtcatctttagatgatataaatatatataatgtgcctggtttatagttagttctagactccattatcaaaagttctacaagatgagtatacgttaattacatttagaataactttagatgcatatgtcctctatatctatatatacttcccctttaatttctccatatttatttatctatcaccatttggctagatgtagaaatcaaacggcctgatgcgtcacgagcttttgcgtgtttacatattattgatgcaattaagagcaaaagaggtgatcatcaagaggacggcccatggtttcactccacctacatatgcggcgaccatacaatgcagggctgaattcaagtcattttttgtctctttctaacttagtgtttctgttgagtgtttgacacatgcagtgagatgatatttgtccgtatccagccaagtcaattggctcttttcttttcttgcaatttttctttctttaggctgtttttgacacacgaaacgataggatgtattagcacataattaattatgtattagtaaaaaacttaaaaattacattaatatatttttaaagcaatttttctataaaaaatacaatgtttaaccgtttgggaagtgtgcatacaaaaagaagaaagtgtgagttggcaatatagacataagaatacaaccttaaaatcgtcaactagttgggtgggcggctaaaaaggtagcctccagctacgaatgctctcgaactttcctcgactggtagtatacgtacaaagaaacatatatagacaaagataatagcgtaagccatgtatagtattactctagtagtgcaattaaatatatttattatttctttttggaatgaatcaattaattagaaggcatgaatgctatactatgtctttgctcacggctggcactgagatttcgcacgtttcccacgagtttccaaagcacctctctctttaattctcaatttctcatatagtaaatgaattggatcaggcaaataaaatcgtcgttcgatccaagcgtggattagatttttttttaaaaaaatggtttgatttcttttcatcgtttctaccgatcgatgtgctgtacgttctcccattggtaaagcgaacgacgaagatgatgaagaaaacagaagcaagatatatactgtatatagatgcatgcatgagacaaaataatttattaattaaagtgataatatttcagcaatgtgtactaatttatatgtacacgtatgatactggattattggtggtaattaacaaagaagaaagagagagagagagagagagagagagagagagagagagagagagagataatgtggcatttactggacctttcgaagaggacggcgagcggcgcgacggcggcagcgccgacgaggttgcggtagacgaggaggacgagcggccgcgcggcgccggcgccgagcgcgagctccgacaggagcagcgtcaccgcggtgaacacctgcaccatcaccatccccaccggcagcagcaccgccgccgcgcccaccgccgccgcctgctcctcctcctcccgctgctgctctactaccgccgcctcctgctcggccacgccgaccaccacgacggcggcctctcccgtcctcgccggcgacgccatgtatattttgctttgctagctatagctagagctaggggcacgatcgatcgatcgatcgacgcgatacgaaatggaaattaagaagaaaagtgagacgcgacgagtcgatcgaggatgggagtgtgcgagaggcgagcgattgattgagcttgcggtggtataaatagcggggggagagatcgagagagagagagatgatatatggggcgcagaaacggacgaaggtagggatagatgggttggtggctggaattgacgtggcggtatatcagtatcagtgtgtgcatgcggcatgcattctcccatcgtccggtcaacttcaactccacctgtccatcagtggaactggaagtgcgtgtggaatgcaaccggctaccacttcactccatctcagcttgttaccatgttcagtgtgtaactaaacttaattcccaattagagtttaaacttttgtcccaaaacaaccttcaggcccttgttcggttacacagggattcattccgggccggttatgataaatataacaagaaatttataatagatacaacaagagaccaggaatatttattccgggtcaggaactaatttacttatattaggtataacaaaacatccggattagttccacacctcttgactagtggattgattccggtctattattgtccctatcatgagtaaattggttcccggcccggaataaatctcggtaaatcgttgtatatatcctaaatttcttactatacttgtcattctcggcccggattgaatccttgtgtaaccgaacaaggcctaagagtaaattttatagaatccaaactattatatggtccaagtttcttaaagccgtataaactttggccgatgacacataacctcaagtattatggttataacgttttacaaaaccacattactaataattttgagtttggtataccatgtacacttttcagttctacaatcacatctcaaatttatgagcattttattcattatataaatgttacattcatttttttatttcaatacaatagtatgtcaaaatagttaacggtgtggtttgtgaaactttaggagtatataatacctatagtttgtgccacatgtcaagatacctgtggttttgtgcaacttggactataataggtgtgtttaatgaaatttattgtatctttaatttatacatagtattcttctaccatgcttggtccataaatcaagaagtttaattttatccttcaatactttacctacttaaccaccaatactatatattttcctattaataagagactctttggttattttccttcctcgccgaagttctcttaggattctaatattcaacttacttacttcattcaaaacataagcactttgaggttttgcgcatggattatgaaagtaggaagatttgaatgaggaatagtatgattggttggtatgaaaaaatagacaaataaattaaatagatgatggttgtgattggtttccagttaaaaattcgcattgacaaatatttgattatacagtagccaaattgatacgaaattaaaataagagtataatgcattggcagcccttaattaaacttatcacgtcatgttatctaggttcttaaactttgaaaatgcacatctaaatcccaagactatatcatataggttcaaaactatcacatacccccttcgagtgctcgtgtggctaacacttcactcatttaatgacactcaatatgtgaacgtcgacgtcatgcggatactcaaaggggcatatcccagccactaatactggagaggactatggatcggacgtccaatgttttgcataacgtcggacagtgttgcatgacatttgtttcaaagtgtttcacatgtttcatcttttgatgggaaaatatttcaacacaatatggagaaaaaatgattcatcatatgaaaaaaatgtttcaactgttgaaaaaacatgtttcaacataaaaaaagatatatgtttcaacaattttaaattatgatacacaatccaatcaatactgaaacattttcttacaacaaatgaaacaccaattttgacctactgaaacatgcagatgattaaaaaaacaaccactgcaacattttagtctaaactaatgaaacatccaatatgttaagctgaaacatataaaaagaaaaaagcagcctagatatatttattcttcttctccagtggtaggtaggccccatgttgatgccggatcgatgccccccccctttgctaacctatactccat

SEQ ID NO: 32916 - DNA, 3226 bp, Oryza sativa
ctagtagattggtcagaggtctgacgattgtagaatagtcctcgatgaaccttctataaaagctggcatgtcccaagaagctgcggattcctttgatgttcacgggaggaggaagctgatctataacatcaattttagcacgatcaacttcgattcctcgttcggacactcgatgaccaagaactattccttcacggaccatgaaatggcacttttcccaattaagcaccaggtccttttcttggcatcgttgtaagactttgtctaaattctgcagataatgaccgaaagtctttccatagaccaagaagtcatccatgaagacttccatgatgtattcgatcatgtccgagaaaatagacatcatacatctttggaaagatgcaggagcgttgcacagtccgaaagacatcctacggtatgcataggtgccatatggacatgtgaacgtagtcttactttggtcctctggatggataggaatttgatgatacccggaatacccatcaaggaaacagaaaaaggaatgatttgccagccgttccaacatttcatcaatgaagggtagcgggaaatgatccttttttgtagccttgttaagtttcctgtaatcgatgcacatcctccattcggttacggttcgttgtggaattagttcattttgagcatttgcaacgaccattatccctcccttctttggcacaacctggactgggctaacccactcactgtatggtacgggatagataatcccggcatgcaggagtttcaagacttctttctttacaacttctcgcattgcattattgagccgtcgttgaggttccctagagggagtactctcggggtcaataggaatacgatggatgcagagcacgggattaatccccttaagatcttgaagcgagtagccaagaacagaacaatgcttttccaacacggcgagaagacgttgagtctcgtcttcaaagagcttgtcactgattatgacaggggcctctctgtcatggtgtaagaaagcataatgtaggcttgggggtagaggtttaagctcaagcggaggccaaggtggtggttccatgatcggcaggtcgagagtctcaccgggatccgcttcctctttgatgaaatcagggacctcatcttccagaagggcctcgggagactcgtgagggggaactgcaataacctcttccgttgactcaatttctggcagagggtctgtcaagacgatccttgcccgtgagaatggaattgaaaattcagtctctcccagtgttattttgaggctatctaatcggggtgtgttgatgagaagttgctcaattggcagcccgattaggatgtcaaaatcttggatttcaaagacgtggaaatccaagatcgcctccttgtcttcaaagcagacaggcacatcttgcataatcccaaatcttttgatgatatttccgcttggatgtttgaagaatttgtttgtcggggtcactgccttatcgcttaaataagcaaatgcaaaagacccggaaacgaggttggccccgacagttggactgtagagaatactgacgtcgttcccttccagatggcaaggaatgattcggggagcggtatttatccgaattacttcggatgaaagctctgcctcccttaaccattcatcgctcattatggttgttaactcccggatagtttctcgtaggaacctgagttccataggatcgggaggtggcaaaggaacgagtggtttcctcttgctaaaatagttcaaggtattgccatagtcttcatcaaaaccgtccttgaacaggattgtggcacaatccggagtctgaatttcttcattctcgacggacggctgctcaggaaccttctcatcaatcgagctagcgaaagtggatggttcagcaaggggctcgatcgttagaggttcctctatcttggacacggatgcctccggctggggttcattgggttgcgtcatgaaggaagtattttctagaatgcggtccaaaattttctttccttctgacggtgttttgtgcatgaacgattgacggagcgtggggctcctcaccgggagaccgcgcaggcccccctttgccggttcggccgggggcgctaagtgaggttcttcgccctcgatcaatctggagaatgttcgcgagagagcaagtgcacgagacacgggcgatgtagacaggttcgggccgctgagaagcgtaataccctactcttgtgttctggtggatctgtgtgtgaaggagttatagagagccggagagctagagagttcaggctccagaacccctctagcctcctttttttctttctcccccctttttggtgggcaaggtcctccttttatatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggccctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgttgggttggagtctctggatcagggatgacgggcgggtgacgcaggagcgcgcccgcagcctggagcgcgccctggggcgtgctgccatcaccgtagatgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccattgcccgttcggccatggggctgagcgggagaagcttggcacacacgaaagagaacgagggcttagaaagacacacgcgccccctacctggcgcgccagatgacggagcgtggggttcctcaccgggagaccgcgcaggcccccctttgccagtt

SEQ ID NO: 32917 - DNA, 7026 bp, Oryza sativa
gggcggccacatcatttttgggcccgacccccccccagggggtcaggccacatgggtgattgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcggcagaaacccagcggtcgcaaatcgcgcacatcggcaaggaaaaaccgaccgacaataatgagcggctttcttcaagaccgctacattacttaagtagcgcgcgaaccgggacgagccggttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcccctctgaaccgctacgacgccgttcttgaccgcctggcgggtctgcgatcccaggggctcacgggggccatggtgttcggcgactaccttcgtcgccggatcgcgccactccagcggcgcgcccggggcgcctgggagtacaccaggtccgaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccaaaccatgccggggaaacctcatctcccccccaaggtggtcgtttagccgacctcctcgcaggttcgtccccgcgcccactgtggccgtattcattctcccaaggcgagttttcacttacccgtttctttttgtcttctggtttttcttccgctttcagcgagattccgtcgcgcctccctcaccattccaagtccggccggtctgaggccgaggagacagcaaccgtggaggcccggaggcgggaagctgtccggcgagaagccgcggaccgcctccgggaagctgaggaggctgcccaggaagccgtccgggttcccaggctgaggaggccgctcgggaggaggccagactccgccgggccgggaagtcagcccgggaggcagagcgacccgcgcacgccaggcggcctgccaagccctcgacccgactccgcccgaggcgacgacgacttccgaggccacccacgatgaggccgcgggcgcgccgctcggacccgacccttcgggcgacgttcgggacgagccagcctcgggggacgcccctgagtccggcacgtcgattggcgggccgagccgcacagcgcccacaccgaggcggctctctcctctgccttccgccgccccactgaacacagagcccctcctgcaggccctggccgccgcgaacacgacggtgctgggacgggttagggcccagatggaggtttccttgcaagcagagcgggcggagctcgacgcggcgtggcgtgcgtcgatgaggggcggcgctcggtggaggccatggtggaggcgggccgcaaggcataccaccggcacgcctcagagctcgaggtccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacaccgcccggggagtccttgacgccgccactgcacgggaacggcgggcgacggagaacgaggcggcgtcccggcggcgcgaagtggcccttaaggctcgcgccacggcgctggaagagcgcgcccgcgcgagggagagggacctggcggaccgcgagaccgccgtcactatccgggaggcaacggtggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccgcgaggcagcacgggaggagcaggcgcgccgtaatctggaaggcgccagcgccgagagggccgcactggatcagcgggccgctgagctcgaggcgcgggcgaaggagctggacgggagggcgcgcagcggcggggcggccgcgggcgacggcgatctagccgcccgcctcgcagctgccgaacacaccatcgccgatctgcagggcgcgctggactcgtccgccggggaggtcgaggccctccgcttggcgggcgaggtagggcccggcatgcttcgggacgccgtctcccatctagaccgcgccgggcggcaagcggccctctggggcgagcggaccgcgaagtacgccgccaaccaggggggcctcgcccagcgcctctcagagatggccgggactctccagcgcctccccgaggagctcgaggagacctcgcccggggggcagtggagcttgtactggcaagctaccaggccagggacccggacttctccccgtgggcagcgctggacgagttccctcccggaaccgaggacgatgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactagccaggccgggagcgcggtgaccgagggttatggggacccgattgtgggcctttgccgattcccccccggagttcaccacgtcccggggcacggctcggttctgggccccgtttggcgatttccgccggctcgggccaccgagggcagggtcgagcacgagcgtgctaattcaagccaagactcttcaaaaggaaacaatggcacagacacagtccttaggaaatcaaaaaagcttttattgaaatacggaagagaaaaaagataagtatatgcatatgtggtagcccccggccaaccctgcacgcccgaggggggtgcgaggttggccagagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctctgctggtagcgcgcggctcgaatggccgcgcgccgccttcgttcttccaagtagtcgaggtcatctctgcgaagctgatcttgatcagcctcgcagtacatagtggcccgaggggacctcagggtgacctcggatgggagaactgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgttccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgatttaagtgcggagtgcttatcgatcttgatgaccggataagcctcgggccacttagtgaacttgtcgatagcgacatacagatactcgaacccgcccggggcccgtataaacggacgcaggatatcgagcccccagtcagcaaacggccatgacagaggtatggtctgcagggcctgggccggctgatgggtttgcttggcgtggaactggcacgccctgcactgccggaccaggtcgaccgcatcgttgagagccgtcggccaatagaaaccctggcgaaaggccttgccaaccaaggtgcgtgaggcagagtgggctccgcactcgccttcatggatagcggcaagaagctcgacgccttgttcccgaggaatgcactccaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctagggtcccgaggcctggactccgacgggcctcaggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatattgtggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgggtttcaaagtgcaaatcgaactcagagagttcgattgcccatttcaccacccgtccagtaccctctcggttatgcaagatttggccgagggggtaggacgtaaccaccgtgacccgatgcgtctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgccaggggccgcatctccagggcgcttttcgtccgagaggccgcgcggggcgcactcggcttctgtgtcgacgacctcggggtcggaaggcgacaggcgtggccttcccgcagtggccccggggccatcctgggggtcgggggctcctggcaccgtcggacaagcaggcagagggccagctccggtcgtcgggggcctcgggcagccgttcggctcgggggcctctcctccctgctctctcccgggtcgagtcgatacagggtgctcttcgtccgagaggccgcgcggggcgcactcggcttctgtgccgacgacctcggggtcagagggcgacaggcgcggccttcccgcagtggccccgaggccatcctgggggtcgggggcgcctggcaccgtcggacaagcgggcagagggcc

SEQ ID NO: 32918 - DNA, 1758 bp, Oryza sativa
cgggcagagggccagctccggtcgtcgggggcctcgggccaccgttcggctcgggggcctctcctccctgctctctcccgggtcgagtcgacatagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccgtagcgtttgaggagcttaaataggggtagcgccttctctcccagcctcgatatgaaccgacttagggcggccatacagccagtgacgcattgcacatccctaagcttgctggggggcgcatccgctctatagctcgtatcttctcggggttggcctcaatgcctcgggcagagatcaagaacccgagaagcttgcccacaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgtgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccagtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcaccatggacggtgatggggccaccggggcccgacatcttcatctggagataggcgtagtggaccgccaccatgtacttcaccaacgcaggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcggaggaaaggatgttgagggctgcacccccgtcaatgaggacacgccc

SEQ ID NO: 32919 - DNA, 10363 bp, Oryza sativa
tcccccatcaacggtggcgacggtggcctcagctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccacgaggtcgtggagggaggtgttgtgcacggtgcaccacttgccggtcgggcgctccctactgggagcgccggcctccttttttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcagtgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgcccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctatcctttcagggccatggggaagaaattcgccgtagacgaggagacgacgctccctgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccatcgtcaccgctagcgctcggagagagattgtgcgccattgcctgttcggccatggggctgagcgggagaagcttggcgcacacgaaagaggacgagggcttagaaagacacacgcgccccctacctggcgcgccagatgacggagcgtggggctcctcaccgggagaccgcgcaggcccccctttgccagttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctcctttttttctttctcccccctttttggtgggcaaggtcctccttttatatctcaaggggataccacatgcaccacttctacctacttttcttctgagtggggacctaccctatcttgaccaaaacttggcttgcaccttcgcctggaagctaaatcacaacttgtccttgagtgaggctcagcgccgtcactcgcctgacaccggggatctccctgttactccctcattaatgggcgaagatttgccatggctgctttccaaatgaccatccgatgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccactcacgtggcgccaaacccacagggggtcggggcgccccagccctcggggccgaaacgggagcggcccgacccctcggggagacagagggaggggcggccacatcaccctcgggcccgacccccccccccccgagggggtcaggccacgtgggtgactgcagctgccccaaacctctagtcaagatacccccggtcccatgtcaccgacaacgatcctccagcgattatgtccagatagaatgcagactccttatccaaacccgtatggaaatgttgaagaagcacatacccgggtaaggacagggttggtccagactgcactaaattagtgaatctggaccaggctgcaccaattgattcattttcgatctgcttaaaactgagaatttctactcgtagggcagtaatacgagtaactgggaagaaggtaagacagaatttgtctcacaacttttcccaactaccgtttacacatccaacggtagaggtgtaccattgctttgctctctcttaaagagagaacgggaacaatttccaccgcacagtttcttgtctcatgccacgaatcttaaggcacgagcagacttgttcaaagtctcgcagatgatggtagggattttctagatcaaacccagaaaaaggatttttccctaaccatactgattagttcgggatgaatttcatagccagttgtataaatgggctctgatgaaggaggtggctcatagaattcaccccgaggagcagacagctcaaaaagcggttgctccatggtcgagaagagtttgacaggaatacttctttaggatagcaggggtagatgtagaattaaaaaaacaaaaaggatacgaggatgaataaggtacggaaatgatcagcaaccatttccccggaaacggcgccagaaatgcttgttggtatttcttatggtcacagataaaatttgcaagcgcacagatataccgatgtagcacttcccctacggagtattccaagggtatcgaatccaatggaacgtgtgtgatcagatcttcctccggttcatccaaggacaccaagcaaatgataggccaggatagagaggatttactagtgagaaacagtgtctagggaaagcttaactttaatcctaacgcaatacttcaggcactggcaacccgctgttcccagatgtcgctctactacgtacccggacagggaggacttaagtgatctcgagggctgtcaccacctctacacccacctcaaacgtactgtgggatacgcagtaattactggataacaattacttaaacatcacgtctaagcaattactgtctactttagtgtttataactcaccaaagcaatcactatatttagttgattatagtgaacaataattccgtatgctatttaggaactaaccaagagataattctcacaaaataaatctaaattactcaagaagaatattatattgaattcagagtaaaaaatagaataaaagaaataggagaagattaccgacaactccggaattcttccgactcctactctactctcttccgattgtaatatacaatatagtacaatagagcctcttataatttagctcaagcttggaagtgtgtgtgtgaagtgagagagtgaagcctttatatagaggtaggtatgacggttgtgagaagctgaaatgtccgaactgccccgcaaccgccattaggagatgatcaagaccgtccacgccaaaccccagcctggatggctgagattaggagatgatcaagaccgtccacgccaaaccccagcctggatggctgagattgtggtccggccgaacctgggctgggcccatctggcttggctcttggcccatgttctcccctgatcctcctctattcattcttcggtattttggctgattcactgatgttttgatgaagttcacaacccatccttgcagggatacacatttctcctcactttagtctgattttcctcccaacatcggggtttatcgtctgcatacaaatatataccaacacttgtggaatatgtgagattaagcacatatcactatgttggatgttttattatccgaactttatgcagatgttggcggtacagaatcggtatttaataaccaccaacagacaccaatgtgcctacggggcctatatacctgagggaccgtggggaaacggtgaaggagcagtgaacggttgagagacaccaatgtgtgaaaggggaaattgttgattagtcccacattggttgaccgtgggtgcctgcgggggccatatacctgagggaccgtgggatctctggcccgagggacatagtatgtgaaggcttgatggaccgtgggtgcctgcggagcctatatacttgagggaccgtggggaaacggtgaaggggcaatgaatggctgagggacaccagtgtgtgaagggggagattgttgaatagtcccacattggttatgtaaggacaagggacctaacatataagtggggtcccctcaccttaatagctagcttttagggtgggaaagaccctttacgatcttacaagtgagcccatccacaaggcatgacaacggcggagggggctccagtggtccacagctaaggaggagaagaggaggcatgtgagggagccaataagcaagatgacgcgctcatattcctctacgatgcatgtggtacgcttcttggcagacttggcctcgcgctccaagcggagccgctcctcctcatgagagcgtgcaagctcaacctcgatgtgcgacgacttgcgggcagccatcttgcacgacgcgaaggtagaagtggcttggccttcgcatggtagcggttctcaaccatgcaggaggcgacacacggcgcgagacttggggcccttggccttgcgctagtactcctcctccttggcgcactccatgcctccatgcggtcccaacggttagccgccgtgatcgcaagccacctttgccttggagttgacacccatcttctttggcatcgcggctgttcatggcggcagtggctggtggcacggtatggggcttgagcgaagtcggattggcatggtagatgctgaaacgatgacgacgaggtatatatatcccaacctacccatctcccttatctctgtcctctcctcctttgcagccatagatagccacggtcccatcctctccccacggcgagctcgagctcgccaactccctcgcctccctcctctctccactgtcacgggccaccagagcctcctcatcatcgacctcccactgctattgccacctcctgcaaacgagctcaccggccactacccctctccccctcgatgagctctggtggaagagaggggagaggtggagagatgggggaagagagaggataggtggtcggtgagctcttgtggaagtgaggggagatgtggagagatgggggaagagagaggataggtgggaagaggtaaaaatccacttacatgtactccctccgtaccaaaaaaagacaaactctgggtttccgtgttcaatgtttgaccatccgtcttattcgaaaaaattatgaaaaaaattaaaaagacaaatcacgcataaagtattaatcatgttttatcatctaacaacaatgaaaatactaattataaaaaaatttcatataagacagacaatcaaacgttggacacgaaaacccagagtttgtcttttttttgggacggagagagtagaactcacatgtttttaaatatttctttttattgactaggatgccacgtcaagacaaaacaaccattcataatgtcatgagacttgattggacggttttgctaagatgagtaaagatttctggtatcacgatttagcgatgttaattaaactctgaccgaaagatttaggagacaataagtggacttattcctttgagtaatgcaaattttataaggctagtattgggccttagggaccagaattcaactaagcccagagaaaacaaatagcatactgtttacgtgctttataaaattttcattctcaaaaaaaaatctaagtagggcaatggtacaccgtacaccacacctctcaacggaaccatatatggcgagtaacgcagtgctgggtgtgtttgtccgaggcgaaacaaacccttagaagagcagcttgattcagagttgatacatagtagtaatagcatagagccatagaccattccaacatgtacattgtacaaagcggagtctttgtcgaacgaaacaatacccaggagatgctgcaccacaaaaaatcgaagcaaaaagggcaaaaaaaaaaagaaggaaaaaaactgagaagttgatctttcgttggaggaggttagctatgtacaggttcagcatattcacacttgaccattgcaaatatatagtactcctatataacaaaactgccagtctgctccaaggcatatttgagttcagtatcacaaaacgaatcataaaagaggaataaaatgaatggagcaattattgtatccacataatagtatctttttttttttcatcatcatcatcatcggacaacataccccaccaaaatcaccatgtccccacagccctaaacccatatacctcctcattgcatgctatcaaaagtaataatacacacagaaatgctaattactgtcctacactatgatttgtgctttcagtggtagctacctgttgcattatcaaaatctcttttaggagagccttctaacaaaggtaaacggtgtccatggatggttttactgggtttctactcaacagtgacaacatggataggggcacaaggattgtacaatcaatgcttcagcggttggggttgctgttcaggtaaaggagggaatacatcaagaaggaacctgtgaatcatctcaaagctggtaaatgttattactgcggcaggagttgtccgcaacagattagttgcacatccacggtagaaaccggtcaaaccctctatatgatagacctttctgatgcagtccattacacctgtatatctcgccttggagtgtgctccctgctcctgtaaccttgagcgaacaacctgtaacgaatcatttcagatatatagccaccagttggccagaacaaagttcagtacacttattacaagactggcatgcatcgtaatttcaaagaaaagactctacctcatgaggatatgtcaaggttgacgcagcaacttttgccagggatgaagcaacagcaacatcaccaaaacttaatgcctccactgtagtattatctgttaaagcatgacgctgttatatgtgtggaacaaaacacaatctggagtgtacaaatgtagtaaacatgtgcaagccagataagctttgatcttctcatgtgcaggaaactgaatagcaacatgactgataccagccaaggacagaagttgagagagtacctcgctcagccagataagctttgatcttctcatatgcaggaaactgaatagcaacatgactgataccagccaaggcagggacaagtccactttataaaaaagaaaaagaaaaatatcagccagcgcacaaaacatattatcatcaaacggtgtaaaatcttgcatctgtggacttccatggaaagctacctgtacagtccacgaatgccttcttcatgtgctattctcttcaaagcagcaagtgtacctttgtacgggatcaccccagctcgtatcccttgggtctacaaaagggaaaaggatacagatgatgatatgactcaaaataaaatctttgaatcaatttgtctgagtatagcatgtagatgttgactgcttagtatggacaggtaaaagatctaaaagaaattcagcatatttataagtgattataattaatgatagctccattccaaatgggcattcagcctgtgtaaagaccatcagtcaacattaggaaagaaatgggaattgcttacaggttttaaacacttgcctaatataggccagacaaaatatttggtatgcagcattttgaaattgcaattatgctatcaggcgtcttggatcgactactggtccagacaagttgtggtccaaggatacctgaaatcttgtcttcacaacccaaagtggatttgttgcaatagtagttgcacctccagcacatgatgcagcaataacatttgcccctaaggacaggtgatgacttctatctgcaaaatgaatgtacgataccacataagaactgacaaatgatatgctgtcaagtaagtcatatgcagggtaaaacactaaccattggaagaaagcaagcttttaagctgctcatacacagtaaaatagacctggaaatccacaaggatactattagctccacaatagatcatagacacttgattcatctatagtgtagtgtactactctactcggtgccatacatgggtttgcatgcagatcaacttatagcattatcattagcatcgttgctttttacatagaatttaaaaacatctcatcaatggagtaagtggagctataatgtaagggtaaagactaaccgcccagttaggcaagagtgccagaatagttggagataaaccacgatacattccccgaaaaccttccctctgagcaatctgttgtaagcttccaattattacactacctagtaatgatagaacaaagaactgatgtaataaaccttagcttctgaagaatcttggtatagtagaaaacaatttagtccagacataagcatttcagaaaatatgctactcatcaaacttctattgacaaagatgcaaattcaacagtaaaaagtacgaagtaagtgcattatcaatgcaccaatgctgttggccacgtacataggatgacctgctggcattcttcagagcataacgggccacacatatgccagcatccatgaatgcagctaaaacattttttgaattcaaagcatgtacgtcagctgatgttccaggcaatttaggttcagcaaatgtgtaccaataacatcagaaatccaggcttggaagtattacccacactatactacacccatggacatcacaaagtctgttggcttttttcacatgttcatgtatgctaatgcttttatcatacatcaacgaattcatgcaacagcaaatagcacgctgcatgctttccttccattctcaatgtgcacgatctcataagttcccaacaattccgctcaacacatgtgaagctcccagccccactttgattggaggtactgatagattcaaggtgcgcaaaacaacaacgagagaccaatcaaaagcctcagataacagaaccgtccaaacaagcaatccgaaaccgttacgacatctaaaagcagagagcagatctttcgttgccgacaagtattttctcaactccctgaatcctggaagtgtccgagtaaagctacacaaagagaaaggcacaaaatctgcaccggtttaccatcattcccctgcatgcatgatgcatccactgtatattctgaccactatatgcactgactttaagtgctcaaactcctatgtgctcaccatgcttcatcaagcataggatagaaattgcagtctataatagatttatgtgcagctctagctctgcagcagcaaactgtagcaagcaaagattcgcaagaattcctctgaagagacacgcacctccaattgtgccggtggcgagcttgggccagccgtgcacctgaaacctcgtcttgatcacatcgagcgggcacacgaaggtcgccgcaaccacacctgcggacaagccccaaaaattcaacgcttgctccacatgggcatccccgaaacacacaaattgacccaaaaaaatggataagatagctcgagcggtcatgtgttaccagcggaggcgccggcggcggcgtggcagagcaggccgcgggcggaggtggcgtggtggctctgctgcgaagacgcggacggcggcgccggcgccggcgaggtcgccacgtcccccggcatcactcccccacacacacaccgatctgctcctcccctccctcagggcacggaaccgcgcgccgccgcgtctagggctacagccaccgctaccctcccctacccctaggagaaggtgaagcccgggggcgctacgcgagggcgcccgatcgcatccgccttcggggggtcgcccgcgacgtccgtggcgcgctcgtcgcggcagcaggaggcg

SEQ ID NO: 32920 - DNA, 4992 bp, Oryza sativa
  unsure (1)..(4992): unsure at all n locations
cgtggtcaccagccaaggccgtggggcccacgagtcattgacacgtagtcctcgtttacgtgtacgtgtagaactttaccagcttattagttaggccacatgtttttgactcaacgaaccccgtcacccgaccacgtcactgtcaggtgggaccaccgcgcggtgggtccccggtgtcatcgatggcgggacgtgggggcccacggcggtgtctggtcgccgcttaccacccggggggtgacgtggtggaacggcagccgtgcatcggggacgaggcggaatcgaccggacggcccagatgggctcgcggggaccattttttatttttcttttcctcgtttcgttttctttcgctatccacagcgagcgagagaggaaaagataagcacgaagaattatgttgctttgtttcgccatggtgcggcttgtactgatctctcccccttctctcgatttgtggggacagattggaaaatcggacataatatataggtagattgtccaagtacttgaaaatagctcaaaattttgtcttgtttgtactacccaagtgcctaagtagttggtacacgtacgtgactcttatcaatgactttggttcgtaaacataggtatttggcaaaatttggtacatgagtacatgacatcatgacttcgatatcttcaccgtacgacattacacaagtgactttagaaaaaaacactataaaggtgatttatgattaaataggggagaggaacaatgtgaaagttgtgaactattgtttctctcccatcaaattagaaatcaatattttaataggtacggcatccatgagttaatttttacgtttgtagagtattttcttccaaaagctacttttgtacgatgttctacagctaaaaccgctaagtcacaacattctttattaaatttttccttattatttttatcattgctctgtgtttttatcctgaatgtttcttgccattttttttctttttgttgttatatggcataagtactcccttcggtcaactttattttattttatgtatcatttgttaaatatagataaaatggaagtcgatccaagtggatttattggaccgtagtaagccaaaaattgaatttacaacttaattttcaagttaattttttatattatagtttattttatagtatttgcttttgtatcgctaatgagtaaggacacttatataaatattttacccatatttttttctaatcctttataacccactaactcctaaagcttaacatgcaaaggtgccacatcatcatccactaacaattaatacatttaatatcatgtaaacatactatattatctaatttaaaatttattacattttagagcttttaaaatgaaagcatgttaaatcatcatcccacataattcacataatatttcaatatatattttcattattttttataatatcttatatacctatacaagttcatcctcacttggttaatattatttctctcttctctaaataagccatatcacataaattgattttagtgcttatgtaagtttatattgtttagctatattacatattatttttacttattattatcatattgaagtcccgcagtaacgcgcggggtttcacctagtaaacatactaattagtataaataaaagcgaaaagatgagattgtaagaagttgataagttattagcttgtatttgtattcgtaaattagagtggatctaatttatggttttgacgttacgttttaacaacttatacgttattaaaataaaatgaaaattacttaaaaaatcaaatgcggtactacatctaaccggcacgaaataagtgaacccaacatgaacacgtaccctaaacctcaaataacaggccaagaaacaaggtaaaccatcattagctacatttaagataacccctctaattacaagttattaccatccacacgaaaccgtatgaaatacatagaaataactatttggataaaccgtaggaaaaacacataaactggaaattcctacaatgttaaaactcttgataatttttctccaaaatctacattgagcaaatttataaggaattctatagaatttgggaagatccatttctttatttcaaatggtcaaataggaaatattcttacagaattagaaccctaaaaaaaattctgcacaaatccttttgttgacaccttcgaaacagacacgcaatagcctcttatctgtaaagaaagagttgactgtccagattagaattggctgtccaattcgatcccccaacaaacagaaaccaccctatccatccagccagagggaagatctggtcggccaagaaccgaatccagtgctatcaagtatcaacacaagattgctacagccaaccacgaattgattcccgaatgcaaagtaattatcaggaaagagtgacagcaacccaggagatcgaaagggagaatgatcgcctttaattcctaataattcttcagtttttctgtctcgccttttttagatctctgttgatggtgctggtaatgccacgtacgagcaaaagatgaaagcatagttaggaagtaataattctgtataattatatgtacctatcacgaataatgagagaacttgcccttttaaagcttagatcacttgaaaaaaagtaatgttgagaactctggattactttgtgccttactggacttgctggacttgtgggaatctactgtactgccacaactatatggaatacgagaaattttttttaaaaaaaaagttcctacattcccgtaaatgaaggaaatgaattcccttgagcaaaggtaggattcacgttcatctaaatacaaacattctagtgttagttcatgaaatttcaatcgtctccaactggcacattggcacatttctatcatgcttcctgataataaagtccattgccaccaaaaagatgcatgcctgaactgtcataggctcatagctcctaattagcgataacacaacatggaagaaatctgagcatataatatttacagatggcagcaacagctgctgagatcatgtaagatgtgagaaagatatgaacagattgattcttaacttcttcctggctaacactttagcaagatactacgtccacagtcaactttgatcagcccttaattttagaagcgtaatgtactccgtgaattcttcacccgagaaacctgcaacgatggttaaaatgtcacatgatgttcaggattagcatataaacatggcagtttgatactttgatgtttttagattgcacttacaatatgggacttccattccactttgcatccctcggtgacaccaaactgaggctgtcccttgacgtgatggaatatatgaacaaggaccacagcatcaagggcagcatactctttctgcaaaaggaggaagaatctctctgttttagggatggcgctttttgtcctcgatgaacagtaggctatcaaactaactcgtggctttagattgcaagatgaagcatgtttgacttagttttaactaatggtgtttaccaagataagcttagcacaagatctgatagaaaatttgcttgtacatgagaataaggagaggcatcttaaggtgatgttaaaaatgtggtaatcgacaggctcatttctaaagtaaatttctttttctacttttttcatacaaacacctgtcatggttagaaaagtattgtgaaaataaattcagaatgagactgaaaaaaaaaactcacaatacaaaattatgagaaattaattaatcactcataccaacaaatagggcctttcaaggaataaggactcgtgaggacagcttttaaggaatatgaaagatgacagacctgattctgggtgagagggcgctgttcccagttgctattccgtcgcgtcttgttcaaaccagctcctaatattttctgatacattccgtgataaataaagatggaggaccagatgattcacactaaactataagcttaaaaaaaatcaaaactggttcaacgtccagttaagtggagcctataccgctatagcaattaccttggacagcccagatagaccaccagtagtccctttgaagagcttctggatatcaagcagcatttcataggactggaaacatttcaattctccatatgattgtgatagttgatgcagatcacattgcagattatatcctttggtttacaatggggcaaaaataagtacttgtttaacaggatgcataagaaagaaatgttgttttcaggaaaacaagagtgtatgggaagatatgggttttttaatcaaaatagtacgctacctagctttagtatgtttgaagaacacataattcgcctgaagcagctatccaacacttttgggtcatcttcatacagcttgatcagatcaaaaataaaagctttcttatctgacgcaatttggataatagagacctaaccatagagcaaaattcaattaatgcaagaactgacatagatagataaaatgcagaatttctgaaagaggaacaagtaaaaaatatcatgggaacttaaggataagatagtcgttccaaaacaataaacactgtaaagaaaatatcactgagatgatcacaaggccatagcttactacacagggagtgatatggataactgaatactagaactactaaattgcttaaatgatacctaatacaatttatttatcctattttatccagtgatgccttttgaggaagaacagggggagattttcattcagcctgctgtatcgccacaataatgcaacatatgattaccatacattaggaaaaatgattataattgtaccagaaaactaagttaaacatggaaactgacagaaatttaaattaagacatcgcttaccttattaggtttgctacctttctcaaaattaggcttccattcacaatccacaccaataattttannnnnnnnnnnnnnnnnnnnnnnnnnnnnnnnnnnnnn

SEQ ID NO: 32921 - DNA, 589 bp, Oryza sativa
cgaggatgcatagttatttttcatattttgtactacatccgcccaaaatataatttttttaagtatgaatttaaacgaacagttatctaaatttataattagaaatacttatattatattatattttaggatattggaatattctgaatactataataagacaagcgtcactcaacaccaaatatacaatgtgaaaggcagtggtaattaagtggagtcggcactcaacaacagtacgcatgtcaatgttcaacttcggcataggtacacgtcatctcgccgacagatcatcatcagaattcagatagatccgaatcatacccagctggtgcaagaacgcatcacaacgggcccctgaaccctaacgcgtatatggtccatgatggattgatggatatgcatggctctcgatatctctccaaaaacgtgtgattttcactgatgaaaaaacgtgtgatttatgctatcctaatgccagcatttcccacgtgcacgattggaaacattcctggatattgcagagatcatatgtatccatttcttgcttaggataatttgttttgtcagattattttcttaaaggaaaatt

SEQ ID NO: 32922 - DNA, 836 bp, Oryza sativa
acctccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccagcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcagatctagcggaaactttgagaacctccgctccgcccgcataaagctgagggggatccactagtggagattcggccgc

SEQ ID NO: 32923 - DNA, 833 bp, Oryza sativa
ccatatgttggagtacagcgtaatgagcctgcgcgtacgatgcttgatcgggcctaattcttttccatccgattgtgccaacacctgacaaccttccctcgtgatgagatgcaggaactccgataggatcggcatcggacatgtaattgacacagaactcactcggtcgtgtaaccttcaataatgctcccctcgggtttagctctattacgaacgtacgacttcagaactcccttgtacctttcaaatggccacatttcccttagaaaaaccgggccacataaatttgtttgcttcaccagatgaatagggagatgaaccattatatcaaagaaagatagtgggaaaaacatctccaggtgatagagggtattcacaatatcggtctgcaacccatctagatcttctggatttataaccttctgtccaattgcattgaagaaggcgcatagacgttggatcgtgtgacgcaccttcggtggtagaatgcctctaatagcaactggcaagatttgtgtgattagcacgtggcaatcgtgagacttcattccaacaagttttagatcgtccaatttaacatacttacttatcctcgctgaatagcccgatggaactttaatatccttcaagcatgataacatcgcgatcttctcatccttcgacaatgtgtggcaggctggagggaggtacactctacctgtctctgcatctcgtatgggctggagtttcatgtcctgtagatcaaggcgcgtgttcaacccgtcctttgtcttcccgggaatattcaacatcaggccaaccaaactctcacacacattcttttctacatgcat

SEQ ID NO: 32924 - DNA, 16499 bp, Oryza sativa
atgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcatttggacaagcgtgaattctacggacctctaaccccagtggacacagaacctgctttgcttcgtatgtcgtcgtgggtaatgtgttctcaacaggaagcatagccttcaaaattcctaaaagatttgtgaaactcttgtctgtccatccactacttgccttcagcttcattaggtccaaggtaactgacaacttagtgtgttttgctttgcatccagcgtacagaggcgtctcggaatcactgaccaacctgctgaacttcattccatctctctcattctgggctgggtcctcaacgtcacgtaacttgtcttgcagcagatcgtgatccacatcaaccatttcaccgcccaatggagaaggtataaacatgtcatgctcatcttcatcttcctgattatgcgcaccacttctgtctgctgctactccacttcctgattcttgctctccatgcttcacccaacatgtatagcccttcatgaatcctcgttgtaccaaataaccgtgtacgtcctctgcgctatcaaacatattctcattcttgcaatctacacatggacaacacatgtaatcactgtttcttcttttccgatcctcctccgcggcgttcataaaatttattacgccatttctgtactccgtagaatgacgtttcaaatttttcgcatacatccaacttcgatcgattgctacaaaataaaaaaaacaaattgcatgcacatcttataagatcagtattgcaaaagtaatacgtgatgaaatttctcaattaatgtttaatattactcacttgattgatccattttgatcacttttaggaattttctgtttttcttggaaaaaaagacaaaaaatcgccccctacagcctcccaccaaaatagtgaacagtgggatacagttacactaggtggtaggggtatttatactgtgcaataaatatctgtaatggccctaaaacaatcaaccgtgacgggcatacaagtaatctctatcgggtcttaataaaagcccgtcaaaaaagagtgtcatctgtgatgggcattaaacttatctcaatcgggcctctagttggagcccgtcacagatgaccctcatctatgacgggcttcgtttagggtccgattgagatatggaaccctcatcttaatcgggcctcaactatggcccgtcacatataagtgtgatccgtgacgggcttaagttttatgccgatataccatggctgtgcgaccatatctcaattgggcgaaacttcggcccgattgagattacttccttgtgacggctcgcaaattccagtcttgttatgggccgtcacagatggaaggatctgtactggtgttaattaatcaacctatttggccagttagggatcgacgttgcacagtgaaatttgtacggacagaaacatccattagcttttgattgtttgtcatcagttttcatctctgctcactgtcacacatgtacttcagagactagatgactaaaatagaatgctgaatgtacatatttatagcatgaaaacccttcggacaaaaagttactccttccgtcccaaaatataacaaccttgtattggatgggacacatcccagtacaacgaatctggacaggggtatgtctaaattcgttatattaggatgtgtcccattttatacaaggttactatattttgacatggagggagtacaagcatcagatggcatggcacgtatgtaacacaggcacaactatatataggtcacaaaacgtaagtccatgaaagagaggggtaaaaccgagttgcagactggttgtctgctctcggttgtgcctggcaaaaccacacccagattctactcaattctactcaaatcatttgcacaatattgagtttaacaatagaaaagctaaaatgtacgggaaaatcatttgcacattatgagttcaatttctagctttgtgactaactagcttggaaaaaaaatattttctgaaaaggtaaaatgtacgggaaaataatttgcacattatgagttcaataaaagaaaaggacgtcccgcaaaaaataaaagaaaaggacgagatcgatcagtgtctaagaaaagattaattggctaggtcgaaagatcgttgtatatacagtttgccctcggtcgtcagataccatatacaaatagggttgtggtttaaactagctatgtctggtaggcatcaggaacatcagcttgctaccccaggagcagagatgtaggtagcaagttaaatcctgctagcctgcatgatccgcaagggatgttctcaatttggaagcggcaattttgcggtatacaggaacacttccctaagcaagagtgtggtactgtggtatgtcatttagaaaaataaaaagttattgcttccagtttgttctaatcaaccaaactagtagcaaactgtgaaataattaacatatatcaggatttgctgaaagcacaatttaacatggatgatggatgacatttgcccacaagtcctctactgtgattccacatgtacgcttccaagtcagcccacgtgcacgattggggcgtgagccaaatctgacttggaaaatgcccaaatttggccagacctttcggtttgaaagggttgaaatggattgaagggtttgatagggaataatttcacaccacaataaattttgaaataaatcctctccaatccttctcggaacatagccttagccaaattgggggaagatcttagggtgggatcctgtgagaattaggagcccacgctgttttcggcgtaacaaataacgtgctggtccaacacaaattatgtacaaacaaactttataaattaaaaagttcatacataaaaggtgtgcataggaactacgcattcgtgtgtgtataaatttcaaacaaattcattagcgttttatctcagcaaaaagacaaaagttcatacatagacctttatacagaaaaaacttatagattcaaattttgttgggcataaactttcatgtgtacaaaaccattccgtgttattgcgcgatggtgctgtgtccatccaattagcacgatgaggccctgcatgttcttctgggtgtgcctatgaaaaatattaaactaaacgaggaaaagtaagagacggctaaaaatgagagagaaaaatcataaaattaaagcaagttggtgattcctgttctactttccgcaattacttgaataatgtagtccagtgaagaactcaatgtgctcgaacaaataggataggcattcatctgctattctttgcttgcaagtagtttatcaatgtatcataaaaaggtggtggactgaaattgtcacgttctattatcatattacgagcaaattgccggggagatagagtctgtgctgaaaatcaatttcagattagtaacttcggtagttgataattagctccagttcagcagcaattcataacgcacgtggaatacttcagatgataaagttggaaaacactgcactgcagcagatgtcgaaagaaaagtcacctacacggtgtgcaggatggaagaactatgggtgtgtttggttgcttgcataccctcatcctggcccatctcaaggaagagtgaagcgacgaggaagaggaagagtgaaggcccaggtggcgatggcgacagtcctccctcgacggcgttcagatctggcggattcgactgagctcgagcatgtcgcctccgcgcgcgtctggatctggcgaatccgaccgagctcgagcacgccgccctcgccggagaggatggtggtgccatcttaggtcagtcctttgcttctatctcaggtcatcgtcctcctcttccctttctgatttcgttgctactcttcctctccaaatcgtagattttgaattttgggggcaaatgaggagggggcggattgacccctgcttgccccttgcacgcgcggtgcaacgccttgcactcgcgggtgcaacccgctgcatccaccgggcctgcccgagataggaagctcgaatcgagcgtttctcctcaacctggctggggagccctttttgcatcagcggggccaggctaaaaatgctgcacaggcaaccaaacaacaggaagttgcatctactgatgcaggcaaagcctaatgcaggcaaccaaacacgccctatatatttgtgcagagctctgccttcttgtatggccaatcaccgaaacagagtcacgaaaatatcttggatatgactggcctgtgtaagcacaagagagaaataccggcaaggcccagtattctgcagattttttttatctattttagaccttttaaataaataatttaataatagacctcccaataaattattttaaaaaacaaacctcttcgccacgccaccagaactggcgtgggctaactaagttgtcctgtgacggtctaccgtgttgacagggtcaagcaggcatcgatatggcagcggggtgaggtggcgtgacactgtcatgccaggcttggtggcgtgccgatgctgagcttgccgttcttcgcggagcagcagacgaactatcagtacgaaatgatggactagggcatcgggatggagatcggcaacgaggcacgacgaggggaggtggaggctatgagaggcctcatagtgcaccgagctagcgtggatcctagttgcgccagctcggattttcgccgacgtggagcgagcgaccgcgccttagctaggtttctcggcacctaactgagcaacgcagaacctcgcgaggaccaaggcgcgcagcgaggagaagacgtgagacgcgcgcgctgtgggcggcgtagcctcgcgctcgcgtgcccctagtgcccaaaatccccgattcaccctcccaaaatcccctcccgccacagatcggattggaagagaaaaggcaagaaaatcttggggattagaagaaaagaacagatcggattcaacaagatgaaaaataaaacaaaagcaaaatcatcacaacaagattcaacaggtcggactcctcctgcaacaccacccccgcctgctctgattccgacgacgaggacaacgacgacaaggtggggactcgtcgctcccgccgccggtggaggactcgaggaggactcgctgccgccctccaagaacctgtacgggaggcgaggaggaggaccagctcaccggtgctccagatccagccgccgccgccaagaaccgcctgctgcccgccgccaagaaccgccacgccgcccccgccgctcccaccttcgggaaaggcacggtgacggaccgggaggaggcgtgacggcggactcggagaggagcggcgtgggaggtggtagtgggaggcgaggcctcgccgccgtccgctcccgcacttctctaagcacgcttcctcctcggcacgagtgagggaggagaagcagagcgtgggatatagagggaggggaaaggctcgccggtgcgtgcggtttattgcgatgaggcggcgccgtcgacgtgggaggcgaggaggcgcggcagcgtggcaggagaggaggaggcgcggcggtgcgggagagaggaggagccgaggaggcagtcgcgccgaggaggggaggggaaagggtggtgcgagtagtaggcgagggtagttgagagaaataaatgtggggtaacgcgcctggggtcacgcccactgtgggcttggtaccctttaccagtgtctctattcaattaagccacacaactagaggtgtttgcactgtgggatgagtgtctctgggccaactttttaggctagggatacgggccccatggcttgcactgtgagaggcctgatacgggagtccatggaggggcagaagaggagggaggtgcgggcatgtgcaggagagtggaaagggaaggttgtacgagtgacgctgtgaggtgggtcacgggtcaccaaccttgaccggttcatccacgaggagctgctgtcctgcaaggataaaacagtcacggtaaaatatgcatggcagcatttaatattgtacagtatttctagttggaacgcagatcaatattagaatattcaaccaagtaaccaagtagccatgtcatgtgttttacttagtactttctctgttttacaatgtaagtcattctaatattttccatattcatactgatcttaatgaatctatatagttttataatgtaaggcattctaacatttcccacattcatatgaatattaatgaatctagacatatatatatttatatagattcattaccatcaatatgaatgtgagaaatacaagaatgacttacattgtgaaacggagggagtatttcataagagcatcaagttcagaacttcagatataatgttggcgttttacatctcctctctgcagctacattatcggaagagaaatgcacactactcctactagaaaaaacgtttttccaggtgggcaaatttctttattccaaacagccaaacgttctgcctgcacctaaaggcctgtgaaaaaatattttttgcaggcggccttcggacccgtctgtgaaaatatttttgcaggtggactcttctttctcgcatgcagcagatccaaccgcctgcgaaaataatcccaatgagccaaaaaaaattccctgccaccaccccctacccgccgtcgccctaccagctctggccaggtctagggttagggttttaggagggagagggaggggagggaacccgcgctgccgccggtcgccgccactgcagggggccatcgccagagctggaagggagggagggaggaagttgcgtaccaccaatgccaccaccgctgtatcttgaagaaagggaggaagccgcgccgttgccgccactgccctaccccctccccctccgggcggatctaggaggtggggagggaggggagccgccgccgccaccgccctcccctctcttccctccagccgaatctgggagagggagggaaggtgagccgcctccacaccgccaccttcgccctgcgccaccaccatcgattgggtgaggagccacctccgtgccgccaatgtcacttggagaggagccacctccgcgccgcctcagcttccgccaccaccactgtcgcttcctccactgctgctaccatcatcgtgtctgcctccatgccgcgctgccgcctccgcgccacctccacgtcacgttgtagtcgctcggaactgggactgggagtgacgaagggagggtagggtagctgcctccacacctccttaatgccaggccaccgctgctctgatctgggactgggagtgagggagggagggagggaggggaggtgagacatggaggagatgaggagacgagggaggtgaggagatacttttcgcaggcagacctcttaagataccgcctgtaaaaatgaccacttcagaggtatgcctgcaaaaatagattttcgcaagcgaacgataatctcgccccacggttctcatttttccagacagccatttagctccaagaggcatgcccgcctaggaaaaaaatgccatcatgtgaaaaaatggtttttttagtagtggcacggggaaaacaatttgttttgcttcaacccctaattattaaaaagatatgtgctaattatatttattttttatctttaccgctgactagctggtaaatcatttaatcacaagagagaagagatgtcagaaaaattatttatcttagtggtgtccaatttgaactgatatattatttatctaagtgatttctgtattagcatgaggatagacaaacaaaataaaataaaaatggccgtaagcccctgactcaatttctttggcttgtcttaagctgccaactaatatttaggtccatattccgtctttggttttgtggaagaagagcgttgaagctccttcaagagcagaaaactttttgcatttattttgttttccaaagccccgaagttcaccgcaccgaaggttggaacaacaattactcccccatactatgtggtcttcctcatgacctaaattaccttcgaagtcgagttcaatggtccaagatggacacaataaaattcccaatgcttcccaaatctaagtgcgacgggtctggtgagaatactgcagggcttgtggccatcggtctatgaatgatatgctatgagtgcagggtagagacgcacagaatatgaaagcatatgcaagagcttatactacatgtgacaacgtgactattgtcagaatcttgaaattgcagcctaattagttaagctaccaccaggacaagctgaaataactactgtacatgatttggggatggtgcttgcccacggtcaagttacagaggtacatattttggatcatgtttagcaatgccacatttatctcatccaggttatttctttcataattaaattgatcagagatatgatgcccatcatttgaacctctctaaacatttctaccttcagctaaaataacatacttcatttcgcctcttatagaaaacggagtggatttgctgacatgtgttctctccattgatagtgtcttacttttataatatgaaataaagggagtaacatttttacgaagctaaaaaaattgtgtgtacaaagacagggaggggatctatccaataatgatgatttcctgttaggacttgccaattaattatctattatatggttaagcactttagtgtaggcatttaaacttccaacaaacactagctttgcggtaccaggtacatgcctttattcatggtgattaccacatcctgagcaatgaatagatggtttttacatgctagcacgttagagcaagcttacacagcaacataaagaaatgcaacgaacgtttcaatggttcggccattccaatagtcgcatattattgttggttactaattttacctctccactttaatttagaatactaaaatgatttatgtagccaactataaatagtaggcaaggaaatattcttgtctatggtcaaaacatataaataggtttctatgatttaccatatcgatataaaatgcctaaaatttatatgtactgcgatgtaatttctttatggatcaatgccgttcaatattcagcttaagttagtcctcctgaagtttaaatcctagcttcgtcactggtgatggtactgtgtgtactttcatcaaggccaaatgccaaaaagtcctatataatctatctattatatactaaaagtctattaaactttctacaaacgctctcatgctactatatggtgctctaaaaacgctctcaagctgccacatggcgttttaataaaatagagaaaatcttaaaaattttgagaaaaagaaaaaaagaatctagccctcgactttcattaaagtttgtggacccattagtttacaccgttagattagatccattataaatagtaatctatccctcctaatttaccatgtaatacttacccaaaaaatattggctggaataagccaagaaggcatacgcacttacagagttaacaaccacaaacgagaaaagaggaaatgatatacagcaaaaaagaaaaaaaaaacatactgcatatatattacttcacttcctctgttttttttataacggctaatgtcaaatatttagtgaaactatcgaaagaaaacaaagattttaaactgatttccaattatacttcctatggacttctttttattttctttatgatgatcaacgtcaaatatttagtgaaggtggtagtaagaaaaatatattacttcataaaagatgcacacccaaaaatagatcgataatataatagaaaatatcaaataaacctatcatttcacactacaattgttgagtatagataaattttatttgcatcaatgggcctacattgatagttcaagatgaaataatgagtaactaaaatattacttgggacatattgtcagaaacacaaataaaaaaagtattgtttaaaaatcacattttttctcaccaaacacagtcaggattttagccgttaatgactcaatctacgcttttgatttgtacatatttttttaagtacataagtaataaatttaagattgagttctaaagtgcttatcaaattggctctccctcatttatcttgagcatgttccgaactattaaactgtgcatgttttgcaaatactttttatactttttttaaaaaaaatctatttcatgtttgtaatattaaatacttaattaatcttacgttgatgacctacatcgtttttcgtgccctggataagctcaaccaatgagatcgaatgtagcctaagtaggagataaattagattatttactataaaatttaaaattaaagaatcaagtgaactacattattaaaaaatcattactttttttatgaaaaaaacaaataagttttttttgtctcctcgctatttcttagctattaaactaaaacagaaacaaacaataatattggatttttctagaaacacagcacgcgcataccctaccccttgagtatcaccaaaaggctgattcgacacattttgagatacgatgttaccatgggcgtctcgatgtcgatgggtacgtcacctaccactgaaacattttgagatacgatgtcaccataagcatatcgctgtcgacgggtacgtcacctaccactgaaagaataattagttgtaaatatgagcacccgtatcaagtataggacttgaaccaggtgggcaagttccaccacaagaaacctaaccaattgatccgctcactttacaataacgttggatattaaaacaaccataatttttaagttacattgttggaatacttctatgccttttaaaccggtgaactattagttatagctgttagatcaatcttatatataagttaagcatgtattcatggtacatgacatctccaaaatattactgcacaattgtattttatcattatcatatttaagttaggttgcatggagcctctcacccaccctacatgaaatgttcatagatgggtcgcctcacaaactacatcaatcgtattaggctatataaacccatatatttagtggagactcatgtcccactcaattcatcctttaatgaactattacaatagatatgcaattaaaaaaaacaccttactttactttcattgacacgttttctaaaataaaaagtctaccttattttcaaattgtaaagaagactataaataattgcttatagatattacttaagtatgatataatataaaactaatttagaaacttattaagcaattaatgccaatgaaaaaaatttacgaacaaatcgcgacagaagttctttgtttaatattttgctcttatacttatctcaaatttagtatacgatgcatgccggcgcgaatacgcgggctaccttcttcctagtttattaataatgaatataagtcagtctggcctccttgaactgtcaaaagaatagtgtgtagtttactatattaattatcataaccatatttctctagcaatctgcagttgtctgtaccaaatgctaaatataaatgcaaccttttactgtctttgcctctggatggatcatacgtcctttgagtagtaccgtgaattagtgttatgtatatgtttatttcttgcactgatccctaatctcagttacgaaccgacactgatgctattttctatggtagtgacagaatcctatcagacagtggtagttattactttgtacgtatcaaactagtaccaaaaccatattaatttatcaacctatacccttccggcaccaactttgttcgtagcacgtaggctgtgtttgttgtgggtggttgggaaaaaacctcctccgcacagaaaacggcgcggtctattagcgcgtgattaattatgtatttgctattttttttaaaatggatcattatgatttttttaagcaaccttcgtatagaaacttgttaaaaaaagtacaccgtttagcagtttgaaaaatatacacacggaatacgagggagagaggttgggaactaggagtaaagaacacaaaccttagacataattctatggctttgtatcgatcttttcatagacctgcaaccataaatattgtgcaagatatatataaaatgaatttgcaggaactccatcaagaaaacctcaggtctccgttcaataaaattccttgcagtcatggtcatcctctcctacaccagtaccggtcatccaacacattcggttttgcattgggaggcattgggaatcctagagatactaagcagtatttgttggtttagcttgcggaggctataacaaggttgattagggtagcactagctagctgctgcattgtttacaacatagctagacagagcaagctagccaacaactactagaaaatggatttttggctactgttccacgttttctcgtgatggctaggaaattgctttcaccaaaaatgaaactttgtaacagctaggatcgatccttcatggaaactgctcttttcgtacaaggaaggataatccagtcaacaaaaatgaaatgtaacacgaaaggtatttgctataaattttttgacatatacttatagataaagcattttcgtagacgtggagggtttttttccccagacggatatgaccctcggagctaaatggccgcctacgaaaatataaaccagggagcttgttgtccgcctgtaaaaatacttttttctaggcggaccaatcaagtcctcgtaagtggtccgcctgaaaaaaatatgatttttgcaagcagaattttacgtggtctgcctgcaaaaataatgccaacaaaaaaatatctaagtcctcgttcttaccatctcctccaccatccttatccttatctcctccactcatttccttctcctcctctctctctctctaccagcagagctgctccgcgctctagcctccacctttctccaccaccgcctcccctcttcgccgcgagtgccgccgccccacctcgccgccacggccacagcctccccttctcgccgcgtcgcgggccctccctcctcgccgcctcctccttctccaccaccgcctccgctgtctctgccaccgcctctgcagccgggctcccctcctcgacgcttccaccgcgccacctcgctcctccgccaccggccgtgatgcgcgatgacgacgacgatgatggcgacgcctatggatctgccattggcttggcccgggcgcgtggatccgccgctggctggtctcggggaggggaggggagctggtggcgacgaggaggagaggcggcggctcacctcctcgctctcccttcgtcgcaccgatgacgatggcgacgacggcgccgcgtgtggtaagcccggacagaggaagagaggcagcgacgcacgacgacggcctcaacgatgtcgccgccagctgttggggaggccagcggacggaggaggagagccatcggccagaggggaggccggcggcggtgccttttttttttatttgctgtgatgtttttcgcaggcgggtgaatctaccgtcaggcaggccattgggccgcctgcaaaaatcatttattttcgcaggcctttgcttctagacggttcgttcccccatgcatctttcccactgagttacttgtctcttttgtttacatgagttttacgcgcaaattgcagtctaatttttttttaagaattatacagtacaatgtagacattcacaacacatgcacactcacccctataaacatactagttatattgtaattacttactagttacattgtagttacattcgtactattaaagtaaataaaatctttgtgtgtgtgtctatatatatagtccccaccaaccgagcaagctaaccatgttgggtacgtaataaaatattatagttacaatgtagttatagtataattacaatatagttatactattatatttgtaactacaacataagtaaacaaattctaattataagcctgttatgaattttttggcagcccagtattgtgggttggtccatcagattgaggcccattagatagttaccgtggcagttactagtgagcagatcttatccaagggttaaaaaaaaacgtgatatatggactccaaaaatctgtcgatagacagctatgtagtcctttccaaccagctcttatgtagttttcatcaaatcatatctctcaatccccctcccactcctccactatatctcattcattagggccatcatgttttttttatccgtaatctcttaaaaattttaaaaatatcttatatttatggacagagtgagtacacaacacgaaatatcatgacaatgaataggtgtgagcgtgactacattggtgcatatatataccgatagtgtagtcgattgcagtgccaaataccaacatctgatacacgtctagcatatcaaagccttataccagtatatataccaccagtccaccacatcgtactgcaggtgagttccagcgttctgtctagctaggttgaacaaattaaaatattgagacaatacttctaatgttacagtaccaatatttttttcttccaattcaatagaaaacaggtagctctgctgtcccagaaaacttgaatatgccacccagtttgccaccatttggtcaggcttgtctgaattactgaatagaaaatggtagctatgctttacatcatgtgcgtgtgtgttatatatgcaaggttatattattctcattggtttggtaggcatcaggaacatctgctcgccatgcaggaagcagaaatgtaatttagcagaggattattgcgagttgtagtgatgcaaaggacagagctggaatggccttagtagcactcttcaaaatgtgccacctagaaagaaatagggcatatcgactgctccatctggatcagtatcatcgctatgaggcaggagtggaagccgagatccctatgtaagaatatgaagaaagatgacgatctgctaaaacctagagacgcgagcgtgatcaaactagttgttctagccagctgaggctatcagcttctaatcatgaccatgaattaacatcaaggcatgtattaaacttaattggaatcgatatcgtaattcttacttttgccttatttccagttccattttttttattttgcaggtatgtgttaaacttttaaagctttttttatattcacttaagctttttttatattcacttaagctttttttattttctgaaatttgtgacgcaaaggacctgtaattgacggttatatatgaccactcttatacattttcatttgaaaaatggctttctcacgtgaaactgtctgcgagtactttgacatgcaaaaattcccatttcaaataccacaatgttatatatgtgggagaaccattaaccatctccggctttgaattatcccaacgcgtactgaggcatatatatatatatatatatatatatatatatatatatatatatatatatatatatatatatatatatattacacacacacactaattaatgttactggactcggtctgaaaagtgtatttacttcattttgttgatcaaacaacagaagcaaccgcgtcatgcatggaacatatggcaaattactatgatagcagcaatggtttttttaatactatcccaaatattgtcgcaccaagccaaatacattactaaaaactaattttgtagactgatgattaccaatttatacaagtctttaataaaccacctgtgacctaggcctgtaaaaattaatcaacaatttccttatgcatttagaaggaaccgcatgtgacaatcacattttcacagacatctctcttaacgaaatacctgtcaaaatgaattctagtgttagtttgtttctgataatcacaagtcatgcgagaaatgtatgcaagcagctatataggatttggaccataatatgtttactccatgcgtggtctccttgacatcttatctatgaaatacttcattactttgccatgtatgctattcttttgacttcacctctacatacatatttggcgttctaaataacatcaaataaaaatgtcattaactacaaatttcatatttagcgctataaatcagtgcctcctctcttgctctctatactttgcattgatgctgtcatattgagtaatttggtgatctatttgtgcatgcttatatcttgttgatcatcttctagctctagtttataagtagtgtgcaaagtactctatctataagttttattttctctttccataggttttattttttctgtacagggccggattgtcctatcattattagagtgtcaaacagggtttacgattctgataggcccttctgttttgggcactagcggaattcggaatttcacggaatccgat

SEQ ID NO: 32925 - DNA, 775 bp, Oryza sativa
aagatgacgactcgatgaggcataggtggggaggagcacgtggacataatgagaataatcctacaatgatacaggttttagtgtagatgctacttaacaattcttattcacgggaaccgaaagattcaattcgtactttgtagggctggtgttgctgctgtctgcgtaggctactagtcttttatgtaccagtatctcaccgacgaaaaatgagagataacatactttttttctaacttttttttttctaaaacaagactatagtttaaattcaattgatttttaattagcaagtgcatatattgttatgtccatgcagcgtgagagctacacatgaaagaaggtccacgggaagaactagaattcggcattataaagggggtagcgcacgagacctaaaagtggatggatgcggagacaagaatttaaaaaggttcaggccctctcaatgagaggtaataccctactcctatttagggatttgaattcgtcgggttgtagtattgatctgacgatcggattgtgaatctctgcccatgccccttggagggggctccttgcccgccttatataggttggggggcagggttacaaaggaaaaacctagccggacacgttatcagtatcctaatctattactccctccatcccaaaatataagcatttttggaccctgacacggtcttcgagatgctactttgactaacaatatctatagaagtaagatgttttaaataaaaagagttgggggatccactagtggagttcggccgcc

SEQ ID NO: 32926 - DNA, 359 bp, Oryza sativa
aaatagtaaatgatttcaaatggaaaagccataaacatcaaagttgtacaacttttatgttggtcacttcttcatccgacaaagtgatagtaccaatgtttacaaaattgacatatatgtgttgatgtttataaaccagatgagagaaatgtggtttttgtgaataatgtaactatcaccttgtcggatgaaaaagtaaccaaaataaaagttgtagatcttgatgagaggatcaactttgttgttgaccatatttccatttgaaatcatttagtatttacaaatgctgtttagatttgtcatattgtcaaaatcaattttaagctattgggaacaaagttatatagacaaatgaccaa

SEQ ID NO: 32927 - DNA, 694 bp, Oryza sativa
ggcaatccatccgacacagcttgccagatgaacgagttgatggagaagacgtcccgttaccttgctgagttcgggacgggcggtcgctatctccaacttaactctgtgagttcggcgactgacgaattgccgacgctggagcttccaaagtccacgcccattgaacgtcgcaatgcccgcatggtggaggaggatctattaagcatccaagattgtttgatggagaaacccctgaacaaggagggcaccatagagtacattggtgctgccaccgctgcatgggaaaatagttacgagcttggacgccccgcagacttggagaagttgatgtcttacttgggggcacttgtgcaacatcttaagggagagctcccagtaacctttgaagggagaactttagctgctcatgaaggcgaggcgcgctcttccttagcaaagttagagagtgcgtgttcagacgtgctactagaccttgacctcctcaagagtggccgtgaagacgtggccgcggatcttcagaagtccaagcaagcaagggctacctggaagaaagaggcggaggaacacgagctgaaagccaaagatgcgagggagaaggagcaccagtgtttggaatcagaggaggcagccgccaagaaccggcaagtttatgatagtaccatcgacggcgtcatgcaacgggggatccactagt

SEQ ID NO: 32928 - DNA, 1576 bp, Oryza sativa
tccttggttattgttgtagggctgcacaagcagctataggctatagctgccccggcgtgaatggaacactctggcaatattactgggtgcttgaataggctgttgatcgaccttcccgtctatctcactgggtgctaatgcaggcctgcagggtacttattttttacaaaatttattcccttggcgaaggtggatgttcctgatgcctaccaagcttaaaatgctgcccagtccaaaaggaaaagcaaatatgacagtggcaatgttcatagtagttaacccttgtctggttgttatatatttatcctttccaccaatttttggtcataaattagaggtgcaatgccatccctgtgtgttttttaatgagacctttcacagtccttgaagggaggcggtaccatatttgaccgttgatctggcgcgatctaacagatgatattgcttggtaccacgtcctcacatgtggaggtaccgattgagcatgtggtagtgggaggggtagaattgtactttcgaatcaatcctttctcccgatccaagcattcagcgaactctcttcgtccctccatctccacattcgaacgtcgtgccccccttccgtcttgcgctcgaacttggatggccgctgtctcctccactcccgcttgaatgccgaaactgccggccaccatcatctccgctcttcctcatcctttgatgctctccccctacggccctgccccatgtggatgtcgttgggccagatccaaccgctgaggttggggtgccagatttggttaaggatgcgcttccgcgagcttgcaaagacgctgattggagacctcttgccaccctctcggcgctagtacgtcagagggggagaccatgtggatatggttggtcgacagtgacggagatctctcagatggcggagatcagcgaatatattacaaatgattttctgtttatttcgcacgtcttggatgtggttggtcgatagcgtcggagatctctcagacggcggaggtcagcaaacatattgcaaatgattttctgtttatttcgcacacaaggcgttcggcggaaaacaaaatgctggcctcccaaattatagattataaatggaaagcgtccttccctgcaacgctccggcgctctctacttgtattattatactacaagtagaattcttgctctttcttcctcttcctaccgttctgccacttgaatctccggcgggagctgccgtgaactccggtgtgttctgctggtgtccctcccgaacctgagcaccacctctgccacagcaactgcaccgtctaagcatgcctccataaccccatttcctcatcctagtaggggcgatgcaaaagatgcagcatcgggtacaaagacgaagagagatagaaaccatgcaattagaacgttattatatgcatgtagtacagaagttgtcatctcataattaactctctgccccattgtaatacacacctagcaaaagtgaagggaaaaagagtgtattagtgtgtttctttaataggagagtgtgttttttttatctcctgttagtatatctttttgtcctttacct

SEQ ID NO: 32929 - DNA, 5181 bp, Oryza sativa
ctccccagcatcacccattcatatacatatgcattcacatacacagacatcaatatattttacacaaccacacattcacagccatctcatatttcacatccattcacatatttcacatccattcaaatatttatcatatttcacctgcaaaaccaaattaattggatcaaatatttatttagcaagtcttaacataaacatatgaaatatatacataaatataagcatcacagttacatcatcacagttgcataataagtgttcatcattgcctaaacataaaagttcaacattgttcatcattttagtttaagcctaaacattcctttggggttaattatttcgcagaggataaagctggctatctcctcgcgaacctcctcaaagctggtaggcagagacttggttattgtgccctacattgtcataattctagattagttgatcgatcatatataagtactaaaatgtagttagtctatcagaattgagaccaccgacctcaaactcagccaaagtcttcaccttttctctgtacagaaggcgcatgttgtggcacacatggaatccacactggtcacctatttgttgcttcaccgggaagtcttttttgtggatgagggtgtcatgtcctgtcttcctgaggcctcctctttgcacgtattgggcccacgcttcatctatcgctagttgaattagggtccaatcatatgcgttcttatcaattctggagtttaggtagtaacatgtactccacttaggtgttattaccagaaggatccaatgggcactgcagcattaatatagtgaaagttaattaagtactgaaggaatgtgtcatgctgttgtgtatatttagataacacacttactattgattataggcgcacataatgtactccttgtctcggcgggaccacaaggtgtcgtagatgtagttgaccattccttgacggtcattctggagatttgtgacagtgaccacttgtggatcaaggaaggcaacttctggtgcattcttctgacaccattgccaacttaacctacacacaggataaacgatcttgtaagctagttaatccgattgttattaccagattgagttgggcgacaatacttacaaggagtagcacttaaggaggcttgtgtcaaccgctcggagcctgtagaggtcgaatagatccttgaagtcgacgacgatataatctgttggaccaaggaatggctttccatcgtgctctccaaggatatcggtagctttattcggcttcctggcattagatttctccatgtagtatgcgtgaaggtccttgcaagcggtgcccattgcggcaagcacgtcatctccaaccaatggcatgcctagttggaactcctgtggagcgacatatttcttcttgatctctttgcccttagtctcttcctggcccttgcccagatctagctttcttggagctagaagcgaggactgcacctttcctccccttcctctcccctttgcttcgggtttatcgagagtaattctctaaggggaagagtgtgccttcctgctcttcttcatcggtgggggttcatgaatcgccttgctgtcggccttcgttcggtcctccccaaaatccgtgtcgtactgcaactgcacatcgtaagattgtgcatgacaatcttgagcaggaggggctgaaggagcagaggcgggtctctttggtggacaaccgcctggtgcagtggttggcctcgctgtaaccctgatctcaatgaggtccttgggccattggatgaaggtaccatgggcatttcctagtgagaggacctcgtcgttcagtggatactttggtaggaatagctcatattccggcttcactgagtcgacttgtacttttgcacagtcgcccctgagttgcgctccatgcactcttgtctctagggtcggcttgtacgcaagtccctcggctgctggaaccgtgtaggtcggcatcaccctaactgtgagggtgcagctcgttggttcctgcgatagattaatcaatttttttagaatattatatatcatatggactcgttaagtctttcatgcattatggacgaaacttttactgttatgtggtcgacggcgctgtcgaccgatgttggattttccgccacatcagttgatgcgcaactgctgcgtttttgggtgggacttcctaactcttcatgcgcagcagcagcagcggcctgggtgttctgttgctcttctcggatctcttgcctaatcttggccctcatcgactcgagctttttgtcgaattcagatgtcagctcagctcttatcgacgcccggatcttggcttcaaggcgtgcatctttctccgccttgttggaagaccgcttcttgtactgccacgcgtagtctggtaatccatacttctagggaacagaagacccaacgccccgtgtccgtccatggtattccttgttgcccaacgctttcgtgaggaggtcgtcctcgcgtctttgagagcaggcctcttgtgaggcttgttgctcggcaaccaactccttctgcattacaatttagtggggttaaataaactgcatgatcggaaccaatgcaaacatctagtttgactagacacttactatagcttcgtacactcattgatcttctggatttggcatgaagattgtgccatcatccttcttctggtacctggccctggcccagttcctagccggagggtgtgggatatcaccaaacacgagcggcgtgttcgattcctccgcttcttcatcctcacgctgccattcctcttccttaccggcatatccggcggtgccaagccgatgcagatgctggttcttggtctggagcaagcgatatgcctcgctactagctctggactcggaggtcgacttctttgcatggaattcctcccagacctgttccgggatccaaggaaatttctctcttggatctggattcgccgggttgtagacgaactcgctgactagcttagtcttgaagttcttccaagcgttgcccataaccttgaaagcagcccgcctgagatggtccgcatgctccgcaggataatcgaagctctccttgaacgttagccaagcaatgtccttctctgcggccgacacgtgcttgatgtcatcttgcagaatactgaacttctgcctccctatgaccgatagacctaaatcggctcaatattttccttggagatgtcggcaaccctacggcgtccaccgctgttatgcggaaccgttccttagggattttgttccctgtcctaggagtacgtgcccttgaggacccactagttgtcgtcgatattggttcaccttgctgagacatcgtctacttttttctaaataacgaaaatatactattcagtgcttcaatggctaagaatcgaaagttctaaaatctattagtcacataaataaactaaattacacatctcacagtaataaaatgaattgaatgtcacataaaaataaattaaacatttcatctattcatctattcatccacattcatctcgaatcatctattcatccacattcatctcgaatcatctattcatccacattcatctatccataaacattcatctattcaaacacattcatctaatcatgtattcatccacatgtaaaatgaattgaatatcacatataaataaattgaataattcatctattcatctattcatccgcattcctctctaataatctattcaaccacattcatctatccatacacatgcaagtattcaaacacattcgtctatccatacacatgcaagtattcaaacacattcatcaatcgaaccacattcatctattcatcattcatgcgcgatggaggactcacctgggggtcggcgtcgggcgtcgggcgtcgcaggctcggtggaggcggcgtcgggcgtcggaggttcggtggaggcggctgcctcggtggcggcggcctcagactcagcgagggaggagtcggcgaagggcggcggtgccgggctcggtggagggcgtcgccggggtcggtggaggccgcggtgtgctcggtggaggcggcgtcaggcgtcagagaggagtaggcgacgacgatgaggaaggatgtcgccgggctcggtgggggtcgtcggtgaggaggcggcggcggtccgaatggagggcggaggaggctcggtggcagcgaccgcgggctagtggcgacggtggcgggctcggcgatggaggacaacagcggcgctagggttctaaggaggcgggaaactatagcgggacttagaaaaattttcgatctgatctgagaaaccctagttatagtagagtgatgagtcatctcaaacgggcattgccgtagggcccgtcacagatgactcatcggtgacgggctccatcacggagattgagatgacattcaggcccgtcacggatgactcatctatgatgggccctaagataatgcccgatagagatagactaatctctatcgggcttaaactaaggcccgtcaccgatgactatttttctatttttcccatcaagtctttatatttgtgagtgcaatatatatagctgctatataataattcaatttattagtcataatacatttttggatagtaaatgatttcaaatcaaaatatggtcaacaacaaaattgtagagcttatcaagatctacaacttttattttggtcatttgtctatataactttgttcccaagagcttgaaattgattttgaaaatatgacaaattaaaacagcatttgtaaatagtaaatgatttcaaatgaaaaaggcaacaacaacaaagttgatcctctcatcaagattggcaacttttattttggtcatttgtctctataactttgtttctaacagcctgaaattgaatttgaatatatgacatatttaaacaacatttaaaaatagtaaatgatttcaaatggaaaagccataaacatcaaagttgtacaacttttatgttggtcacttcttcatccgacaaagtgatagtaccaatgtttacaaaattgacatatatgtgttgatgtttataaaccagatgagagaaatgtggtttttgtgaataatgtaactatcaccttgtcggatgaaaaagtaaccaaaataaaagttgtagatcttgatgagaggatcaactttgttgttgaccatatt

SEQ ID NO: 32930 - DNA, 719 bp, Oryza sativa
agtcatctgtgacgggccctacggcaaagcccgattgagatagattaatctctatcggccgtaaactaaggcccgtcaccgatgacttatcaagatctacaagttttattttgttcatttttctatataacttttttcccaacatcttgaaattgaatttgaatatatgacaaatataaacagcatttgtaaatactaaatgatttcaaatggaaatatggtcaacaataaagttgatcctctcatcaggatctacaacttttcttttggtcatttgtaagaaaacaaaattagccatattaatgactacacatatcaagtctttgcaataaaacaataaaacaaaatacttcattcattacaatagataagtacaaatgcatcggtcacaagattatgccttccgtatgatctgaacgagcatatgccacatgctcttggggatcatcgtcaaggtcaatgtgaggtcttacataaagattatggttgtattcttcttcatcgacgatgttgtcaactcctacaattcggcgctttccatccctcacgatgtgcatcttcttgtttgaagggtcttttatgtagaatatctgctcaacctgtttcgcaagtacaaatggttcatcggtgtatcccacctttgatagatctactaaagtgaaaccttccttgtcggctttgacaccagtccgtagattcacccaacggcagcggaacaa

SEQ ID NO: 32931 - DNA, 624 bp, Oryza sativa
ggtggtatggagttcccaactgattgtgatgctggaaagtcctttattctttcaaagtttggcaagagcgctcttccatctgtgagattctttggtgataagttcatccgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttaataccttgggtggatgctggtttctctgggcagtaagttattaaattttttttccattatctttgttccatattattattgttttttaattaatttttctttgctttttcatattttattttgctaggtgctttatctggattatgttgagtttggtgacaagaatattcctattggttttcctagaatttctcactggaagaataatatgattactttgtattctgaccttgacaaagttgatgaagaaaactttggccttaggcccattaaggatttcaatgatacacttatttcaaggtacatgttca

SEQ ID NO: 32932 - DNA, 762 bp, Oryza sativa
aaaaatgccattgtggtacaactaaaatcaacaatatcatgaacagtactacctaggttttatttctttcttttttgtaatttaaagagttgtttcaattttttttgtagctttgattctggaatttttgttatgaagtgtatggaattgtggtcatcaagggttgttctaccaaatgaattttcttcagatgatattgacaatattcggatgctgtatgcaaatcagttattcttccatccaacgaataaaatgctgcagactgaagttgaagaagttgtgctcaattggtttaatcctgtaagtgtgtttttatttttttttcctattcttgttttttgatacatttttagttatgaaaaaaatgtttttcattttttatttgtatgctcaatttgttggtgaaggctgaaatttttcagaaagatagttgctatgaaaattggtttaatcttgtaagtgtcttttattttttgccattcttgttttttggattctttcatagttttgaaaatattatttttgtttgttattgtaggatcaatttgctggtgaaggctaaatttgtgcagaagattagtcgctatataaaactgtagtgtgtgatagcatagtggaatgtataggatcatagtgaatgcatttttgcagtgccattacatattcctgtagtgaatacagatgttcacttacatcaaatacttttagtatgaatacacatatatagtgtgtgtagtgcagtaatacagtgcaaaacattaa

SEQ ID NO: 32933 - DNA, 5350 bp, Oryza sativa
  unsure (1)..(5350): unsure at all n locations
actagtggatccccctgttggatagacccaacatgagacattgcaagagctatatgcatgtgttgtgtcatcagtgatcacatttagcgttggtgttgaatccttagacctaagattatcatggttcccaacatgataaacgctactgcgtaattgggtagttataaaagtagttttcgggtatgctagaaacatgtagtgggatatgaataatgatgatgggatttgtccctcctatggagagatatctctaggccctatgatgttatagattatagaagtgcatggccatgccaaaggtgattgaggagtcaatcacaagttataaatctatcacaagttcgagtgaatgattgagctattagaggatagcacatatctagccttgagtttaatcgatatcgtgaggcaaaggggttcatacaagtatacactagaggttctgctaggggctgctgttgacacgtggaacgaaaaggtgttttcgggttacagccgagtgtgcatgaacctacagggtcacacgcttaacgggccggaataaggggattggatggagatccaatatgagcttaattcagatagggatccgaataggagtcctacgggccttggaggcccgagtcatggatcctatatattcgtgaggggtgtgacaggcagaggtattgtatcacgtgagaaaccctagccgccactctccttcccgagcaaaaccctagccgcacgcgggtgctagcatttctgcgcgtagtgttctgtccctatatgtgtggataccggtagaggcgctgctgctttgcggtgctgatcagcgtgtgtgtacgacatggagaacgcacgaggaggagaaggtcgagctggtgcgatcgactacttcctctacatcgacgcgcgctacatcgcgagggttccttcgacttcttagcactttcttccgctgctcagcgtgtcgactggtaatgatctatgatctaatgcttgcatggttcctgatttacgcgatagaaaactttgatttatgctgtcgtagcctacgcgtatccaaacacgtgcgtgtgttgagagatcaccgtagggctgtggctgacttaggttggcttatggggactaggattagtttatatattgatgtggaattgcctccagcgaatgagacttgtaattggagtatattttaagtggtaaccatatccagtgaacccatgggtctataaccttgtccccacctccgactccggccctacagggtgaactgcccaacacctgatcggggaaattgccactcctggtaaaacatggtcacaaatatctaatgcaacgtttggctgacaaaatcttggatataattgaagaattttgtgtttccttcgccagaaaccagtcaagctctttgagaaattctcagccatctcatctgccagcgaggacatgcatgcgcaacaaattctctaccatctcgttgacaaatcaacctgtgtgagacgccttcaaattggttctctacattcaactccgtgaagcagctagcatcttaatttttgagattgctgtcgtcgttgatcactacctcctgagatacacctgccatttgatagcaggaaaattgctcggttttgcaatgcacattgttagctttcccatttgatacttcagtgggtaccactctgttttgtcacaactctatcgaaaataccgaaatttgcccctctttaacctctcttcttcgcacccaacccttttccacgtccaaactccagccagcaaccgctgccatgtggaccgcaccaatgcagttggctggccaatgctacacctactctactaccacttgcatctagactctgctcgccatccctaacgtggccgagctcgagctcattccagtcgaaaaatccatcttgagcaattgtcgaccgaaacatgtgaaacttttaggtctccaatttaaatcataatttgaggtaaccttgttcattttgttcaaacaaaacaatcgctatgaaataatgcaaaatgaccgttgtgtaattcatgttatactatgaatgaaaaaattgagtggatggtcgagctggatgtagatgccgcagcagagtgggtgctgccaggcaatgatgggagtggcggcacctgctggacctcaacatgtggttatgctagttatgcctagccaaagttagggacagttaacttcggattggtgtcaaaataaacatttttaaaatttggcaataccaaaattttgataaattgacaacattatcaagatttggtaggattgactcaatataatttgaccaagatttcataggcattaccaatatttggtaacaataaactaaatataaccacatgattaccaattttactaaataatggtatgctgagaaagacccaaaaatgatagagaatcaatgttgaaacagggaaatttggtatttttgatagagttataccaaaagaagaggtaggattgacatttttacaaagccaacgaacctggtggcacacgagcttacgcttccgaacagcatagcgaacgaacaattttccatattgttgtcagtgcgcatgcttttcttttcctaacaaagaacggaggggaagacagaaggtgaaatatccttgacatggagatcagggtggcatagggtagctggtaccagatatatacaaaagttctcaacagagataagacatgtcagcaaatccaccctgtttatgagtctagctaggaagattatttgtaatagatggaatgatatctctgttagttttagcttaaggtagcagagtttagagaggtcaattaagtaatggagatctccatagagcgatttaattatgaatgaaatagctctgggtaagatgtgaatgtgcatttctatacatgactcgaacatgtatactctgaaatcttgtacagtggtttattttggcttgtgctgcaggtggtagcatagttaactaggctgcagtttgatgtttcatacagtagttgtcacttgcagtacatgctcttgcatgtgcttctgtaccagctcagaccatatatataactgacggagcaatggataggtcacgcccagaacccagatggccacaacccctgcactattctcacctcacaagtcatgcttagaattgggaagcattgggaatttcattatgtctaattctcactattgggctggaattttgaggcaattttgaccagaatctgcagcagcatgtacgagaaattatcatttcttacaactggcgaacttcggatggaaaaaagttaattaaatggaatattatttctttttttacgttacatgcttcagcgtttttcttccaaaaaaccacagacggaataggggcgtacacattggacgaaatcatcctgtttataatttgataacccataaaattgcccagaggccacgtccattttatctctaccacatattttttaaaaatagatgatgtcgttgattttcatattatgttcgatgattcatcttattaaaaaaatcggtgtaaatgtgctaaagtatatgagttatacactggtggagaaaccatctttggtcggtcggccaaattctacaatagtcccggttccaataaaaatcgggaataaaaatcatctttagtcccggtttaaaagttaaagggtactttttgatctttagtcccagttggtaacacaccaaccgggactaaagatcatttttagtcccggttaaacaagttgtcagggcgtgtcaggccccaattatttttagtcacggttgatataaacaaccgggactaaagatctatctttagtcccggttgtttataccaactgggactaaaatttaccccaagccacgcgatcttttatctcttcgcgcgtcgatctgtgtctccctcctcctctgtcttatccttagcttcttcccatccacttcttctcctcacttcttctcctcttcctccttctcctcctccccttcccctctcctctgtcttcctggcggcagaaaggggcggccggcgcggaggcccggcggcagcggttgcccgcgcggagggcccacggcggtaggcggcggagacgcgaatggcctcccccggcggcggcaggcggcgcctcgggccgcccggcatgggaattttttttctttatttcctttttaatgtgatgtgaatggctgtgatttgtgccatctgtgatttgtgcgatctgtgatttgtgtgatctatgatttgttcgatctgtgatttgtgaatgataatgggagatatgtgatatgtgaagtatctatgatttgctatttgttatttgtgatttgtgatgcgattgtgatttgttagttttataatgatttggaaatactgaacatgagaaaagaaaacaaaggaaaaaaatctttagtcccagttggttacatcaatatgtatctttagtcccggttgtaagggttacggataaggtataccctctatccttgaatatacgctatacatcgatatggtatatctgcgcgtatacggacgttctatgtatacgctaaggaaattcatcacggagtccacagatggaaagattcctacccggataggactgggtcgtcactgtatcgtgtagggtccgatgtctccgaatcctacttagaaaccacctgacctgcggtataaaagggacccccgggaggacctaaggcatcgaatctcatagccaggacaaccaccacagcctacgaagccggagcctacaggagccaagtcgctggtgatctagtcggaacaactcgactacgatctcgtcggtatcatcgagttccactgtgccctttgtaatctatgacttccatcatataatcccatatcaactggattagagctattacctaccaatgggcctgaactagtataatcactgttttttgtttgcttgatgtcgtactacgtagatactcgtaccagcgtaccccaataccctctatatccggtctgcgggtttcccccgtcgacagtgtcgtcttcccggtttataccacggtgccgatctcgactggtccatcaatgaccggaagcgagaacgccgtggctacaaccccggacgactccatgtcgaaggatcctcccgcagaagtggagaatggaacgtcgacgacatccaagcccgaggaggatcctggtgcggtcaaatcttgtccttccgatgagtgtcacaagccgataaggacaacttccgaggtgacaaggtcatggtgtcctattcacaaaaccagaaaacacaccttgnnnnnnnnnnnnnnnnnnnnnnnnnnnnnnnnnnnnnnnnnnnnnnnnnnnnnnnnnnnnnnnnnnn

SEQ ID NO: 32934 - DNA, 797 bp, Oryza sativa
  unsure (1)..(797): unsure at all n locations
tgtatcaatttactgatccagggcttgatacagttaaacatgtcggtttccgaatcattagttttgggacccgacaattacgtatataatatttgtgggaaaaagtatagttggtgaaccttcatcgagatagtttcttacattttagttgattagtttcttacgttttttctaaagtttgagtacatttgtatatgtatttccatatcaatgaagctcatttatcttcttcagtttgacagtaagaaaaaaatgctacgaaagtcgcatttacactagtcattgttttgtgaccacaaattcgtccatgcgttggtccacatcctccataaatggaaaatgaggaaatgattagtcttcaatatttgtaagttaaaaaaataagtagaaaaaagatgggactgcatagctgctatttgagagatctgcatgctctacgcgagcgaaacaactgggactacccaaaccacatctatttatagcaattgcataagaattcctcaacgagaaagttggccaacgatctccattttgcactgtgcatccatgcctgttttctaaccccaggcgatataaatagatgtcatccacatcctccataaacaaaacatgatgatgtgattaatttttattatataagttaacaaaaaaagtaaagaagatatgtgaatgcattgctactttttaagaggtctgcttgtcatgcgccagcgaaataactaggactaccaagtttgcatctatttataggaattgtattagtaaatggggatnccactagtgggagatcggccgcc

SEQ ID NO: 32935 - DNA, 780 bp, Oryza sativa
aaaaggtaaacatgatggatgttgtgattggttgagatgaggaagtaggtggagaaactaaatggggattggtgcgattggttgagaggtggaaaggtagctaaattttggaacaaagggaatagtttgtaatatgacatgttcataaaagtggataattagttgaaggaccactggaaaacaatagtgtgttctcaggtgcaactaacaaaatgagcaaacttgctgaagggcagtcacccctttgtctgtgcgcccagcaacaacagcacagccttctaatggcaatgatcttgcttcaagctgtttagctttcttctcgtcaacaaactggccaagatgtttttctactaacctgcaagaaatacagagtgcaacaaatggttttatcctgtcatctgtcttgagatgcaaaggaagtgaagaataaaagtgccagatatgtctatagaaatgacataactccattcttatttatccttacccttgaacagtgttgaggccaggctgcttctgccaaccatcaaatgaccccccatgatatgaaaggacaatcttgaaggttactctttcccatcgtcctcctcgatctttggatgatttagttgatgtttgattttctgatggtgctgtgtaatcttctccattcgtatcaaggctgtaaccattctgttgaagaaaaatccgataaatcttactgaaacaaactaaaagtactagaaacggacctgcaccgacaaattccaaaattgggggatccactagtggagagcggccgcc

SEQ ID NO: 32936 - DNA, 796 bp, Oryza sativa
aaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaattgggtcacccataaccctcggtcaccacgttcccggcctggccagtctcgacatgcggatctccccaggcactagccccgacccgcgcttttcgaggactgggacttgggcatgggcccttatttcaagctaagacgcaaaaagaccacggcacagatcatcctcatctcacatatagcaaaataaaactaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgttgtcctcggtcccgggagggaactcctccagcgccatccaaggagagaaattggggtcccgggcctggtaactcgctagcacgagttcaaccgccccccgggcgaggtccctcgaggatgacttgatggtcttctcgagctcct

SEQ ID NO: 32937 - DNA, 795 bp, Oryza sativa
ggtggcggccgctctccactagtggatcccctggctccatgatctttttatatcatgaatggaaaattaatctactcgaataattttacttatgctgacaaagttagtttacttcacttagcattcatgccatgtgcagtgacaggcttaaaagataggctacaatgctaaatttgacagcataatatgtttttctactaccttaaaagcgcaaccattctccttctgtcctcttcccactgtgcgcagtcgcctgctccttcatgtgtgcgtaaccaccgtagcatccagtattttatccttaatccatccacccagccaatcgcccaatcctcaattgtatgagcttggtacgttgcaaagcactggcatattactagtaaaaagaagaaataaaacagtaaaatccatatggccactacccaaaatgggttgatacatcaagtttgttgatactggcatctatcccgaaacgaactttaaacatgtgtaggtacattgatatttgaattttgaggtttatagttcagcattctttctgtaaaccaaactcccaatttgttgtttcacaacattgcaagtttcttatgcagtgccaaaatcttggctgcagattttttccccccatctttgaagttaggaacatttgaaatgaaaattttcctagttactatgtatatttgaatattcacaacccatgtaggactagcaatccagcattccagttacacttgtggcatcatggcagatacctatagcctaggtatcacaccattgaccactatgcacgagtga

SEQ ID NO: 32938 - DNA, 878 bp, Oryza sativa
ttaattatgtgccaaagataaccatgctagggctcttttaccatgtgactatttgtgaccgtttttagactcattgacaatttgacacatggcagagtaaatcaaccacctatttttatatttaatttaacaaattaggttcacatttattttagaacaactaggttcatattacctttatggaattaagatgcctgcactacatcagcacgataatatttggttttactattgcgtttcacagaattaaaatgacttccaagtttatacacacccccagctggtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaatgtgcaatctattacgattagaaagagctgcggaaaagttacttcatgctgtggaaaatttgactcaggtagaagataaaactcccatttcaatcttgttattactcttcaagtttttggtgcttttgaaggaacacctttgatcttatatcagcctagcgaaggatgaaacgaaacgtcaaattagtacccaagatacaacgtgctgacaagatgaaacttgaggtatactatttacaaaattctacctggcgaatgggctcgggaatgcgataattactacagaacttcactatcccaatggctgagtcaagtgaaatgcgatgcccaactgagatgggggatccactagtggggattcggccgccccc

SEQ ID NO: 32939 - DNA, 812 bp, Oryza sativa
tcgagctccgctcgttctgcacgcagggcctcactggggtgttgaacccatccagcactgcggtgtttgcggcggccagggcctgcagaaggggctcggcgctcagcggggcgacagaagatgaggagaagagccgcctggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccaagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaaaaaaaaacttctctttgggagaaaggtggttgcaatgagagtgagacgaacctgcgagggggtcggttgaatgaccaccttggaggagaaatcaggttcccccggcatggttccgtctccccctcttgcggagccgttcttcttgcgctccccccggggggatccactagtgggagagcggccgccc

SEQ ID NO: 32940 - DNA, 1664 bp, Oryza sativa
aggaaaaagctggcgtttggtgtgggagtcgccgctgaagactgcaacgttttcttgttcatcacttctgttttttctttgtttcggttggcaatggcttatttggctgcttgctcgcacattgacaaagggtttgtttgggagctggatttctcagctccttacttctaatttattttctaaattctacaaccacagctttttataatccgaacagaaaaatgactatttggaaaagatgtatcagctagaagcttctccaaacaaactcaaagactatttggaaacaacgcttctccaaacaaattcaaagactatttggaaaccgttgtttctgcttatatgtaacatttatggctaaataggatgtaaatcttagtgacttaagttatacatcaacttaaatcaccacactactattgtttttccctacttgagtgatattctctttattttttaatatatgatgtcgttaacttttagagatatgtttaactaaattttgtacaaacatgacaataataagtaatgtttaaagaacttttaatggtaatcaaatcacaataaaataaatgataattatatattgtgcaaacatatataattaaaagaaatggtgcaaacatataaaaaatcaacggcattatatattaaaaatgaagatagcatttatttggatttaaaattgtctggagcgaaaaataactattttacttagggtgaagacaatagacctccagcaaagctcaatgacgaaaaaaaatatatatgactttttattaaaaagaaagtacctttaaaaacgtgataatctcttgggttatacaataattttcataaccaaaccatgcaggctgccaagaatgttgagaaagttgtctgatttttcttttaccagccaagttgtcttcctttttttagataatggattatattaacccggcctctacaccttagaaggtgtacacaacccaaaccacaatcaagagtacataagactcaacccattacatggggataccaaatacatggggataccaaataatagtttaacaaaacggttaaagaagaacaatagtctaagcctcaattctggtgtgtttagttcacgccaaagttaaaagtttggttgaaattagaacgatgtaacgaaaaagttaaaagtttttgtgtgtaggaaagttttgatgtgatagaaaaattggaagtttgaaaaaaaaagtttggaactaaacaagggcctagtgtagttgtatgctatatgtagatcctttgcagtactgtacgtgcagtattgctaactgacatgtcagtctaagaatctgtgagacccatgtgtcagcgagcggtactgtatgtacgtatacgtacggtactgacatgtcagtctaagaatctgtgagacccatgtgtcagcgagcggtactgtatgtacgtatacgtacggtacttcagaggaccctctctctcagttcagagctgtatgatgaaaaactctttgtccatctagcagcacatcggcaagttgttcttttttttttctaaagcacatcggcaagtttggctctccattttcactatttttgccagtgacacatcgatctgcacacctttaatgccgaattaatcacaacattttcactctggaagggggatccactagt

SEQ ID NO: 32941 - DNA, 801 bp, Oryza sativa
gcggccgctctccactagtggatccccccaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctctcaaattcattaagggcatcacggcccgttttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctctactacttagaagacgagggcgggcgcgcgggcccttcgagccgcgcgctaccagcagagcttgcggcgctaccatca

SEQ ID NO: 32942 - DNA, 600 bp, Oryza sativa
  unsure (1)..(600): unsure at all n locations
actagtggnatcccccatatcagatacttatagttttattatttgtttccaggcagaagtcaactaccttgggcaacttagccatccaaatctagtcgaactgattgggtattgctgtgaaggctctcatagactgcttgtttacgagtacatggcttgcggcagccttgatttttttttttttcgccgtaagctgaccctttccttcttgacagttatcactcccacctactgaatggccgttgtccatggcagcagaacctgcaacatgtttattgtttttgcattttcaaaagtaaaaaggaaaatggtcagtttggtgcacgctgcatgaacaaaaacactaatttattttcaacaagatgagcagatctatcagtagaattaatataaatgcattcacacttatatttctttcagtgctcgatttactggtgcaatttaatctaatgagtagtgaccactatatacaatttagttgtatctgtgtacccgttccctccatgtaattttcaaaaataaaggattttcttttgaaacgataatggttagcatatgttttgaagttctcccaagtcccaactagctactccctccgtt

SEQ ID NO: 32943 - DNA, 877 bp, Oryza sativa
gattcaactctcaatttagtttaagcaaaggaaaatatgtaacatgggatgtaaatgatattataaacaacataaaagcatgatcacaaaactgttgtccagcaattccacatttcaaaacacaagctcagataagaaccgtattctaatttctaagcaaccggattactactatacaagatgatcccaaaatttcacatcaacaacatgatatattgtcttaaaaaataaagcacctgggaggcagtggctggaactgacggcgagtcaaggacgtcggtcgttggcaagcacggcgcgggccaactctcctcgaactcagccggccgcagcctggcctcgaaagaaattcagtataatgcggacattgtttctcccgtaaggcttgcctatcagcatagctccagtgagccggatgatgtttctgaagatctgaagaaatgtagattaatacacaactagattatctgcagtgtatgtagcttggacactatgactacataaggagtgttgtcaaacacggttctccaccagaagaagcagagacaaatctgatgagctaatggaatgtggtgaaccccataaggacttaaaaagaagttgcatcctcaaatgcgatgtgcttagcaaccaacaccgggtcccctgacttatcggtgaaagcacaaaccaaaagatagcaccaagtatcctggatagaagagaaaatcaaaagaggatgcagaggaaagtgtctggatgattgggttgaggactcacattggcgtcgttggactggtagatggtgacctcctcctacggcggcgctgtcagatcgagatggatgaggaacgcgccagcgccatcagggggatccactagtggggagcggccgccc

SEQ ID NO: 32944 - DNA, 664 bp, Oryza sativa
gcggccgaaaaccactagtggatcccccaaattttagtacatatatattgtccaaatcaatgtagcccatttctcccttttagcttgtcataaatattgtttacagttgtttttttaaaaattttgtggaacaaattgttgaatcgatcacaccgtgacatgaaactataagtataaagaatcatttctttttttagcttattcagatgctaaaacaaaatgtaagtcacattaactaatcatatcttctggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcagttcggaatacatccaaaatgcagaaatagataaggcagcggaattcaggcgcagcggcatgccattgccacaggcaacgaccgtactaagacctactgagcgccatcgtcttcatctccctcctggtagtaggcatagggatcctccaaagctttatctcctgcttctgattaattttatatttgcaagggtgagtaccaaccgtactcagcaagccaccacaacaacaatgcatatg

SEQ ID NO: 32945 - DNA, 14263 bp, Oryza sativa
catatccgggtttccgattccgatttcgattcaaaaaaaatatatgaaaacgaatatgatagagctagtttccaaccgtattcgatccgttttcatccctactagcaggccctggctaaccacactttggtgctttgagtgcagttttttagcctctgtaataacattttgcacaatgataaacctaaagtctatgccagttttgtatctgccatgaactaggtactgcagtttaagtgcttgtgcatatatattccccaggttatgtcagaatttcactgttgtaaactagttaattcattgggtctatgtctccaggacatgcttggcagagttatggggatattgtagccttaggctgtgtttgaggggaggagatataggagattgggaagatacgcaaaacgagatgagccattaacacatgattaattgactattaagtattttaaactttaaaaatggattaatatgattttttaaagcaactttcctatataatttttttgcaaaaaacgcaccgtttagtagttcgggaagcgtgcgcgtggaaaacgaagcaaaactcactcacaatcacccagatcacccaggaaagaacacagccttaattatttcgaaagctgcataccaagttgggatggtttttgatcttccacagaactttctcataaatcaatcgggttattaggacaaaaccctacgattcatcttcagatgttcttttttacgtgtatacaggatcgagcactacaccaactgatcatttgtactttgataagaaaaaacatgataaatcccggagggattcatttgctatctttgccatagtcaagtctgtagtacatcttttcttgtgctggtgtgatgtaaaaatccatatcagtctagcacgatttatctggttcgatttcgagctgtgaagattgtccagacgttctagtcatatcttaataataccgagacgccaccttcataaaacacacaccataaataatattgggtttaatttgcctcacttctatattgcaccattgtctgtaatcgatctactgcatcccacactcatgtgcaatacacaatctacgagatcccactcaccggcaaacaccgacgattgggagagcatttctcttaaactctctacttcaaagtcctgcactaggaaaaggatattgggaaaaaaattaatatacttttaatgttaaatagggatccactaaaacaaacgataaaatctactaagacagacgtaaaacattaggtcgaactcttcttcggtgtaaagaaagtagttgtgtatagtcatcactgcaagcgaataaggtgtttgggaagtgctacgtgtggcttcccgctgtatattcacggtgacatgccttcatcatttctcggttgtgacaagtcatcgtcaacattttgtagcatgcgtggtcaaagcggcacccttaattatattccgtacatttgatttattcatgtgcgattttatctctaggttatgtgcatgagatggttttgctagtttacatgtttgatatcaacatttatatgttaaaatcaattaagcccacatatgcttatattttcttccacttatacagcctatatatatgatctattcatacattgcagttttctcatccttactacttcctccgttttatattataagactttctagcattgcccacattcatatatatgttaatgaatctagacatatatgtgtgcctatattcattaacatctatataaatgtgggctatactagaaagtgttataatctgaaagggaggtagtattatatatatgtactctctctaggactgggagacatgaggaaccctggatatacatatgttatcctttggttgtgttcttaccttcaagttcccaacccctctccctcgttttccgcgcgcacgcttttcaaactgctaaacggtgtgttttttttgtaaaatgtttctatatgaaagttgcttaaaaaatcaaattaatccatttttttaaaaaaatagctaatacttaattaatcatacaataatacatgcttcgtttcgcgtgccggggaggaggggttcctcccgaaagccacctttggctcagctattatggaggcagcagtcgtaaggacaagtgcagctcccctgctgctgttgctatcaggctgtgttatggtacttcgtgcccttgtacagctccaagtacccaatccggtttgcatagcccgagtccactagatagtacttccctgcagcggtaaacacctgtacgttacacgtgatggaggttagaaattgcaaacatagaataggtagcagtgtacctggaggtggatgagggaaaacatgattgtatgtactcattgcatcgttgaacaccctcatgtcatgcacaaaacccggccatccagcaagcacgaatgtaaatatcatgtcaaagtcacaacatgccatgacattctgcgttgtaatgtggtgtcgacatatgtgctgaaccaaatgatctttggaaacctgcataggaatgtgggttccatctatcgccccaatacagtcgttgaaataaggatagaacctaaggtacctcagtctcgaatgcaatgttgcaaactgtgggtcacgtggtttaattatatcagcagctagcttcaaaaggcttgccagaactttgtggaacatattgtgaactgttgctaatgatcgctcaaatctgtcctcaacttgcctaaccgactgtggagccccagccatccaaagaaacaatcctaacgcctcaatacttttagatttcatgctagacttgagctcaaatttgtcgaccaatagatcatgaagactatagaacatatcagaggtcattctaaacatgttgtaacaccgcttcctgtctgcatgcttcttctctacccattccaacgcactcattgttgtgctaacatctctatattctgactggttgtagtacttgtcaatgtgttttgcaagatgtaacgtaccgtacagaaacgcggtggatgcataatcgtccataaagtactccatcataactctgccgaactctttgtcggaatcttcatcctttgtatccacaggttggagccgcacatcctcctgtaataaaagtaaaataacaacggtaactttcaaacatcctcatattaagaaatgaatttggaaagacagccttactacaacttatatttaattgccaacattacgcatgacatagtttgcaacacaacagtagccaacataccataaatgacatagctaacagacatagcagcactaacagacatagcacctcatagcttccaaagcgtacataacccaaaagatataactaaggctgatacattaacatgttaagcaagcattaaaaggtctagttgtcgacccgtgcgaggggctcaaggagggcctttcttccttcaggattggacagctcaaagacattgacggcatctcgatccttgagcatcttgaacatggcaacccacaagtgtggagtcgcctctgtgacccagcactccctactgagtgccatgatgcgctcagccttttcccccgcgcgagagtcatcatcatccctcctcttctcacgctgtgccgaatagctgtccattgctatcgctttctccttctgcagctcgtgtgcaccttcaattcgttcaccacggcgcggacggctgggctcttcaacttcttgcttggactagtagccctactctgcgtgcttggtgtgctcctcatgctgtgcgacctcttcgtcccaacactgatggggcttagggggtcgaagtcgtcatcgtcggattcttcgtcatcctcgctgtcctccacatccacaatggggttggccggctgggttgcgggctatgtaggaacaaatgaagtcgatccgttgacagccacccccatgaatatgcggtccatttcttcgagatagtcgggcatcccattcttcaacttcctaaattcagggtggtcctgcacaaaatgaatgcatcggtcagatgcataggaatgatcatgtgtaaaactgcgcaacgaaaaagtgaagtttttgtaccttagtgttgtcatcccaccacttgtctgaagcaaccatggtgccgtcaggtcttcggcccaaaccagtgtctgtacgcaacctcaatatgaaggtccacatatttttcaaacccctgtatctaaatccgaattgctcattgtcgtggaccaaatcagtggtggcataaaaaccctttctgatctccttccaacctgctttactcattcttccccttatgcagttgccattatctatttgcttgcaatacagctcgcaaaaaagtttggtgttctcatttgtccacgatgccctgtcgttgaaatcctagagggacaagtaaaccgggaaagcaatgaccttgcgacatatcaatcaatcggaattaaacaccgttatcacaatgaactcggcgctcactatgtcatgttattgcacaaaattgtaccacaatttttgtaatagctgtattactaaccaactaacataagagctgtaagcagtaatacatagaaattaaccatacgaactaactgtagctgtaatacatttcgcaagtattgtactagctgtacttgacaagttacaacaactgtagtacgtagcaactaatcagatgaaccacttgttaacctcaaatgaaatgggaatccacacattgcaacacctaaaaacgtccttacctctgtcagccggcaccgtgcaccgcgacccctacctcggcctcgaccctgagatgcggctcgagcttgaggctggatgggaggcacgaatacgcctccatggcctgaacctccaaatggcggtgccattggcgcttggaacccagctccaatcgcatgcggcccgtcaactcctgccgccgacatccgaccgccccgtcgcggcccagatccggaagctccttgagcacttggccggcccctcaacccgagcgtgcgatgcacggtacggggagggacgcctacgctaggagggcattgactgccatccccttcgccactgcgaagaaggtcttggtagccgtgcatggtcgaccacttgtcgccgtagttgaggtcgagagccccgaagttgaaccgggagggttctggctgctggaagaaccctcgccaaagccactcgagttgtaggacgtgcggccgccatcacgggagagatggagaggctgcgcgaggaagtcgtgcgtagggatgctggcgccgaatcgatgctcggccccgtaaaggaggatggtgctcccgccgccgtatccgccaaggttgttgccgtcattggcgtctccgtagccgtggccgctgtcgccgttgccgtacccgccgccatcatggctgtcgccgtagtcgcccccgttgttgctgtcgccctcgtacaaatccattgcacgctcccgtcgattccgctgcacgcaccgccacggatgtgatggatctggacgaggaacccttcgattcacccagggtagggttggattacagcggcggggaggacagatgcgacgccgatgagttcgagagagagtggacgcaggggagaagaaccttagggttagcgcgtgtgaagaggcgatggggaatggataggatcggcgggttcggcgcctcccaggggtataatgggccaccctaaccctaggctactgttgggccttaaatgtgcaatatggccgaatttcaggtgactacccgtttagttctaaagtccagactgcaccccttgtaccgagttttttggcactttggccctatctaaacacggcctcaatgtagcacgaggaagcaagagaggctcgagaaactaggttctagttatttgctggcatgtgctttgatgtgtccatcggaagccattgatgcttttccactatgaaggattctggttcatcgagggactgaatgtattcctttttttttcttatagcacattaggaatatgggacaattgatcgattgaacacttcattctccgcggtttcttttgtttgaaatcacaagtttctccatctacaaatgaaagagacataggttttgtagatatgcaggatttaatttgcaacatcagctcaatcatgtagacagggcatgatttcctcatatggcatgatgactacctgtgtacaaattgttagagtacatatatatggtacttagaaatgtattaggatagtattgatttgtgtaatttttttcttatatgtaatcttttcttatctctaccacgtatattttgtatatatcggtccctgagcttaatacgtacatgtgtaatatttcgtagtatttttctccgtttactattctacacaaatatattatttccataggccttttgttagatgtcatttagcgaactgtctcttgaaacgtcatttagccgtgtgtaagagggcttttacagggcatcgaagaaagtcttcaatgattttcgtggcagtgacagtccgaatcgcacaagaccagaggagctttgctctgctagttttcttttgttgcacacggctattttcgactcgacacctctgattcatggcagcgttcgtgctgcatacagttcgctcaagcgtcttgcctccttttctatcatgtggttacttttccagatgaatacagagacatttagagaccataggaaaaggtacgaattacccccccccccgaatctcaaaaccggacaaattacccccttggctcaacccagagtggttttgctcctacgtggcacatacatggcgccacgtggcaatccaataaataaaatattaaaaagctgtgggcccacttgtcatgtactcctacctcacccctctctctcttctctctctcatcagctagggggcacgacgggcgtgccgggagggcgagcggcgatggcgaacgcgaagcacggtgtcggcgaccgcgtccgtggcggcgacgcgtgagtcgcgcgagatggagcttttgcaggaggtggatggctgcagtgtggtggtggtggtggcccaggcagagaaggcagcaacggcggtggagtgcgggtggcggtgaggggagggagagacggggagcgacggcgagggagggggtggcgcgagcttgtaggggcaacagcagcggacgacgacgacgagacaaccttccccgccgagccgaggtcgtcctcgggcaccgccggggtgccgtgctcgccgagagaggggaagaggagagagaggtgcgggaggacctccgccgcctgccgcggtcgattccttcacgtgagcttcatcatgggccacgccgcacgccctgaacgccccctccacgcccaccgccggcctcggggtccgctctcccgactgcgctacggagagacagagagaggggggaggccacttgccgtagtcgccgtcgtgggccacgccgcgttccatcaccgcctccacaacgcccgccgccggcctggggtccgctctcccgatggtgccagagagaaagaggggaagagccttgcctggcgccctgccgcagttgccgccgctcgccatagtcaccacagctggacagacgacggcggcgccaccctgcttagctcgcgggatggaggatcggcgtagcttgctcagcccaccgccagcctcgcctcctggcccgcccgccggcctcggtctctacgcccgcccgcctccggcctcggatcctcgcccgccgcctgtagccatccccgccgccggccgccagtcggtgtccgctcctcgcccacccgccactcgcagtcacctccgtgcccgtctgccgcctgcagccgcctccgcgcctgtctgctgcccgcagccatcccctccgccggccgccagtcggcgtcggcctccgtgcccgcctgcctctggcctcggctcatcacccgtccgccgcccgcggccatccccgccgctggccgcccatcggcgtcggctcctcacccgctcgccgcccgccagccgcaagatctgtcaaccgagagagaggagtgaaaaaaaacgctaaaaggtgggccccacctgtttttatttgtttttgctgactgtatcgccacgtgtgtgccacgtaggctgaaaaccgcttcaaatcgagttaggggggtaatttattcggttttaagtgtttggggtgttaaatgtccggtattatagtttcgggggataaatcgtactaccgcaatagatcagggggtaattcgtactttttccaattaccatatgtttgatgcatcgatgcaggctgatcgtgcatgcatgtttaatttcttacatgcctgtggttgatcatcaggataccaagtctccgaccacaacgtgttctttatgggaaaactgataaacaaatttcatcacttcagttaaacggaagaaactggatatataaatatggatgtctatgcctgattctggaagccatacagatatacagacaaaaacatctcgagcgagcacctgacaggcatgcacagaacctcccaaatggtatactattggtgcctagaccgatctctgcacgctcttgtaaccacagatcaatctgtagcccgaggtattgtgccgccgactcctgcaaccattggatcgatggtgcaccattcaatctactattcaatatttaatatactaactaagtcacttgggcatagttttagatcttggacccacagtaaatttaaaatttttacgttaaattatagcggtgcaaagttttaaattttatctaaatcgggaattaaatgatttatctaaatgttatcaacgtaatcgtagatctagattcattgatttgtaaagctagaaatacccatctctaataaatcttaatttgatccaaaaatgtaccaaaaagatctaagtacattgtcagatttatacaaacgtattggtattgagttgcacatttgcataatataatttagttggatttctcaccacacaacgcaacttactattgctttcatgatatgccacgttgataaggtaaggatcctgctgcattatagggactatagctagtctagagattccgtgaacgaggtggaaacaaacaagcacacagattcacaatattgacagaaaggtattggaaaaatacttgcggcaatctattcgtcaagcgaataaatttttcatagatattaataaataatgttgaaaaaatgctcgtggcaatctattcgtcaactcgttttccacattggagtatgccgtgggaaaacttgattcaaaaccacctaaaaatgtccgcatgtgattaaatgtccggatttaaccgatgaggtgtgtgttgtcttttttttttcatagttgagggcggtataaatcatattaattttttcctatagtagatatggaaaatctagttattaaccctatacaaagctgtgttgtttcacattttatacaagtttaggctatatgtattgtaactatagtcggttaattaagaaacaagaaaaatcgcataatttgatttggttactttacaatgaggaggtacccttctattgtttgaaaaattcctaagagggtaaaacaaatatctaataaataaacccattcaaacaaagatccgttactctcttacgtttcgagacgtatcttggtcgttttttgttgcgttgttatcatctttcgttgtgatttatgaacagcttctgccagaaaccagagttgctggcttctagaatagcaaaggcagcggcacgcgcggaccaagccagcgattgattggagacccttcccccccccccccccccccccggcgcgcgcgcgcatgtgctgacaattaagcgtcaaaatgaacgtgtgcgttggtgtgtgcgtggacaaatacctaactatcactgtgaattcagccagattggtgcgttatcgcacgcccaagttgcccaagttgccgagatcgatttggaacttgatcaaatccaaaacgaaaagtaggagatcgatgccgcagtgcagcccaaaactacgtacgctaggctacgtcctatatatatattcacctgctttaatttgcatcgatcccaacttaaactgagtgacgccgcgccaatatgcagccgcgctgtacgctcatccacgccgtcgccgtcgtcgcggcggcggcggcggccgcgctgctgcttcctccgctcgccgccggccagccgtggccgacgtgcgacaccagcgccggcacgtacaaggccgggagcgcctacgagtccaacctccgtgacctcgccgccgcgctccgcgcgggcgccgccgcctcgccgtcggcgctcttcgccacgggcatccgcggcggcgcgcccgacgccgtctacggcctcctcctctgccgcggcgacctcagcgtctccgactgcttcgactgcggcacccgcgtcctcgccgacgtcggccgcgtctgcggcggccgccacggccgcgccaaggacgtggccctcgtgtacaaccagtgctacgcccgattctccaacaagggcgacttcctcgccgccaccgacaacgccggcggcgagacgctgctcatcagcggcaccaacatcaccggaggcgccggcgtcgtggcggcgtacgaccgcgcggtgaccgagctgctcgcggccaccgtgcggtacgcggtggaggagaacccggcgaggctgttcgccacggggcagcgcgtgggggacgacgcccgcgacccggggttccgcaacatctactccatggcgcagtgctcgccggacctgccgccggcgtcgtgccgcaggtgcctcgacggcgtcttggcgcggtggtggcaggtgttcccgctcaacggcgagggcgcgagggtcgccggcgcgaggtgctacctgaggtctgagctgggcgtcggcccgttctacaccggagctcccatggtggtgctgcgggcggacaaggtctagccagcgtcgtcgccattggcacccgatggaagctgcggtagctacagcctacagttctacgcaccaaaatggtggaggtgcaccctacctatggccgacaaagtgcaagcaaatctctacacgtatacctatactattattaggacattccgacaaaatgtccacgttcacccgagaaattttagtgaataaatctggacatcgatccagttaaaaccaaatttacaacggttcaataactaaaataattgatatgcagctcttcgccaacttcaggtagaggttcacaaataaaattcagtagttgtgggagctttatcttgtgttggtgtgtattagtttgtgcttacttaatattttgttggtgcgcttctaaactcactgtgtaagattgcttttgtgtgaattctgtaataattggatatagctcattaagcaaaaatcgagatgttttattccatcacctataaaaaagctaaaataatcgacaaagctttcagttagacgtccaatcaaatagaaaagatagggcatcatattacctatgtctaagctacatggccgctatatgtgcatgcagtagcctatcttcctactcactagcattctcctcccttccgatgtcttttctacgtttttaaaatagcttgacatgagttttcttttaaattatttatattcaatttacaatccgattatatcttgaatttattgttattaaatatgtaaaaaaagatatcacataattatattcttatgaaagatatgtaaacttatgttttaaccatgaaaattcatgttcatacgcgatactgaaatgtttcaacatatgtttcacataatctttcagtatttcaatcactattttttttcaatgtttcacccgtggacaacttaaacatttcacccccccacaaaatttttttttatggaaattaggtgcctggtatcaatttcatgttggtacttcctcccgttccgtaatccttgatgttttggataagattgagatcaacaattaaaactttaactatcaatactccattcatttcacaatgtaagtcattctaacatttcccacattcatattgatgttaatgaatctagacatatatatctatctagattcattaacatcaatatgaatgtgagaaatactagaataaattacattgtaaaacggaggaagtaacttttaaaatatctagtttgaagaaactacaacattatgcatagattaattttgaaacatgcattaataaatttaaataatataataaaaatatagttaaaaatatgttctcgagaccgtattattatccaacacgtcaagaaatataatagaactgaggggagaatttagtcagatggtttatttatacgaaattatcattaaaaatgcttcctatcggtctgctgataaagccaacaggttgtgcctccatcttgcgcttgcactttctgcatccggcgcacctcgtttctctctctagctgcatgcgtcatctcttagacggatagtctgtctactctctctatctccttgagcatgcagtggctgtctgcattcatgcatgtgctgcattagtaactttaaacgattttacgtgtcagatgcaaatgtttccactcatatttgactttacttatcgattttatgaattctttccatggatttatcactgggctcaatgtttcatgtcacggttgttggtgttgcagtttgtagtttttaaacattccatttctctgaagcgtttcactaagtggtgaaacaacatttggttctttttcgaaataaacaagatgcccaagccatagtctcatctaattattacatattaaaaaaatttccattccacacctatggcaacagttaaatattttgtccctaaacttcaaattttcctcctctctctataccagacacattccatcattccactcatttgaatgaacttttagccatggatacatgactcaacatgttgacgaggcctggcacatttgttgagcacttgagctctctactatggttttgctctttctatctctctcccctgcacacgagagatgttaatagttgtgcattgtcttgtcagcatgctaactcatctgttcatacagtgaagagtttcatgtttagagatatgagtattaatgttttgacccattgttgtagttgagcgacagaaaatagctagttcattgtaatagttgggaggtacgaaggctacacttttcttcattataaaacaattataaaaacatgtgatgtgcttccttcatgtgaataaaggagtcacgcattaaacatgtataatgcatccaaacaggtgtgcacaaaaactaggtatataattattgaggtttctcttacctccttggaaaggtacctcctcactattcaaggggaaaaagaaagaaaatcggtggaactgattgaaagaacagtatacaattggtaaggttggactttttttttccatgggacttgggaggtatatagaggcatatatacctcacaatgttagtcatgaggtatatgcctccatatatataccattgaaataatacatttacctatgactctaaaaaacttctcaaccctattccaacctctaagattagttttggtacctctcttcatgaagggcatatctatatatataaggaggaatacaactcttcaagggtggtagatttttaggtcatgttatgatatgccatatgtgctatgatttgtactttgaggcaagccatacagtacttcttcccaattgatcatacggtaggtagttattaagagatgttcactttgaagtgtacaagacacagccgtgcatacaagtataaaccatacatgtgtcttgctaccaaaatagaaacaattcagacaacatcgccatttctgattcactcattatatatattgtcatattgcagtctgcttctacataatctacatatacatttggactgggaggtcttgaaaattgtctctctccatctaggaaaagcgaaagcttttgctgtcatgcagcctcttattaagagatcttccgaaggttggcaatattgtgaaagctaatctcttcagaggagcgatcgacgttttaatgggatgacacaatttggaaaagtataaatgttagttagtgcttgtgtgtttttttaaaccaaatgcatgtaactcccacataatttattaatgaataagtcctacataatttattaatgaataagcccgtctggcctcctgaactgtcaagagactagtgcactgtttactatattgactatgttaaacaaatttctttgc

SEQ ID NO: 32946 - DNA, 24024 bp, Oryza sativa
actgtgctgagggtgatgttgggtttagtcccacatcggtaattgatgatggggagcacgacttaaaaggtgagagacgcggtacccacctatcatactagttttttaggttgcttaggtccagaacctaaagttgtggctttgattgggtctgtggtggagcaggtccaatgtcacatgggtggcccaagattggtgggccaggctgcgcactctaacaggtaaccttgtatgtatatcaaactactagctaaatacccatgcgttgcaacgagggggctcatattatttgtcatcatttttacctcatttaaacaaatcccctgttggaataaatattgaattaaggaaaggacaaaaaaatccttctaccttatcattcactggtggagaaaccatcttttgtcggtcggccgaatttcacaatagtcccggttgcaataaaaaccgggactaaagataacgggcatatttaatctttagtcccggttcaaatgctgtcagtgcttgtcaggccccccgggatctttagtcccggttagtgttaccaactgggactaaagatcccggtgatctttagtaccggttggtaacaccaaccgggactaaagtcccacccctttatatatgtcttcttcctcctccagcccgagcaagcttcaaaatttcttcaaaatttcttcaaaaaagaggggaggtcatgccaaaatttatagtgaatttactttggtgattatatacaaatcggaggtgcctaaaaggttagcaacttcatcctccaatgtttttttggtcatattacatttggagctatgttttgcacacttttttatctccaaaattttgttgtaagttgatgagagagaaaatttgtgtgggaaaagaaagaatatatagaaattttgtttatttgctaaataaggttttataaaatagttgagtaggaaaatatagagaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgttattattgtacgaatgattatttgtgtacgatttttttttcatttcatgtagatggatcgtcaatggatgtacgctgaccggcggtccaaagagtttattgacggcgtgcattattttttgagagtggccgaagctaacaagtagaatggttttatttgttgtccatgcaataagtgtaagaatcagaaggagtattctgcatccaggactattcatttccacttgtttgagtcggggttcatgccaagctataattgttggacattccacggagagcaaggggttgaaatggaagaagatgaagtggaagacgacaatattccagactttgctcagtacgctggatttgaaggaaatcaaacgggcgaggaggaaagagatgctgattataacgatgttgcggatgatcttggtcagatgttgcaggatgccaaggaggactgcgaaagtgtaaagggggcccataaattggacaagatgttagaggaccacagaacgtcgttgtacccaggttgtgagcaggggcacaaaaaattggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcgcggtaaggagtacgagaacctagaagcatgccctgtttgtaaagcactacgatacaagattagacgagatgatccaggtgaggttgacgggcagctaacgaagaagagaattcctgctaaggtgatgtggtatttccctataataccacggctaaggcgtttgtttaggaacaaggggaatgctagaatgatgctttgtcacgctgaagaacgtcaacaggacgggatgctgagacaccccgcagatggttcgcagtggcgaaacatcgagagaaaatttaaagactttggaaaggacgcacgaaacatactgtttggtttaagtacggatggcatgagtccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaggaggagtttaacctacgagcgctgctgttcgtaaccatcaacgattggcctgcacttagcaacctatccgggcagtcaaacaaggggtacaaggcttacactcactgtatggatgaaacagaaagtacgcttaagcactgtcggaaggttgtgtacatgggtcatcgttgattccttgcagcaaacaatccagtacggaagaaaggaaagcactttgaacatacggcggaccaccgtacgaagccaaaacatcgtagcgggaaaacagtgtttgctacggtgaaaggtcttaaagtagtgtttggaaaggggcctggtagccagcctatagagtgcgaagatggtcacgtggcgatgtggaaaaaaaaaactccatattttgggagttaccctattgggaattcttggacgtccgccacgcaatcgacgtgatgcaccttactaagaacctttgcgtaaaccttcttggcttcctaggtgtatatggaaagtcgaaacatacactggaagcacgtaatgatctgaagcatatagaacaacgtggcgaccttcacccggaaccaaaggagaaaggcagccattacttgagtccagccagctacactcttagcaaggcagagaaggaaagtatgtttcaatgcttggagagtatcaaggtaccatctggatactccacgaatataaagcgaataataagcatgaaggagaagaagttcacaaacctaaagtctcatgactgtcacgtgttgatgatacagctgctaccagttataataaggggtatcctcccagacaatgtccgggcaacaataacaaagctatgttctttcatgaacacaatttcgcagaaggtcatcgatccggataggttagaagcccttcagaatgatgtggtgcaatgtcttgtcaggtttgagttgatatttccaccttcatttttcaatataatgacgcatctgctttgtcacctagtgaaagagatcggtattctcgggcctgtgttcctacacaacatgtttcctttcgagaggtacatgggcgttctgaagaagtatgtttgtaaccgtgctcgtccagaggcaagcatcgctaagggggtatggaacagaggaggtcattgaattttgcgtagaatttattgaagaccttcgcccaatcgagttacctgaattacgccatgaagagagactacggggaatggggactctcgaaaggaaagcaataatgacggtagacaacaatttattccgtaaagcccatttcacggttttacaacaatcttcattggtggctccttacatcaaggagcacttggctctagttcgcaccagaaacatcggtaagtccgatgcatggattacacggcatcacattgatactttccccgcatggctgtgacaacatctcatgggtaacgagacgattaaccagcaactggccttcctggcgaggggtccatctggctcgatcgcaacattccaaggatatgagatcaatgggtacacattctatacaagagcccaagacatgaagagcacgaaccagaacagtgctgttcgtatcgatgccatgggacacgatggtacaactggcacgtattacggtgccatcgaggagatatgggaacttgactatggacctctcaaggtccctctgttccggtgtcaatgggttaggttgactggtggaggtgttataattgatgacagtgggatgacaacggttgaccttaacaaggttggatactcggacgaaccttttgtccttgccaatgatgtaacgcaagtttttaacgtgaaggacatgtctagcaaaggaaagaagggcaaagggcctgacgagccgatgcgcaacgtggttctcccaggcaaaagaaaaatcgtcggagtagaggacaagactgacgaggattacgatcagtttgatgggcaacgccctttcacggtgacgattgaccctagcatcctcctagcaaatgaagacaccccttactcacgtagcgatcacaaggaaggaacaatagtgaggagaaagtacgtgcggacaaccgtcaccgccgatgtattgccgtaaatgttgtaaactattttggatgtattgaatatgctagttatatatgatgattaacaaatttaaatcatgcatatgctaggtacatataattattagaatttttaaaagttttaaatcatgcatgtggtatttacatatgttaattacaatttttaacaatttaatataatgcatatgctaattatatatgattattagaatttttaaaagttttaaatcatgcatgtgggatttacatatgttaattacaatttttaacaatttaatatcatgcatatgctaattatatacgattattagaatttttaaaagttttaaatcaagcatgtgggatttacatatgtttattagaactttaacaatttaatttcttgcatatgataaataaatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgtttattagaatttttaacaatttaatatcatgcatatgctaattttatatgattattagaatttttagtaattttaaatcatgcatgtgggatttacatatgttaattagaatttttaacaatttaatatcatgcatatgctaatgatatatgattattagaatttttaaaagttttaaatcatgcatgtgggatttacatatgttaattagaatttttaatgcattatttactattttagaaacacatattcaacgaaattcaatattcagtgctattatctttagtcccggttcttaaccctaaccgggtttaaaaaagaatttggaaatagcgggaaaatatctttactcccggttggtgagaacaaccgggagtaaagatatctttactcccggttggtaacaacaaccggaattaaagatagatttctaatcccagttgttgttatgaaccgggagtaaggttgttctcatcaaccggaagtaaagatctggggggtatatatattcccggtgcgccctcgtcttctccaccaacacttagacgtttttccatcgagatcgagcatcggcttctccttcgccgccactgcttagggcaaccccgcgccgacgccggcgtcgtctctcaccgttgcctggcggtcctcgccgcctccgccgcagacgccgccgccgcctctcttgggtgagagcccccaccctctctctctcgatgtagctctctctctctccaaaccgccgccgcgtgcctagctatagcttgttgccgacgccactacgccacgccacggtcaaccgccactgccgacgaacgacttcggcgtggccgccaccgccggcgacgctgacgccactgccacgccgccgcccctgtctcgagatcatgccgccgccgcgcccccacgccgcgggcccccacgccgccggaccgcgcccccaccgttgcgagatgccaccgccgcgagacgccgccgccgccgccacgctgccgctgcgcccccacgccgccgggccggccctcggcaccggaccgcgcccccaccgccgtgagacgccgccgccgcgaacgaacgcttaacgaacgtgaacgaacgcgaacgaacgcttaacgaacgtgaccgaacgcgaacgaacgcgaacgaacacttaacgaacgcgaacgaacgtgaacgaacgtgaacaaacgcgaacgaatgcttaaagaacgtgaacgaacgtgaacaaacgcgaacgaacgcaaacaaacgcttaacgaacgtgaacgaacgcgaacgaacgtgaacgaaatgttaaagaaatgttaacgaacgtgaacgaaacgttaacgaacgcgaacgaacgtgaacgaaacattaaggaacgcaaacgaacgtgaacgaaacgcttacgaaagtgaatgcacttgtactaaaagtgtgagaacgaacgcgagcaaaacgtgtacgaacgagataattaaacgattattaaacttagcatacatatatgattatatatataggttaaaacgtgaaatacaataaatgtaacttggccctgtttagactaatatattttcctagtaatgttgtagagaagacgtcgttgtcgtccctcaagccgaagtggtagctagccatcgaaggaattcgcgcaggcaagtgttgtaaagaagtgattgttagagatttaatataagattattagagttttaatataagattattagattattagaattttaatataagattattatattattagagatttaatataagattgttagacttagcatatatgattattacaattttgatataagattattagagtttgaatataagattgttagacttagcatatatgattattacaattttaatctaagattattagagtttgaatataagattgttagacttagcatatatgattattacaattttaatataagattagtagcgatttaatataagactgttagacttagcatatatgattattacaattttaatataagattattagagatttaatataagattgttagaggtttaatatacggaacttaattagacttagcatatgtgagtgtcagagattgttagagatttaatataagattattagaggtttaatatacggaacttaattagacttagcatatttgattgttagagattgttagagatttaatataagattattagagatgtaatattcgaaacttaattagacttagcatatatgattatctagggttctaatacacgacacttagacttagcatatatgattatttgagttttaatacaagattaattagtagagttttaatattacgcttagcaaatatttcttctatgaacagatggctgatcgcgatgaggaacagatactgtatgatacaatcgcagagggaagcagccaatactggaacgaagaagaggggaacgaggatccaaaccagtacttgaacgaggagcggaacgtggagagggatgcagaggggaacgaggaggggaacaaggaggggaacgtggagagggatgcggaggggaacgaggaggaggccagtggaagtcatccctccgctggacagaagagggcacgcggacaacgaggtgccacgaagaagataaagggtcggcacatcataactgaggtggacgaagacggccgacctagtgccccggcagaagcagccaagaattttgtacaccacatcggttgggttgtgagggataacgtgcctgtcagcaaggtgtactggcgcaaaacaagggcacgcggggatgatgacagctttgtcccggaatcagagaaagagatgctgtggactacaatgctcgagacgttcacgctccctgcgggtacggagaacatagtgaaacagtggactcttaagaaaatggcagaacagttccagactgtcacgtcctgataaattcatcccgaaataaaaatcatcttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggtttataaaaagaaaaatccctaaaaagtctttttcccccctttttccttcttgggccggctcggcccattccctccctctctctctcttcccccgcggcccatcggctctctccccgcgcgcgcgccgctgacgggcgggcccgcccgccgccctcgctgacgggtgggtcccgcctgtcatctccctcctcgcgccgcgccgccgcccgcccgtgccctagcgccgccgccgccgcggattccgccgcatcccgccgtccccgcgcgcattaaagagggggaaattattccccgcgattccctctcccgtttcccccgttttcccctctctctctccctcggattcgtccggattcatcccgcaatcgtcgccggcgtcttcaatggcggccgagatctccgcgccggtttccttcctctccggccgcgctctccccctctcggcgctatatatttgctccccgtgcttcgctcttccgtttccgccgctcgccgctcgctctccccgtcggattcgtgctcgcgccgtcttcctctctctccgccgtcgccgacgagctccggttcgccgccgacgtcgctccgcgcttcctcccgactcggcgccacctccgtcggcttcgccgcgtcgccgccgaccccgtccacccctccgcttcgctcgccgaccgccggagcaccgtcgccctcgccgtcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaatgagttttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgctgttatgtggaggttattagagtaaaagccgtttcttttccgttggtcgtgtagacgctgcagcttcggaagatccgctcttcgtggaagtcgaagccgtcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctatttatggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaatcctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcagcaactaaaatgtggaatggttggcctgggttggcttgggacgagctggaacccaggtcgggttgccagttcggtccaaatcatcgtaggccttgggtcaaggcaggttcgtgagggttcacggccttgtttaataatactgtgtagctctagaatcgtctttacaaaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacagaccttcaagggagatctatacaagaaatacatcctgaagggactaacaccgaacttcgacgtattcccaaagctaagggatcattgggacgagttcgttgcttacaagacagggcaacaagggcaagcgatgatggtcaaaaacaaggaaaacgctgccaagaagaagtaccatcatcacttggggtcaggcggctatagcgtcgcaatgccgaagtgggaggagatggaggcaggcttgattgagaggggtatcgaaccggccaccgctaaatggccggatcgatcgaagttctggtactatgctcacggtagaacgcttaacccagttgatggctccctggtcttcagcgatcagatacgcgaggctgccagtcgactaacagacgcagtggaagcctcttctcagggcacgttccgacccgacagagagaaggacgagctgtcactcgccctacagactcccgagcatccaggacgaacacgagggaaaggcgtgattccctagaagattgtgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccggaggcaggcgcgtcgtgggaacgtggctgtctgccgacgacatgaccggtgttagaccggtcacaaatcggtcattcttgcccaccacgcgtcagcctagcaacgtgcatgtttgcccttcttcatgtagcatcttgcctgtaatggttgggatgaagcctggtataaatctaaccagggctaacgtgccatctctaagagattacacgctagctctggcttgagacgagtgcctagaggctttcgtcttgacgggatggggcaaggcgtgcgtcagaccgccagtcgccacctaacccgtgatctgaccggtctgtgactggtcacagaccggataaaggaacgcactgcactacgctgcatgcagcgtgacacgttcgaccaaaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcttggtgacaggtgggaccggtctccatggttgggcagaaacccaacggtctcaaatcatgcacatcggtaatggtgacttggctgtccataatgggcggtctcttcaagactgccacattacttgagcgacgtacgaatctgggtaaaccgatttgcttcgcctggagatatggtaacgttgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccgggcacagcgatggcaaaggtataaagacactgaggaacggatttgctcccttcctttcgccactattccccttgccttcgccgcttgagctctaactctttctctgctgcgcctttccttcgccacacgcgctcgttctcaatcatcccttcctccggcgccatggcacggggttccgctctgctcgacggaagcgtacttccgccttctcgcatcgtgagcgagaggcacgccgggctgccgcgccgctttatgccggaatctgccaccggcagggagatagtgatgctgggcgagggacgcccggcaccagactacccggggcggtccgtcttcttcctccccttcgcaatggcagggctggttccgccattttcttctttctttatggatgttctggatttctacgatctccagatggcgcacctcacccccaatgcagtgatgacattggtcatcttcgcgcacctgtgcgagatgttcattggggtgcgcccatctcttcggctgttccggtggttcttcaccgtgcagtcggtgtcgccgccgtcggtggttggtggctgctacttccagccgctggggccggtgttgaaccgctacatcccctgcgccctccgcaagaagtgggacgactggaagagcgactggttctacacccccctcgccaacgaagcgcgcctccgacttccaagtcagcccccggcgcaggtctccagctggcgggcgccggtagatctgggggatgactatgacgccgtcctcgacagcctggcgggcctgcgatcccaggggctcacaggggccatggtgtacggcgactacctccgtcgccggattgcgccgctccaacggcgcgcccggggcacctgggagtacaccgggtccgaagactacatgcggacccaccagggagtcagatgggattgggctcccgaggacttcaagatcgtggtccaaagggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttctgggccccgcgtcgggggctcggggagcagccgccctgccgacgcccaggggaagaggaagctgggaggaacacctcccccatctcctccccgagggggcggggcggtgcgtgccagcagtcggcgcccggagggggccgcgctgacatcgcagcccgagggggagcgcaagaagaagcggccccgcaagatgggggagacggaaccatcccggggaaatctgatttcccctccaaggtggtcatttaaccgaccccctcgcaggttcgtcccactctctttgcgaccgcctttcttttacccaaaagcaagttttctcttacccatcttgtttgtcttctggttttttcttttgcttcagcgatgtcccgtcacgttcctcccgccatcccaagtctggccagtccgaggccgaagatccggcggccgcagaggaacggaggcgagaatctgaccggcgagaggccgcagatcgccttcgggaagctgaagaggccgcccgggaggccgctcgggctcgccatgcagaggataccgctcgggaggaggccgcccgggctcgccaagccgaagaagctgctaaggaggaggccgcccgggctcgtcaggctgaggcgatggcgtcttccgaggcagctcacgacgaagctgctggcgcgtcgcttgggcccacttccccaggcgacgcccaggaccaaacgggtctgggggacatccccgagcccagcgcgtcctccggcgggccgagccgcgtcgcattctctccaaggcggctcttcccctcgtcttctgtcgccccgctgagcgccgagccccttctgcaggccttggccgccgcaaacaccgcggtgctagatgggttcagcgcccaagtggaggccctgcgagcggaacgagcggagctcgaggccgcatgggcgcgtgtcgaggaggggcggcgctcggtggatgtcatggtggaggtgggccgtaaggctcaccgccgtcacgtctctgagcttgaagcccgcaaagcggcgctggcagagatcgcccgagaggtggaggaggagcgggaggccgccctcattgccaccaccgcgatgatcgaggcgcaggacaccctccgccttcaacacgggagctgggaggcggagctaaagaaaaagctcgacgccgcccaaggggtccttgacaccgccgctgcccgagagcggcaggcaacggagattgaagcggcgtcccagcggcgtgaagaggccctcgaggcgcgcgccatggcgctggaggagcgcgtctgcgtcgcggagaaagtcctggcggaccgcgaggccgccgtcacctcccgggaggcaacgctggcggcgcacgagtctgcctgcgccgaagaggagtccgcactccgcctccgcgaagacgcgcttgccgagtgggagcgagctctcgaagaggccgaggccgaagcgcaacggttggcggactccctgtccctccgtgaggcagcgctgacggagcaggcccgccgcaatttggaatccgtccgcgccgagagagccgcactggagcagcgggctgccgatctcgaggcgcgggaaaaagagctggacgcgagggcgtgcatcggcggggcggctgcgggcgaaagcgacttagccgcccgcctcgcagctgccgaactcaccatcgccgacatgcagtgcgcgctagactcatccgccggggaagccgaggccctccgcttggcgggcgaaatagggcccggcatgctttgggatgcggtctcccgcctggatcgcgccggacggcaagcgggcctctggaaaggccagacaaggacgcactccaccaacctggaaggcctcgcttcgcacctcacgaggatggcctgggctcttcaacaactccccgaggagctcgagaagaccatcaagtcatcctcgagggacctcgcccaaggagcggttgaactcgtactagcgagttaccaggccagggaccccaacttctctccatggatggcgctggaagagttccctcccgggaccgaggacgacgcgcgtgcgcgggtccgggatgccgccgaccacatcgtccacagtttcgaggggtcggcccctcggctcgcgttcgcccccaactccgacgaggagggcgatgccagcggtgcagacgatcgtgacgacgaggccggcgacccgggcgcatcggactgagcccccaggcccccgcctgactccagtttttcctttttctttcttccaaggccttcatgcctcttttttgtatagatcaacttaatctggaatcaaaaatgatgaaaaaattcgtgtcaattttattttgctatgcgtatgagatgaggatgatctgtgccgtggtcctcttttgtgtcttagcttgatttaaggactcgtgcccaagtcccagtcctctaatggctcgggtcggggctagtgcctggggagatccacatgtcgaggctggccaggccgggaacgtggtgaccgagggttatgggtgacccgattgtgggtttttgccgattcccccccgaagttcaccacgccccggggcacggctcggttctgggccccgtttggcgattttagctgaccgaaccgagcccccgagggcaaggttgagtacgagtgaccttatttcaagtcaagattctacaaaaggaaaaaacggcacagacacaacctttaggaaattgaaactgcttttattgaaatgctgaaataagagaaataagaatgtgcatgcgtggtagcccccggccaaccctgcacacccgaggggggtgcggggttggcccgagccaaaacctgacactcgacccccccctcaggggtagaagcgacgaaggtgttcgatgttccacgggttaggcagctcagtgccgtcgcccgtggccagccgtatggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaaaagagcttgatgcccatgtcttcgcagtagtcgccgaagagttcactagtgaattgggtgccattatccgtaataatacggttaggcactccaaaacgggccgtgatgcccttaatgaatttaagtgcagagtacttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcgccggaccagatcaactgcatcattgagagctgtcggccaatagaacccttgacgaaaggccttgccaaccaaggtgcgcgaggcggaatgggctccgcactcgccttcatggatatcggcaagaagctcaacgccttgttcctgaggaatgcacttcaggaggattccattagccgcgcgccgatagagggtcccttctaccagcacgtagcgtttggaaatgcgttggacgcgttcactcccttcacggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcctcggggattgagacggtctctggagccggggtacactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtagagtagtaggggctcgtttggccccggggcgactagaactgggggagagctgagatatgtcttcaactgagtgagggcacgttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggcgcatccgctctatagctcgtatcttctcggggttggcctcgatgcctcgggcagagaccaagaacccgagaagcttgcccgcaggtacaccaaacacgcacttatcggggttcagttttatgcgggcggagcggagattttcaaaagtttcctctagatctaagagtaaagtctcttggttgcgcgtctttacaaccaagtcatcgacataagcctcaacattatgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaatgatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcgcgtcgcctcatgagtaggggccgcggccagaagctctcgcttcatggccttgaggctccggcgagagacgtgagcacacgctcccccatcgacagtggcaatggtggccccaggttcttggaaacctaggtcatcatcaccgtcatcgatgtcaacagcaggggccttctgtttggcctcacttcgccgtttaccggagggagttgccggcgacttgccctcacggcgttccttcctcctgtcctcctcccacttcctcgttcgctcagccaagtttttgaccgtgcgacagtccgcgagatcgtggagggaggtgttgtggacggagcaccacttgccgactgggcgctccctggtgggagtaccagcctctttctttttgtcgctcgcaggcctcccctttcgggtggcccgcggagcgccctcgacggcgaggacatgaccctcgtcgccggaatggaccgaccacttcttcctcctcctgtcacgccgccctgtctgagcggcggatccgggggcggccgaagctgccactccggaaccggaggggttccaggtccatgcttcctccttacgagccactcggtctgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacaaagaggcgccctccgttgcgcggggagtacgccggctattacgccggcgctcgatgtcgaggcgggcatccggctctccacgctgatcctcccgagtcggaggtgccgacgagggagtggcagccgaatggcgtgcaacagccgccgctcgccgcgccctccgtcttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgcgccctggggcgtgctgccgtcgccatagacgaggaggcgacgctccccatctcgccgttctcctccatcgcccgcgatcggtgaagccgcggatctgtcgaccctctcgagggcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacggaaaagtgcgagagctcagaaaacacacgctgagccccctacctggcgcgccagatgacggagctcgtggctcctcaccgggagaccgcgcaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatctgtgtatgaaggagctacaaagtgtgagccgacccctccctcgttctaggctctgaatctggaaaaaatcaacccccttccctatgggcagggtcctccttttatacttcaaggggataccacatgcacccctctctttccaaactggacttttcttctcttcataaatggacggagatttgcacggttgtcctccgaacatcctcctgacgggacggcacacacctacctccacttctgccggaggcaggcgcgtcgtgggaacgtggctgtctgccgacgacatgaccggtgttagaccggtcacaaatcggtcattcttgcccacca

SEQ ID NO: 32947 - DNA, 11292 bp, Oryza sativa
aactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagattggattcaaggaggacatccacacatacaagagtcagatgaggagcaagagagataccgaggcgaagattgcagatcttgagtacagggtatcgagctacgagctcagcatgcaagaggaggtggcccggaaggtggatgaacgcatggcagcatatcggtcacacgatccccagccgtacatacctcctccaatggtcagcccatcaggcaatcgtagcagctgcgcctcaatggggtaggtaggatcatatagcatggacgtcatgcaaacccaggacgaaaccacctgccccattgatgagatcacgcaacggacaccatgtgagctgcatattcccttcaagaacttatcaatcaaggtatgctcgatataatatatgatttttgacttgtacgttccgcaagttgctgcttaggttgattactaatagataacctctcatcacgtgaaggtggcatcggtaaaggacatcccaacggacatttcagggacttaccactgtaggccgattccagcaggatactcgagggtcgaagttgagctggtggaagccgtgtacgaggacctcgagttggactacttaggaggagatggtgagacgcatctacgagacacaagccacgtccggttcatcatcctccctgggcgacaagcggcgtctcgtgcaccatctcctctggctccgccgtctcctcctgcaccatctcctccagttccttcgccacgtcctcctgcaccatctcctccggctcctccgccacctcctcctgcaccatctcctccggctcctccgcctcctccgcctcctccacctccacctccaccgtgtccgcctgcacctcccaagacaaggtctcaccaagctccacctcctgccagcacaagggcaacgaagaaggccaaagttgacaccaccaaaaacaaggagccgccatacgattgtagtcaagaggagcttgacccttatgtggcaggagaagtgaagaggcaactcaagcctcggactcctgaaaagaagatacctattgacccgagcatgaagaatttcttcaagggaatatccaccacaaacaagaaggccttaaagctatcggactatgaccgaacacttaggaaagcctattacaagaagtctaaaccagttcctcagcttggagaacaaccaaaccaagtggtcgagccgttggtgaccggcgaagactttggcataatggatttcattttggacaccggtctaactgtggctcagttggttggaggcacaccaatcctgaaggcggaagtggcatacaagtttgaactcggtaaactgcttgtcaggcctgagcagctgcagtccctaccgacacaaatgtacaaattccatgaacgatacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttctgagcgcatggattttgtaagtatctttgagttcgatttgtttcgttcaataattagctcctagcatatatgtaagcaataataatttcctttcaaagggcccgacggcggggggtttacgatactgggttcattgaccctcggaaaatcaacaccgaaatgctcgacaagtacgagaaagacacagaggacaatctcgtccatctcctaacgcagcagcatttcaagacgttcatactattgccgtacaacacagagtgagtttttattgtcgttcgaacaaatttcattcccatacatataacatgtacattctgatatttatctcatctcacgcatattccagattccactgggtcctgttctctttcgacttggacgcatgcagagtcactgtgtacgactcaatgaataaagaggagaaaatgtgcacatgttctacattagatttattttttatatatttgaacaaacgttgttacacaataaattttgtgtattttcgtttgcagaggtacttgcttgggcgaaggaaaagagaccgagtgtaacgcatgcatggatgatcaaagaagttgattggggactaaaccaagaccttctccaagtctacttctatttcaccacgtcacttttggtccataaaagacgagagatcaagttttacacgttttggattcggattcgggcctcctgacagcatcaacttcaaatggacatagccgctgatctagaaggaatttcggggcccatgagtacttgttgaaaagcttatggaatctactttcagatggttttggtcccatgtcaaaatttccaccgagctgccgggaaactacaaaacaagtcatgtatctcatctggtctgaatctgatttgggttttaggccttgtaattgtgtctaaacgtgctgatgaagcctagagggggggtgaataggcagtccctgaaaacataaaaacaaatcgcagcggtaaaattcaaacagacccggaacttcctggtaaggaacaccagagcttccggtctgccaggcccagaacttccggtgttcagaacaaagaagaaattcaaatttcgaaacaggagactaagccaatcttcataagatgatgcacaggtattctaagcagaagatagatcacaaaatcatccacagaaacatcacagaaatagacaagagcgattttttaccgaagttcagatcttgcgatcctactctccgttgaggagctccaaagagctgggtctcaattaaccccttgcctcacttatgcaaaaacaccagaggaaatccacagccttcaaccccaaacacccctaggcaaatttctagaattgagtgactaccaagatccaactcaacctacttctagaaattcgccacaagtgtgggttgctctacttggaaaacctctagaatctcagcacaagaacttcattaacttacctcgttctctttcggaggagaggagatccttcacaaacttactcgggacatccacaatatataacggattctcgcgggcgacacctaaccgtctaggagatcatctccaagagtaacaagcaccgagatgacagcccacaagatattccaagtgctcacccaatatcctagtcttcacacctctccaaatcttcttctctccctctcaatctctctttctcacaagaattaggctcaagattgagtggagaaggcaataaacacttaggagaggctagcaacagctctaggttcgaaaagtgaaagtagaatagccaaagaatgagctgcaaacgagctggttatatataacggctaggtgacgtcatctagccgttactcacaattttgaacttgaaactagacaggaagttccggacctggaagacaggaacttctggaaaacagttaggaaaatctttttcaccagaccggaacttccggacctgaaagacaggaagttccagagttgcatttttggacagacggagtatttgcaaaaataactcctagggaaacttgtcacttggttcacactaagagtacttgacatatctcagagcaccacctggaacccctcttaatagtacggttttttctaaaactcgattgcaataaataaactatcctatgcactcctcaagttctggtccgctttgattttatacttttgggtggtctccaagcatccatcttccacactttggactaatgcacctgaaagtagctcaatgaactcattagtcccttaaccacatttgtcattaatcaccaaaacccactaggggggtaaatgtacttttagtgtcgtgggcttagcccaagggggtgtgcgccctaaggcaaccctaggacgtccctaatcatatttattcagtagccgtcatcgtttagagtcaggttttgcttagattaatctgtcaaaaacagtttcgccgctagatcggtttgtggaaccccaaattcgagtgcttaatatattttccttcacctaagcaagtacctctacaaacgaaaacacacaaaactcattgtgtagcaacgtttattcaaatatataacaagtaaatccaatgtagaatatatacacctttggttgattaatatataaggtagtcatgattatatccgagctagttatgtcctcatcaggcgctaccgagaggataagactgtgagagactagagagaaggaggaataggaagataagaagaggataagagtgtgtgagagagaggaggaggaataagagatggaaattaacttttaaggataagagcaaaggattatatacgtatattgatgtttagttccggttgggaacaacaaccgggactaaagttaggattttagtcccggttgatgttaccaaccaggagtaaagatctccggggatctgatagcctctaacacaaggtgaaccaggactaaagatagcatagtccccttacacttataaactgtgactaaaaatatttttatccccagtttttaatgaaccgggattattgtgtattttaggcaaccaacaaaaatgatttctccggtagtgatgctcactatgaaaattatgttttttaattttaattttgaaataacgaatataaattgatcaatatttctctgcatacacactagcagctaatagttttttttccatatgacctgtttttaaagccaggatagactttatagccagatgaacggatatgggttttgaagaaaaaagtggctcacaaaacacgccccttgtaacaggaaggttttgaatagattgatgctctatggtaggcaagaagaggagggaataaaataaaagaaaatatacgaggatgaactaagttcaaagatgacatagtactttattaaagaagcattcactgaggtattcggacgttgccttcactctctatctattttcaccatactattaaattgatgcctaagatataaaagtgaaaattaaatttgaaaatatacattttttttcaatattttgcgtttatatacctgcatagaaaatatttgcacaaatatacctctccgcacgatggggacgcaggaccgaaacggtgccgcgcttccattccatgggaccggcagtcctgcaggatggctgtgcgacaccgcctcactcccgcagcccaggagagcggtagcgtggtagagggcggctgcacgcgggaccgagcaggtcgcgtggcgccgtggcgcgggaccatgcttcccgtcccgtcccgcgcgtgcgcgtgtcgcggtcgacgcgagccatgcaaagcatcacctctcaagcacgcatgcacgcagttgatctagccaaaccccacaatatataggtactccctccggttttattttaattgacgttttgaacaatgacacagtctacaaaatatatgtttgaccttatttttctattataatatataaaattaataaatgcatgttaacttttactatatatgttttgaaagataaatctatatatattgttctagtttctttaaaccaaatatttttaaagttatttatggtcaaagttatataagtttgacatcaaccttgtccaaagcttattatagaaccggagggagtactagcttagcttactaattattccatcctgatctcctcagctccatccatccatcattgccaacttaattcttctaagagaaagtacaagctagctggttaatcatattgttaattttggcctcaattaggtctagaattaatcaaggcacagctagcggcgcagatgggcaggagcagggcggttgcgcggcaatgatgcgcgggaccgagccggtcacacagcgccgtgttgcaggaccgccctccagtgaggccatgcgaggcggtgccgcacggctgtcctgcgcgaccgccggtcccacggaatggaaaagcggcaccgcctccatcccgtatccccattacgcggaggaggtatatttgtgccaatattttttatgcatgtatataaacgcaaaatattgaaaaaaatatgtattttcaaatttaattcataaaagtgagttgcactccactttattgtgcattttagaaatgagtgagttcctccttttatagggcaattatgacggttatggatgtcggttcacccacaatcgccattctccatggacctccacgtgaaaagtggagatgagggggcctaaggtcggtttgaccaaatccctggttcgaccgacctgtgggtcttaccactctctactaggggtgaaaacggtatggaaactttccggattccagacctattttcgaaaacggaatctgtcggtcagaatttttttggaatttttcggaaaccaaaatgaattcggaaatattttctcgcaaatggaatcggaaattataagcgcagtttccatcggaactcggaatcggtcggaaactttccgaaaattttctcggaatttttggaaattgtctcggagttatcagaaattttgtgactgcaataccctggattctttttttaagcactaaatagcgaataccatagtgtttggctgttacctttttcaaaaatatttgttatgcaaatctaaaattacataagaatatttttttcctacattgggatttattaacaacattactcttttgaacatagataatttattcaattggatttatcagtttgagaggttttttattccgataaattttcgttaccgtattcgcgccggttcgttttagctccgttttttgtttcgataatattcgattctgttttcgtatccggtgtttccgattccgattctgattcccgaaaaaaaatatgaaaacaaaaacgataaagacggtttccgtccgtttccgtaccgttttcacccctactctctaccgtctttcaacccattaaatttgatattatattttgtgttcttttatgcaggagttagataactcccggatctaatgttttatcccaaattattctataatttatttatgattatataggtatatagccagctacaacgtaagaaacatgttagtattactactcaaatactccctccgtattttaatgtatgacgccgttgattttttaacaagcgtttgacctttcgtcttattcaaaaatttatgtaattatcatttattttattgtgacttaatttatcatcaaatgttctgtaagtatgacataagtatttttgtatttgcataaaagattaaataagacaaatggtcaaacgttgattaaaaagtcaacggcgtcatacattaaaatatacggagggagtataaaagaaaagaaaaaaacaagttagtactactacttaaatctctatctctactactcttattttaataccgaacgaaaaataccgggcgaaacaaaaagtccgatccagcaaagggaggaaaaaaaaccggaagaaaaaaatgtcccatccaaaaaaggagcgaaaaaaaccggcgaaaaaacaaatcagtccgatcaataaaatatggggcaaaaaaaaggaaaaaaaggaaacgaataggtaaaaaaagagcgaaacaaattaaaaaaactgtctgattccaaagaaaaggaaattaaatgtgacacggtaaaaaaatcgacaaggcgaaaaaagccaagcgaaaaaactgggccaaaaaatcaaaaaagtcggataaaaaaaggggcgaaaaaaaaatctgtccgataaaaaatagggaaaaaaaaggaaaaatcgaaatgaatccgactccgtcgccgcggtaaaaaaagggcgaaaaaaattgaaaaaaaaatatctcattccaaataaaaaggagttatatgtgacacggtaaaaaaatcgaatcctattatatctagaaaggtccgacactaataaagtggcgaaaaaaaccgttcgtaaaaaaatacacgagaaaaaaaataaagaagggcagaaaaaaacgcggtggaaaaaagtctaatttctattcattgttttagtagtccttttatatctcttctttatctctaatctaatctaatgtaactattaaaaaaagtttctaccatatattaaaaaggaaaaaaatgcgcgagaaaataaaaacggtttaaaaaacgcgtgaggaaaaaaatgtcagaaaaaagcgcaaaagaaaaacgcgttagaaaaaagttccgtagtcagtaaaaaaacgcgcgagaaaaaaatatttccatcttctgtaaaaaaaaaaagcatatgagaaaaaactgttagaaaaaaggttaagttgatgaacatttggtcggatagactccatcaatttttttccatctcctacacgacttttgtttcatcatctattctcctatgttggagaccctgcacatctttgtagacaattatcatattatttttgtgaagtatagctattattcttgataacatattatatggaaataatcttagaaaataaacatattttaattgttatttagagaaaagtgcacagtgactctattttgtgtggacttgatcatacgagtcagtgtaggatttgattggttgcaataatgagattaaaagaatattttagattatatgtatttcattggttgcaataataagattaaaataatattttagattatatgtatgttgtcacatgaataatccaattattttaaaacaaacatcgtaagcttgccatcatcgagattgggctattgcatttaagatattccaattttttgattttttgattgtcatatatggttatgcatgaaaaacgtatattatcattaagtttttttatccgttgcaacgcaagtaacagaaaagaaaagaaaaaatctcccgattcgtccctggtccacagccgcgaggccacacgaaattcgcggatatcaactccccgccccgccaccaccgcttccttttccaacgacttcttcttcttcctgctctaccttcttggcttttgcctctgttcctcttccaagatttgcgagatggtggcggtgacgccgggcaggcgccgccggcctgcaggatgcgccgcggggcaccaccaccagcaccagcagcagaggctgctggccgtcgccgcccgcctcgccgcggcgaagccggcggccactacggaggccgccgtgtacggtggcgtaggaggaggaggatgctgcctcgagttcctcgactgcgtgctccgggcgatgggcgtcgccaccccggccgagatcatgccccccgcggacttcaggtgggccgcgcgcccgatgcggcggcgccgccgcgggggctcctcgtcctcctcctcctcgccgcgcgaccgcgagccgagggacggccggatcgccgccaacggcgcctccgctgccgcctcgctctacacgatgcggggcaacaagggcgtcaaccaggacgccatgcttgtctgggaggtaattatttctttcatcccccattaatccccaatttatttctttcatcccccattaatccccaataacttcttttccatgtgttttctgtgatgtgaatttttttttttactttctttgagatgatgtgtgatgtgaaatttgttcgtacccccggcgaaagagaaacgtgttaattcgtgattgattgattgatgattgaacgtttacatgaaagccccgaactgtctgatatatctgcgatttttttttaatatatgttgttcttgtgtatgcttgagctggcctacacagattgatttttttttcaactttgacataggacatacatgtgtcgtcttggtgtagaatgcatgtttgattcccctacttcttgatattagaataccactttgttctgtctccatatggattgccattggatattgctggtggagactgtttcagatagtaatataatacaacctaattattattctccctatgtagaaaatttgttagcaggggaggtgctccacacgattctcatccttatcctttcttctttttatggatgatcttattcttatctgtttacacattgagtttagctcttgggccatccttttgctgtgtaattaatgtttgcttatcgttctgccccataacacctagtattatccttttgttgtgaggatcctctaccataatgttactaccattacagtcactagtatgtggatcctaccctcccattgcaccacacgtcggtgcctataatgatagtaccattattgtagaggatgtgaacccaccgagccttattgtctccacagtttgctgaagtaccacctggcatgccatgtagcatacaactattgtttttgtgagccagctagtagaatgatagctcctttcatgtacttttgcaatggcaacatatttgctgccctaccaatttctttattgtgataatggtttctgatttttccatatttacatctagtaaccatggaaaaaaatactataaaagccaaataataaattgaaagtacaatttttttgtgatctggtttgttgaaatttttggagatctccatgggaatgcaccatctgatgttcctttctatgaagcctttgtaatattaaaaccatgaatgatattcctttcagctataaattacataaatttatcaattcctacctgataatagtctgtaatcatatgaattatccacttccagttttcctgttctaccattccatttttaggcaccgcaaagttgattttgatggtgttttttgtttgacttccagaatttctgttcaaaggaagatacaattttttgtggtgtttttgatggccatggaccatatggccatttggtgtccaagagggtcagagatctcctccctataaagttgagtgcaaatttaggaagagatggacacaaagaaacttcaactaacattgtcacaagcagcatgactgaaggtggtggcaccgaacgcatggatagagatactgaaactcccctgggaacggaggagaatggagactaccccgagatgtttgctgcattaagaacttcattattaagggcattttatgtaatggacagggatcttaagtttcataaaaccattgactctgtgttcagtggtactacagcagtcacagtgatcaagcaggtaaaaatgtgtcaaa

SEQ ID NO: 32948 - DNA, 7361 bp, Oryza sativa
tttttttcctccagtacaattgaaatcgtgggtactgctgattattttgatacaaagaattctagaagcactattgttctgtaacaagttctggtacagagttattgtagtgcgtcaaacacttaaaatagatttatacaccattataactatatatgtttttcatgaaactacttgatataagatgaacatgtggaaatgatattctgaacaagttagaatgtcgggctagtttttttgttaagctggttagagtttgaggtggctgaggtttgcagtcatcctatctgtgctagagtaaaaacttccttgttagaaggtttaggatactgcaaaattacataggaaaaatctctagcttattccctcaaatgtaaggaaaagtttaatatttcagtgcttctacactagatgcatttgtaaattgctgaactgaaaaccaaaaattggtgagccagctgaaatgatttcacaatgtgtcaatataaaatgcatctttcattagtttatttagtttcacagtgcaataagtttatttatctgggatgtgatagttcatagttgtctgtcccacgcctttgatttactgatacctgttgtctgttcgaaactgtgatttattttttctttggaggtatggcaattggcaagatgaaagaaaccttttgatattgcagtaaaaagtatttttatatggtacatgcttcatttatatacctgttattttgtgtgtggaaactcaacatgatttgcactgccattttcctctttcagaatgtcagggctttaacaatttgatgcatccgaagaatttggttcttaaatactgttttaacacttttgggaactaaatattcaaaattcaaattggaaataataaagatcttacaagtaaacctcttttaacattgaaaccacaaggtgacaaatttgatctgccacgtcacatctggtctacaaggactggcttgattagagaatgacagatttttgcatcatgcagcaagtttggcattctatttacatagtgtatcccagtatgatataaaagttcagttcaacatcactccctgaagaactttgtgaactaattagtacagtgcacatgtgttgagcaaaaatagtaatgcaatgtcacaaaaggagagactatgtatgttgatttaaatgaggatagctgagtagaaccttgaacccaggcaaatcagattgacctgaccggatttcacatggcataggaagttgaacatttacctggccaaacttcgcgctaaatataaaaaggacatgcagaaaggttcaaaccaacacctacaggttaacatagacacgaatgtaccaaatgagataacagctctattgttttaaactattaacatcctgcataggatttagttatgttttttttaccgttcaaacccaacatgctggtattttcctgttcaatataatgtggtctgactggtgacccaaggtcaagtaggtgtgactgggtgctttggatctgataacattgccatgcctgccggcgttcggtaactatcatcgaaaagcgtttttaaaggaaattattgggacttcgaaaaaataattgtagttttctacaaataattgttgatataatgaaaatcattagtctttttttctgaaatgatcaattccgatatttttcctgcatagctgagattgttggcacacttcagtatctgttgtaaaggcttgtttctgtgaattattttaaaataataataataatgatagtttatgtttgataagtaatatcaagattttgtgtctacattactaaatggcatgcatgactacaaatgtacacatcggatagttgtttcctgcttttactcccctaaatgaagcaaaacatgttttcaggtgaagctgcacgaattagggaacgaagtggcagaatattctctctgccagatgagccagatgttgctcgtgtttggcttccgaagtacaacatgccagggttggccatggcaagagcatttggagacttttgtctaaaggattatggtctaatttctatgcctgatgtttcctaccaccgcatcactgaaaaggatgaatttgttgtgttggcaactgatggggtgagccattgagcacaaattttacttgaacatatatcttgcttgttcacagaagtaaattttacttttggttggaagattatttttgatatatgattgttttgtttcttttattaactgtaggtgtgggatgtactttccaactcagaagttgttagcattgtcagccaagccaagtcagaagcctcagcggcacgatttgttgttgaatcggctcaacgtgcatggagaacacggttccccacatcaaaaattgatgactgcgctgttgtctgcctgttcttgaatacagatgctagaaataaaccccccggttcaggaatcaaagatttggccaatgccatagaactgggtggtggtaatctttcttgaccatcaaatcaagcactagggctcttaccgatctcgttactgcattggtaacaggtgatgagtggcctgtccttgatggtgtctcgaaaaatctgcgatagcctacttaagttgcaagggaaagcataaaatccgtacttgtctatggattaggataaccattttgcccaagatttgtgcagcttattatacttgcaatgattcttctgcatgggaagacggagccagtttactttgcttgttggggagtggttgcttggtttattctgcactgcaattagtggttctaggacctctgtttcagttattctgtaaagtatcaaatcagcttagtgcaagtctaaagaaattcagtctagtgctgtggtattattacattttgttcataataatagcgaagatttatatgtcaagtatcatttttgttctattatttctgtttcagattaagtttctatggaactgtaggctttgttaaactttttgtccaagtctttttatcatattattgtggtttttgacaaaagagccagaagaatgtttaagaaaccgtccaacttacggtaccttatcaatggaaaacgacactgtgccatttggtcttgcatgtgatttctgaacatatatatcttgttgcattcatcatgaatctcaggatggtgatggctatggctgtagcaatgtgtatgttctgaaaggagaacaggattatatgattatgtgccccaaaagaaattggaacagaggaaaatagaaaatgtaacaaagggatgagacttctctaactttgtgcagtttggagttgtgccactaatatgtgggccatatcaaagtagggtctacatgtcagtggtataactgtagactacacaaagtcaggggatctgtttccttaacaaagagaggggaaagcacaaaaactgtgtattttaatttcataccttagtctctatttccatgatgagaacccttcgatgatctcttcttggatccggtgataacatcctcctaagtagcatcgtcttgctggagactctactaattggatgctatttgttaaataaaaaaacaaaataatcttagacatactaacactgcattttcttatttttatagaagaaaatattgttgtttttatgtatttgtcatagcttatttttataaaaacatatggaagagttattttttaaggcaaatctacttaatatgatttttcacattttaaatcctggtatttttacatcaacagaagttttaaaactacgaggatcgactgcaaatattttacgatgtcaacaacggagttactattaaatattaaaattaaatggtgcacctaagtacacttaatttatttctcacgtgctacatgaaaataatttttttagtgggatgggatccgatcagatcaatcattgacccacacctaacccggcaacccctccatggttttttggcacccaaaatccatccatccaaaggccaagccttaactgcagtacccctccttgcccccaccgattataaatgtaaagcacggttaaacttaacatgatctccaaaagtgttttcttattattaatttctcgtatagcaacaaaatcatttttttaagataatgatagcaacaaaatcatagccatagaaaaatacattcctccccgaaaaaaaaaacattccagtgttaatcaataataacattattttcatcaaaataaaattaagtaaattgctggctaggccagattttttttaatcgaagtctttgtctgaaaaaccatctatccaatgtttatttttctctaaggtggtgtttgaatctcctgaagatgaagataaagataaaaattaagtgtttcacgtaaaacgatgtgataataacgtgtggttaattgagttgagttttaattattacaaacttgaaaatgaattaatatgatattttagagcaactttcatatagaaagttttcgcacggcatagtttagcagtttgaaaaacgtgccacgagtatccaaaatttcatctaagcccgagtttagttctaaattttttcttcacacttccaacttttccgtcacatcaaaactttcctacacacacaaacttccaacttttccgtcacatcgttccaatttcaaccaaacttccaattttaacgtgaactaagcacaccctaactcttgttggagtatccaagacagcctaactctgatgagttgggatcctctcctgtaatgcatgtgcggtaagtgccaatgacatatgggcccggaataggtgggacccacatgccagtgacacgtactgcaggtgcagtacagcggtggatttgcatccaactctgattccccatcaccaccacaccatcaacatcggctttggcccttccctttacctagagcttaagctctaccattgctccacaaggacactttcagctactacttctccttagctcgatcggggctaccttgctcctctcttaatgcctttgcttgatctactggcattaaacgggacatgaacaacacattacctgtgccggaaaagatgagctcagcccccatctctcccaagcttcttccttctaatccttgctgacatgcggacaaccggtccaaaatacaaacggtaggtaaatattcctaactttaattaaaaacatgaaatagagagtgatcatactccactataaaaacttcgataaaaataattagctcaacttacaatttactcgtcgaaattaaatcctctctaccacagctccagacaaccagccagccacacagactttgcattgggcgtggacctccatggctccgtatcatctactcaaaatcagagccagtttaatagtatagctaactactagctccaaatcatgaacaatcaatttaatagccccacactgcgacgcaactcttgtctctactgttttatctcctcgacatatgtttatatctggcttataatttgttattatagctgctctcaggggacagtactgcatataggggttaaaacggggtggcgcctgccagtccagcctaggggtgaaaacagtatggaaatttcccgaccgtatcgataccgttttcgcaaaactaatataataatattatttttaccgatgttaccgttttcaaaattttgttttttttatttctgtcagcatggtatcgaagttggcactaaatagatgaattcatcgtaaatatggaaattccccgaccgtttctgctcgttttcgaaaaaaataataaaataatataccgattctaacccgttttcatccctagtccggccacattatttggagacaaactcagtgccgatgtcagcgggatactccagtgggccccaccccctcacctgacacgtgcggctccactgttcgctggcgccaatgttttatactccagttttaacaccccccaccaacctccaacaaagagaaaacaaggacccatcgtcgcctcgcctaatcatcatcctttccgatgcctcgcaccgccgccgccgccgccgccgcgccgccgccgctgctgctgctctccgccgcagccgccatcgccatcgccatcgccgtcgccgtcgcggcccccgacggccacctagtcgccagcctcccgggcttccatggcgccttcccctccaagcactactccgggtgcgtctcgtgtcgcgcgccgccgctcttctcttctcttatcatctgaccgacgacgcgccgtggtgttcgtcgcaggtacgtgacggtggacgaggggagcgggaggcggctgttctactacctggtgacgtcggagcgcgacgcggcggccgaccccgtcgtgctctggctcaacggcggcccgggatgctccagcctcgacggcttcgtctacgagaacggtgcgctccaatctccttgttcaccatcgatttaatcgccattgattaggattcaagtgctccattccattccatccaatccattggattaatttgcatattcagcgcaggccccttcaatttcgagcgtggcagcgatccgggtggcctcccaaatctggagctcaacccctacagctggtccaaggtgatagctctgcactgctctgctccttaatctctgtttctgaaacctcttctccgtaatccccgggggattaggtgtgcacctttgtggtctttgtgctaatttttagtaccttttactctttacaaagataaaacaactagtagtaactgatctagtttcttcagatgctttgttccgctatttgtgtcacaattagttgtcacgtagcaggggtgtttatttttgcatatttcataggatgtctcatgtgtctggttgttgtcactgagctttggtgtgctaagcttaagaaaagaagaaattaggtagctgagagcatcaccgacagaatgtgtatagtcctgagaaaactcctctctccaaaagaaagcctaaatttaattgagtgaagtattccaaaaactaaaaaactaagagtgggctcttatgttaaactaccaaccgaagtatttatttttgcacagaccccgcacaccaaaaaaaaaagatcgctcctacacgtgcgcgatctccctcctcgcgcacaaagagaaaacctcgcgggaaagagagattagggttggaggtgcggtgtcgctctccctcaaatgaagagagcgaaggatgcggggatggggtttccaacaaattaggatcaggataggttatctgttagaggcattttttttaccaaaacccaaaaaattaggattagggatagaataagggcattgttgatgatgctattggcattgttgatgatgctattggaggttgattttcaacgcattaagtattactccctccgt

SEQ ID NO: 32949 - DNA, 6256 bp, Oryza sativa
  unsure (1)..(6256): unsure at all n locations
ggacacatcatagtacgtccagattcgttgtactaggatgtgtcccatcctagtatgaggttgggtttttttggacggagggagtaactattataaacttaaaaaatgatttatttgatatttttaactaacttctatatataatcttttttttgcaaaaagcgcaccatttaacagtttgaaaaccgttttaacagaaaatgagatggagttgaagaaaagagcagtacctaagtcactcttaacgttctatcaactcttttttggctcaaaaaatatctatacaacatcaagtgagtgattaaatatggcactaaataggtttccaacgtggtgtacctcgactcccctgctggtgttgggatgtcgtactcgttgaataaatcagattacacgacaggtgacctaaaaacagcggctgatgcacacaccttccttctgaaggtacctactccctactgtggttgcaataatatcaatatcacttcggaaaatttttatgttgattctatgcattgttgcagtggtttgagttataccctgagttccagtcaaatccgttctacatgtcgggagagtcatttgcagggatctacattccaacactagctgatgaagttgtaaaaggttgagtttgtcagtaaaaaatatatatagaaactattattatcaaaagtttcctacttatgttgtttatgtcctgacagggatagaaaaggatctgaagccaagaatcaattttaaggtcctcccattttcatttgtcgggagatgacgtcatacaacaactctacatgcatgcgaaaattgtctttgggctcacaatttaaaggttatttttcagggatatctaattggcaatggagcaactgatcaggactatgatttcaattcgtttgtgccgtttgcacatgggatgggtctcatctcaaccgaattgtttgaggtcaagaaatcaatgcctccgctcttgtgctctttcacctcaaaacagtaaaagaatctgtctaaatacttctgtctaaaagaatatgttaaacgagggttgtgctcactggtaatgtcagaggagatagacaacacagaaaaaaatctgatgaaagttaacaaagctaaaaaatgatttgagttgctttcttgcaggatgcaagtactgcatgccatggtacattttggggcaaagttaataatctgtgccaagaaaagatagacagagtgcattgggtaacttccctgtgccagcacatgtaaacaaaacaatgtagcacaatcctacaaatttggtaaacgctccattactggcaactgcaggaactcaaggacctgaacaagtacaacatccttgctccctgctaccatcaccctgaaattcaagaattagagttcaagaacagcagcttgccatcaagttttagaaagctaggtgagacagagaagcgatttccagtgagaaagcgaatggctggccgctcttggcctctccgtgctcctgtgactcgtggacgcatgacgatgtggcctgaacttggtggtagatcactcccctgcacggtgtgtaaattggagtggtagtttaatatgtctcaaatttcatcattttgattttgtagatcaaacatttagctgtgtttcgttccaaattattagaattcgggtgcctaatttcgtcaacagataaaacattttgtttcatgtgtttaacaaatcaacatttccatgtacttgtagagcgacgaacttgctaatgcatggctggatgatgaagatgtaagagctgccattcacgcggaaccggtatgatagacgaggaaccaaaggtttcattttgaatttatcttaaaatttacacctcactttcttctctttgtggggaactaccttgttaaaatggcacatcagaaaagcttaattgggtcatgggaactgtatactgcaagaatagagtactaccatgatactggagacagcatggtgaagtaccacaagaagttcacagccatgggatatcgcgcacttatttacaggtatgcaacagaccattaagattgtaatttgaaaattgagtgatttaaagtgctaaattcctataaaaaaagctacacattaaattaaattaaattcctattaataaccttggtgcagaatgccagaatttttagctacaaataacaaatagtactacaattattgctcatttggattgaaaataattggagtaccaagttgggttgtttggaatccaacttatatgggttagggattatcaacggtttctgaaccttgcttcagcctaagaggcccagggtttcctaaaccgctcgggccggggttaccgcgctccgacggtaagtaaggttaccgcgcggtaaccgtgaaaaaccgtacaaaaccgtgcaaaatttatcaaaaattcaaattattttttaaatttatttgaatttaaggaggttaccgcggtatttatattaccgtaccccgcggtaagcccaataaccgcggtaaccgcgcggttaccgtcggtttgggaaaccctgaagaggcctaaaattcaaatttgtgcttgtctttgaaaaaaataaaatgagaaccaactactgatcattctgttttttgtagtggagatcatgatctctgtattccctatgtcggaacggaagcatgggttagatccatgggataccgagtaattgatcattggcgaccatggtactttggagggcaagtcgctgggtatgttctcatcctttcttcataggaatcatcagttcttcatataccttttcaggagttatgtcacatctagatattagctcagttcagcttaactcatacttttctacctagaattttagaagtatatgtgcagattgtagataagacttctgtttacatttttttacttgaggaagcaagaaattaagagagaatgtcttgacaagttttcctcactagagcgatattgccattgcagatatacacaaggttatgaacacaatctcactttcctcaccataaaggtaagtgaccagatttcttttccagtagataagctgcatgttctgtaccaaaaggatgttgctcactcaacatgtgtttttttttttttctttagcaaacactggacggttttcagtcatgcattagcaagttcaggctaaaccacaactgtctaaacaaacaatccattggaatgaacacatctattttcgcttgtggttagcttttgaagctgtactatttgatgatgttaacaacatgtgccgacgtttcagggagctggacacactgtcccggagtacaagcccaaggagacgcttgcgttctatagccactggttgtccgggaagaagatttgacatcaagatcaactcgtcgtaacagttttgagcctccgaatgaaaaaaaaaagttgtaatctgtaatctcaacaggcagacaagtgcatttgtccgtaatctgcatctagggatgtgagcagtcccagtactacccccataaaaaccttcctgataatttatttgctacatgtgatagcataaaattcaattgcccgatccatttacattcctgcatgcaccgttgtcgcattgaagatggtaatattgtcccacagaaactacaccgtattttaggaaacacattacatttcagagcactgacagaacctaacatagcacccgtttgtcgagagaacggaacggagctataagacgcaactgacagaaatacacaactgaggctgcagcattgccatctgcacaagatacgtccgccaacataaatattatacattctggaggtcaacattctacccaggaaacaaaacattacatcaatgaggatacaactaatgaatcaacttgggtttcccctagatggcaagagtctttacagttcatttcatcaactatggagttcaccaaagtccgaccgccctttcagctaactgcagtacgctactacggaaacaaagtgtcgtaatgatctagagaaacagctaggagcgcttctgcttacagccaagcacaccatgcccctcaaaaagggcgcgcattcaggaagcagccaggcctggcgaagcaccgttagatttacctgaacttcggcttctttgagggtcctcccttgaagctgctgcgctccggtggtggacgggacttgctgaaggtcttcaccttgcgccgcctcctctcttcttcgctgtccgactccgcaccattctccctgtctgcattgcttgcctcccgttccagctcctcccaggtcttacccttctcttcctcagagtcttcttcagaatcgtcctcatcatcctcatctgattccaccaaggactcgctgtcagaatcttcatcttctgattcagactcaggctcagcatcagaaggctcgtagccctgatcagattcctctgtttcctctgtttctgaatcacttgcttccatattcaagaattcccagccaccgtcatcaatgaatttctgaggatcatcgatgatagttttcagaataggacgccagttaaggttcagcctgctctcatagtacttgaggtcagtcgtgtcaagccactcctttattgcatcaagtgatgttgatggtatggaatcaatgcgaagaacatccttcttgaaatccttgaacacgatagccatgtcaaagttctttgtcccaaagcccaccctctccaaattaacaatctctatctcactcagggtcaccaccaggaagggtgtctctattagttcaaccaaacaagtcgaagttggaatgatgaaagctgaagctttatatggaacaccatggaatccaagctctctaagagggacatcaaactcaagatccagccccttgaattgtggctgcgaccagtgatcattaaccttgttcacaaagttctggaaatccatgtttattctattctttcggtccctctcacgctgctcttcttcaatttcatcaggatcaagagctgatctcctattcccaccaagagtctgaacaacatccatcacctcaacataaaattgaacatcctttgtcttcttgtttccaaccataatatgattgtgcaaatggaaatgaaggagtgtaatcatttctttttctgctggctggaagaaggcatgctttacattcccatacatgatatccacacgctcatcagcccttgaagtagaatatctaaaaccattgacatgggactcaagagttcctgtaagcttccgcccacgtccaccaaatgcaggccttatccacacatcagaaagtctcactggcttgtttctgttgcttgtcaactggagtttctcctgagtaacaagggtggctctttcagctctctctgactcccttgaagcaacttgccgcctcaacgttttgatttgctgaacaacttcactgctatgtcgtggatctttcgagcggaacgtgatctccttcaagtagatagccccttgcgacttcagattgctatcgtttgagaatggcatgccaggcacattgaagaagatgcggatagtgcaagtgcggttgtcttggtgacttgtgacactcttaacagtagaaacatggaaaggaaccatgctgccataaataggtaagaggacagcttcattcttctgatctacttgtatgaccaactctcttgcatatggaacatcattaacattcttatatgcaacaagctcatttgatgaccttgagggaccacgcccatcaccagaaccagagccaaccccagcaagccttctagcagtctcttcattcttttgacgagcaagttcagcctggtgttgtctccggagctcttccttggacatctcctggttgtctgacctaagtgtggcctttgttggtggcaatgcctcctttgcattaacctccacctttttgacaggaagaacttcatcctcgtcattaaacgaataagcaacatccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32950 - DNA, 693 bp, Oryza sativa
gatgcgcgtcgttcgggaacacattccgccaccgatgtcgccgcctcccaaccaccagagccctggtgcccctcctccccctccttctcgtttgctcggctggaagagaggaggaagacgacgggaggaagaagaaggaaaggaaaaagaaaaagaaaggctgacaggtgggcccatgaacagtgcactttcatcttttctagatttaattcaaaacctaatctttagaaacccatatctcctaaaccatagatccaattccgatgaaacttagacctaaattcatctaaattcaaaatctaccttttggtaccaaatttactattctaatattttatttgaattttcttaatttattcaaatactatttgaataaatatttgatttaaacctatatttgcttttcaaatattttattttatcccaattacccttttagccactaaaaagccgccggttggaactttgcgccttccatggggacgttcacggttttctatccccgacgtcgaaccgttggttgtaaagcccggcataaaccaaacccaaggtcgaagtgctgctcctggcaccccacgcctcgatgcgtatagcggtcggagcttcactattccatcgacctccacagcacgccgcacagttagctctcgggctctgtgtaatcctagccgctccgtcgccactcacggttat

SEQ ID NO: 32951 - DNA, 763 bp, Oryza sativa
agtggatcccccacatatgtatatctagatcaatgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgct

SEQ ID NO: 32952 - DNA, 769 bp, Oryza sativa
gggcggccgctctccactagtggatcccccgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaattgttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaatcttcattggcatcccaacctttcttatcacttggcaaactatctgcattggcatcccatcatttctcatcactcg

SEQ ID NO: 32953 - DNA, 353 bp, Oryza sativa
  unsure (1)..(353): unsure at all n locations
actagtggatcccccttcgccacttttaagatgaggtaattaagaatttaccacccatagtctatgacaacatatgggtctttatcactttatgtgtctatgacatgtgagtccaattgcaaattgtcactcgtaagagtggtaaatagttaattgtttctgatgatcgttttccggcatctctccaaacttaccaattcttggcttcgatcccaggtcaagatggctgaagacatggtcgcgagggccgcgatgtcgtgtggcctgggccagctcgggctggcgccattgctcagctccaggaagatgtgcnnnnnnnnnnnnnnnnnnnnnnnnnnnnnnnnnnnnnnnnn

SEQ ID NO: 32954 - DNA, 801 bp, Oryza sativa
gggcggccgctctccactagtggatccccccgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagggcgctccgcgggccacccgaaaggggaggcctgcgagcgacaaaaagaaagaggctggtactcccaaccgggagcgcccagccagcaagtggtgctccgtccacaacacctccctccacgatctcgcggactgtcgtgcagtcaaaaatttggctgagcgaacgaggaagtgggaggaggacaggaggcaggaacgccgtgagggcaagtccgcggcagttccctccggtagacggcgaagtgaggccagacagaaggcccccgccgttgaccccgatgacggtgatgatgacctaggtttccaagaacctggggccaccattgccactgtcgacgggggagcgtgtgctcacgtttctcgccggagcttcaggctatgaagcgagagcttctagccgcggcccctactcatgaggcgacgc

SEQ ID NO: 32955 - DNA, 8647 bp, Oryza sativa
gctgcatatggctgtatatatccggttacatgtatatgctgggtaaaaaaatactcttccgaaaatataaattcatcagttcttacttcgagtatgtacactgaatcatgtcaattaatttgaggtctatctttgttgtaaaaagcaactatgcagcgcagcaacaaaatgtgcaactagctagtacacggcagagttgcacaaagcagctggagtagactgcgacttctttcccgccggtgccgttggagctttaaatttcgaaattctttcccgggggaccgaaattaccaaaattttggaaatgttgaattttttttagctgaaattatttgaaattttctgtcttaatgaattttaattaaatttgaccaaaatcagaaaaatttacaaaaaaaaaaaaaccgaaaatttcgggcgagatgtgagctttccggtaggggacaaaattaccgaaatttcaaaacgaaattgcaaaccctgcccttaagtcgacattctcattggcggagtggtgaaaccacggaactttgtaaactatcagaagaaaactgacagatttcgtggcgtcactgcagcacaacaattcctgggacctcccagtccaaacatagatatatagaatgtatggtaggatggatgcaatgaccgagtgaatcataagtggaaatgcttcacttccaacaaatatatactccctccgtttcaaaatatttgacactgttaactttttagcatatatttgaccgttcgttttatttaaaaaaaattgtgaaatatataaaactatatgtgtacatgaaaatatatttaacaatgaattaaatgatataaaaagaataaataattatttaaattttttgaataagacaaatcgttaaatacgtactcaaaagttaactttgtcaaacattttgaaacggactgagtagaagctagcaacatgcatagcatatctcagccattaataatctctggctgccttaaaactatagccaattcttttcgtagctagaaaccatccacttaaaacgtactagagtacacatgtggtaacacaagttgttgtcttataactttttgccccattgaagcacacttgtgataaaatgaagggaaaagagtgtatcagtgttgtttaattagagaagtgtgtgtttgtttatctgcctcttaattagttttcccagggaaaatcattacaatgcaagcagcaaaaaaatcacgtcatgcaggggagggcccacgattttgaggttgcgtataagcgtactcaaagtagaaaggggtaaaagaaatttatctttgacagtttgtatgttgtttcacgaatcacagaattaggccataaaagttgtgtgaattggaccctcataggagaggaagccaagcctagaaagacaggtttatttactaattatatatatttttaacttttttataaacatacatataacaaaaaaaattgggtctccatttgaatacccgtgaatctaattgggccgctctgagcaccgtgaatggaattactaaacaaaatggaattaataaggctgcgttcttttgcaatggttcccaactccatcctcttttccgcgtgcacgcttttcaattatatggtttgttttctacaaaaaaaattctattggaaagttgcttttaaaaatcatattaattcacttttcaagttagttttagctaatacttaattttttttacggttaaacagcaggagaggctcctactacgctatattaaaaaaggggggaaattatgtacaagagctaatacttaattaatcatgtgctaatgtgcttttccattttctatgctggaagggaaggttcccaatcagcacaaacgaacacaacctaaatggctgttgattgagaattgtgggatttgtgtcacaatcaaaccttgggatttgtgtcacaatttgtgctccgacaatcccaactcgttctcctctagctctagagaatcttcggcacccggcgccggcatgttgagttagggtttaggatcccgggttggggtggaggtaggaatggaggcaagggagagggaagaggcttagagggatggttgtgagaggcagcgttcctataggcggtgagcagctagagccatggggatggagcaaggcgactggccagcaatggtgcgtggcggggaaaaaccagagctttgtggttaggacataggaaagatggtgggatgtgccgtagagcaaaaaagggaactggtgattgatccgggcgacccttggttccaaatatataatgtgtattttctctaaaacataagggaacaagggtaggatggctagagctaaccactctcaacgcatagatcccggtttgagtccccatgccacaagccttttctatgatttttgtaaaccaaaatcagtagtacggggctaaaggcaatggaatgggccttaatttggcccatttatctcctctgcctggttcgaccaaaggggtttaatgcccggtccgaccaaggtgttttaatgccgggtccgaccaagacggtttaatgctccgtttagtctaaaccttattgcacggtttagtctaaactcggctggttcaatctgggtcgaatgcatgtctgatctttaagcgtaaccgaactatggaaacttctggttccgtacttttccaatcgaactgacgacccggtctgtttttttcaactatgggacaggggcactcaccatcgctggataagaaaagagaaaggggaggggagggggggactatgggatggggacacttgccgctgctggatagggaaagagaagggggagtgggagcgaggccggtcaggataggtagcccggtccggttttttccactatcagacgggggcacttgctgccgttggatagggaaagagaagggggaggggagggaggccggtcaggagggcctcctcatcagcttccaacgagacaacgaggttgggcggcaccgctggagatgctcgccttccgtcgccgtcgccgccacacacagctgctggagccgccgcgtgccgccgcccgaggaccagaactgccaccggagccaccgccggaacaactgccgccatccagggagggaggaggagagggtgctgtctggtggatctggagggaggaggaggaacgagaggataaggatgggtagatggataaggagtgatgggtggcgattttttaatgggctatgatatttttaagtgcgcatgatttttttgacgggctctacggtaggttaagaggcctgccagctaaattaggcttatttttgcaagcggattttttaacctaccaccagcaaaaacggattttcgctggcggttctaaactcaccgccagcggaaaaaaatagggtaccgtcatgaaaaatcatttttcttgtagtgatgtaatttaatcaaacttagaagtatatgtatatatgataaatgtaacttacatatataataaaagtaatttacaacatatatatttcttttcatcagaatatattcatgtaagatcttgttataaagatttaattacaaagaataaaatggtataatcggactgtagatgggatatgtaatttgaaagaaaaagtatatttgaagtttaactattaaactatatttccttgctgttgcatgcttgtatacttaccacataggaagagatactagttatgaaaatagttgggtctctggtttaggctatcaagagaccaaaagcagtacagttgccacccgaaactgctaatgtacgggtgatcacccgcactcccctccccctgtactcctccctcttccccccttcctcctcccctttctctttcaactacagtacaccacaaaatttttttaaaaaaacaaaagttagaaaaatttatgtatagaaatactatatataaaaaaattgaattcaaattcaaatttgaatcgggtatgtaaacttttgacttataaactttggatctataaattttacatgtatagaaatactatatatagaaaatatttgaattcaaattcaaaattgaatcagatataattcaaattcaaatttgaattgggtatgtaaacttttgacttataaactttaggtatataaactttacatgtatagaaatactatatatagaaaatatttgaattcaaattcaaatttgaatcagatataattcaaattgaaatttgaattgggtatgtaaacttttgacttataaactttaggtctataaactttaggtgtataaactttagatgtatagaaatactatatatagaaaatatttgaattcaaattcaaatttgaatcaaatataattcaaattcaaatttgaaacgggtatataaactctaggtgtataactttagatgtatagaaatactatatataaaaaatatttgaattcaaattcaaatttgaatcgacttttggtctctaaactttagatgtgtaaacttgaggtgtataaactttagttgcataaatttaccaaaataagaaagtaatacggtgccagaaaaggaaaccaagtggagggggtgaatctgagagtcttttagccctatgccattaagaaagttggaggttacgcgtgtgccacaaaaaagttttgagtcacctgtatgccatgacacaaactttcgtttacccgtgtgccattccatccaccttctgttagagaatgagctctgacatgtgggatccacgtatgaaaatgactaaattgcccctgaagcattttcatctcactactcctctcacgtgcaatttctccagtgccctagcctagcacgccgccgccgccggtcgtcgccgtcgctggcacgccgccactgccacctcgcctcgccggcacgccgccgccaccgccagtcgtcgccgtcgccgccgccgcctcgcctcgtctatccaccgccgccgccgccgccggtcgtcgccgtcgtcgacacgccgcctcgcctcaccgtcaccggcacgccacctcgcctcgccgtcaccggcacgccgccgccgctgcctcgtcttgtctatccggcagcgtgcctctagtcgccgctgccgccaccgccggtcgtcgccgccgccgccgatttctcttccaaatgttccatccaaagtggctgaaatagagcaagggcaaaatagatctttcaaacctccgttagtctccgttagtgctgattccatccaaagtggcgcacaagtaaaagaaagtttgtgtcatgacaagtgactcaaaacttttttgtggcacacacgtaacctccaactttcttaatggcatagggataaaagactctgaatctgatcgctaccccatcgccaggacgatcgatcatccattagaagcccccgttggccctttaaataaaacgaacccacaagaaaaaaaacacaaaagtacatatgttctattttgcaaaaaaaaaaggataaaattgagacgctgagcaacaatagtggccccaggtgacagaccagagcagcagcccaacgtctgacattaatcgcggggtcgcaggccgcagcacccaacaaaccacgaggacgcttgcctgaccctctcggggactcctaatgggcgcgtgtgcgctggctgtccagctcgcgcagccgcgcacctcttctactggttatgttgattagttttaatgatatttattaatgctaatgataattatagtattagttttttaaaaaaaatacataaacaaatctttcaactcggacttgaaaacattcaagtcaaagatttgaaaattttaatttaagatttttttaaaatttccaactcggatttaaaaatttttaagtcaagatttaaaaacttttaacttagattaaaaagctttcaattcggatttgaaactttcaattcagacttgaaaactttcaactcagatttgaaactttcaattcagattcaaaaacattcaacaaggatttgaaaactttcaactcaaatttaaaaactttcaactgaagatttcaaacattcaactcaaattgtttaaaaaaatcaagtcaagatttgaaaatttttaactcaaattttaaaactttcatcttaaaattcaaattttttatttaaatgttaaacattcaacttgaatttaaaaaaattcaactcaaattcaaactctcaactgatattgaaggtgaaagtatcagtttatagaatatcgcaaaaaaaaaatcacacgcgtgtgcgaaaaaaaggacgatttccaaaaaaaaaaaagaaaaaaacagagcgatttcaaaaaaaaacagagagagagagagagaaaaactagggaaattgcggaaagaaaaaaaggaaaaaaacttgtcgcggcatcagaaattacgattttgctaggaatttgtcgggtgatttttttgttgctatttcccgtttttgttgccgttggatctgcgccgagatttgtgccaggaatggggtggacgtggtcatacgtggatagggcctcgcgttggattccctggcccgattactttgcactgtgcaaatttcgatttccgcgcttgtccgtagccgttttttatttcccctcgctgatcccgctctctcctcgcatttctctctctcgctttccccttttcttctcttctcttctcgttttctccgcgaggcgagagagagatctcgtcggagtgagtgcttgctggagaggtttgtctcgtcggtataagtgctcgccggagaggactgtcttgtcggtgtgcatgctcaccggagaggttggtcgctggcgagatttagtgtttagatttttttttgttcgatttgattcagtccaggtccgattcaaattgtgttcgggttcaatctcggttttagttgttttcttgttcgatttgattcaatgtaggtccgatttgctcaccggagaggttggtcgctggcgagatttagtgtctagagtttttttttgttcgatttgattcagtctaggtccgattcaaattgtgttcgggttcaatctcggttttagttgtttttgttcgatttgattcagtgtaggtccgattcaaattttgttagggttcaatctcggctttagttgtttttgaatcgatgtaatatgatggaaagctcgccggagacgttggttgccgtagttttgtttagtttgtctcatcgtttttgtgtggcatccaatgttttttggtcggtgaaatcgtgatgctgctgctgcttcgccaagttgcgcttccaggtttggagatttgttcttcctgggctgtgggaagcgttcacggaatggatctaagattttgttgtttttgttgctgcagagcgttgcttttgagttggggaatggttgtttagcccgcggattcgggggttttaggggaagcttttgattttaggggtgctttttgcttagcaaatcctgtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcatttaactcatgtccaagttgatgtttatttattgttctttcagatgcctcgtgtccaaacatcaaggttgggtaaaaatcccattgaagttgattctgatggaggtgaagatttacatgttgattatgaagttggtaatgatgtaagttatattttaaatttttattattgtattatgctgtttaagtttacctttaatttggtattacattatttttctttttttttaggttgatgaaggtcctgaacatggtgaaattgatggtttattctctgttgtgctcaggaaaatggtatgtgaatttttttttgttgacttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttattgcttataatcttgttttaacttatcaatgaaacggagaattaattcggtcaaaggaaatttagtactaatgaagtggatagttattttcagattggaattgttctgttttttttttgcaaaataaaattttatatttgttctgtttggtccatgtgtacaatgcggtactctgaatcttgctaccatgctattacagactactgttagttatgttgaagatgtgagtatttttcaggttgtagttgtgactatacaaatttgtatctattctctcaacacagttcagtgcagccaacgttgttgagttttttgttttttcttctctcgttgtttggcactaataccttctttgttttctttcacatatcctgcacctaagtatccttggtagctttgatgcatgca

SEQ ID NO: 32956 - DNA, 736 bp, Oryza sativa
aaggggtcggggtgcctcggcctcggggccggggcaagcgcaaccagaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacgccacttgagcagcgcgcgaatctgggtgagcagatttgtctcgcccggagatatggtaacgccgcttcggtcggcgagcgtaattaacgcgcgcacgatacaatccatttcgattgccacaaccgcatatccactcaatgcgccgcaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctctggggggatccactagtggagagcggccgccc

SEQ ID NO: 32957 - DNA, 744 bp, Oryza sativa
gcggccgcactccactagtggatccccctttatttcaaaagagagatcaagtctgcattcggggaagccaataattaattttctatggttattttgtgaaatatgccatcaacaaaataaagcattccgtatgccatgtctgcatgttgctgcagaggtatatatccagacgattttgagtatattacttatataatatttgtgggaaaaagtatagttggtgaaacttcatcgagatagtttcttacattttatttttctaaagtttgagtacatatgtatatgtatttccatatcaatgaagctcgtttatcttctttagtatgacagtatgacaaaaatgctacaaaagtcgcatttacaatagtgattgttttgtgaccacaaattgttcaactatgacacctacagatactataagcatgatgcattggtacatattttagcttactcagaaggcagagtgcccacaaatcatgttcatcccatctccagcaccgaatgtgtggccatggataaaatggaaatgaatccaacttcgagaagattaatctatgcttcacgtcgtacaattggccaacaattaaagttttatctaatatcagttatccgtgtgttgcttcggataatagaaatatatttaatattatctgaaaaattaaaatttgctttctattaaatgtgttaataatatgtttggtaaagggaatattgatcctaatttaattttatactccctccgat

SEQ ID NO: 32958 - DNA, 783 bp, Oryza sativa
cttctgtgccgatgacctcggggtcggaggacgacaggagcggccttcccacagtggcctcggggccgtcctgggggtcgggggctcctggcgtcatcggacaagcgggcaaggggccagctccggtcgtcaggggcctcaggcctcctttcggctcgggggcctcttctccctgctctctcccgggtcgagtcagcacagggttagcctcggggccaaagggcgataagtgcggccttccctcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagct

SEQ ID NO: 32959 - DNA, 683 bp, Oryza sativa
gggcggccgatctccactagtggatcccccctgggagcccccaacaccgcgcctcccactccaatccgccgctccccctactcccgcctccccatcgccagcctcctgccagatccactcccaagaacacacaccaccaccagtccaccaccaccaacccaagccccgcgcaccaacccggaaattttttccgcaccgactccgccgcttggttgggcggaattgctccgccgccgccgccctccgaccgccggtggatggatggattcgcgcgcaaccgtcgccgaaatttctggtgcgttcttggatgcggcttttcttttttcctttgttttactttgggcgttggagaagacgaagaaagaaaaaaaaaacaagaaaaagaggaggatttggattagctgtgccagagggaagcgagagtaaaaggaagctgctttggattaataaatgcagcaggggaagcaactggggagctgagctgaggcttggttttttttttcctttctttttcttttctctcttgttgctttatggttggattggagaggcttggagtttatgggggtttgattaatgtgctgcatggttgaaaagaggatttggccgtgacagtggtttagtttgggttttagttaggatggtttttttttctttttttgactgatggcatcatggttaat

SEQ ID NO: 32960 - DNA, 812 bp, Oryza sativa
  unsure (1)..(812): unsure at all n locations
gcggccgctctcaccaactagtggnatcccccgnagnaaaaaaccaaagaacgaacaaatgagtaagaaaaaacttctctttgggagaaaggtggttgcaatgagagtgagacgaacctgcgagggggtcggttgaatgaccaccttggaggagaaatcaggttcccccggcatggttccgtctcccccgttttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggcccccggtgagcccctgggatcgcaggcccgccaggcggtcgaggacggcgtcgtagtcctcccccagatctaccg

SEQ ID NO: 32961 - DNA, 723 bp, Oryza sativa
actcccttgcattaattatgcatctccggcgtggcttgctgagtactgtggttgtactcattcttgctctatctttctcccccctttcagtaagagaagctttggagaagaagtcttaggtggagtcttggcttataccccagttgagcgcctgtaaagatggagccgtaggccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacactatttatggcaaaacggtgaagggcaagcaaggctccgctacaatggaccatgcgtggggtgaaggtcaagcaagaggcttggcgccgatggaccgaatccggtggtgaagggcgagtgaaggctttgtcatgatggtcgtggtggaccgtgcgaggccatttgaagctatgagtaatccgtatcaattataagaagaccgcaagatggaatgccgaggatcaagaggatttggttcttcgatgaacatcaagtcaaaatccaaagtgggcattgatcaaagcaaaggtataatttatttgggactaatatgcttaatgagtgtaggtgagaatagtcccaatagcgaaatggaattgacgttgac

SEQ ID NO: 32962 - DNA, 3274 bp, Oryza sativa
atgtgtattactcttgtttgagacatgttgtacctctctatggtttaggcttccttgtgatttaatttacttgttgtgaggtgcttgaaatagcaattcacaactgctaggaagttcctaggaagaacctcggaagttccgggtagctttctctgcttgtgagaaaaagctgccaggaagttccggaccttttgccatgaagttctgggccctgattttaaccgctgtgatttgaattaaattttaggagcgcctattcacccccctctaggcgacatcaaggccgtttcaattggtatcagagcctaatctccggattggcttaaccgcttggagagaagatgttgggggatggcgagaaaagtgtgaagggtaacatggttgatagtcaagatgctacaatgtcaacacgaggtgaaactttccttgaacttctcatgctagatggttcaaattacatgtcttggagtactcgcatgctttatgtgtttagggtcatgggacctcaaatatagcgagttgtagatgtgagcatttctcctcctagtgatcaaatgatatcatttgaagcataatagaaatgcatacatctcaatgctcaagctactaatattttgtttagtgctttgagtgaagatgtgttctaatccatcatgccacttgaggatgctcatctcatttggaacacactcgaggagagatatgacaagtccgagtgtgatgaggcaaagctcgctatagaagaaccacttgtggagtgctcaaattcatcgacaatttgtaaagagcctcaagtgattctatccaatgagcaagatagtcttgccacattcacctcctcaccaacacatgtctccattaaaggtaatgaaatggtgagtagcgtcaatgtggatacttctacttcctatagtgcttgtcgaactaatcttttgaaggtagaagtatgtgggaaaaaatggccaagtgaagaatttacatctccaagatgctcatcttcacacttggatgaatattcttgcatcatggagaaatcatatttggagaaagaaaatctagagcttaaagctcaacttgtggagctcactagcaagcatgtggacctacaagaaaaatatgatgagcttttgtgctctcatggaaatcttgtggattcacatgccatgctagaagtaactcatgaggtgatcataataacggtaaaatcctatgtgcctcatgttcaagttgactttacatgtgctaactcttgttgctctcaagcaaatatttttctgcgcactacatgtgacttggattatgtagggaaaaaggataaatacatcgatcatggatttgtttgcaatgctcaaccttctcaagataaccgtgaaagcatgctgaagaagcttgagaagggatcaaccgtagcttgcaccaagttctatcaagaagataacaagtccaacaacaagagcaaggggcaagatcaaagcaagaacaaagcttccattacttgcttcaagtgcaagaaaatgggacatcatgtgagagattgcccttggaagaaacagaagaagttgagcaagaatgaggatcttgctcacaagttcttcaaatccaccaaagagggacactttgcctcaagttgtccttgcaagattgatgatgaagccacacttccaagaaagacatcaagaatcaacagaaggaagtgctacggttgcattgagaaggggcatgaaattggattttgtccgcacaagaaggatgatcatagcaatcgatcaagcaagaggcaaaccggcaacaagcaagtcaagaagcaagataaaagcaaaactcaactttgctacaattgccgggcaaagggacatattggtaaaaattgtcccattggtaaaattcctaagccaaacctctcatttcatcacaatttgcttaggaaggccaaaaatggcacttgtgctactagggtgattagttcgctacatgctagcacaaaggccatttgggtccctaaatctcttgtgactaacatccatggacccaacgtgatttgggtaccaaaatatgcttagattgtcaattaggtacttggaggtgcattggaggctcaactcatccttgaagaactaactttgtgcaatgagcaaaaaatggaatcaaggatgtgaataattgttctacattaagaaccaatgtcatctcggtaacaagtatttacattgaaatttctatatcctaaccttgtgtaggttattacttgtgtataatgtctatcctttaatggtgcttaattgattggcaaatttgatcttgagtaatgttttggttatctcatttagggggagtgttataacttctcatatcatttgcatcccttaaatgtgttttgattaaattgatgctataatagtcttcaaaattctattttggttaaaaagtaaaaatctataaagttagttgtgaaaacttggttttgtttgttcaaaagggttccttcacctaattgagaggtattttaaaagttgattcaaacaaaaatgagttttggcaagaaaattgtcacgaccggaattaacccaatgggcgttccttacgtgcgtgtattattccttgtcccaggaggcaaggtacaccaaaagttgatacatttcagagtttatcaagcggaagcgtaaatagttaaattattacatgggcagcgaaggcccagcacacacaaagacaaacgagaagcagcggaagactagggcgacgaccacatgcgcttgacggctggcacgagctagacaccaaagccttcatcttctaggggctcctcttctgggtttgggaaaaattgagcaagactgagtacaaccaccgtactcaacaagacacacccacaagtacagaataaatgcaagggagtacaaaggagttatactataaagggttagggttgcagtaaacagcatttaaagatatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagcgcgcggctattcgaatagattatactctgatcagaggtgtacatctttacccacaagacacatcttcctca

SEQ ID NO: 32963 - DNA, 2481 bp, Oryza sativa
agggatctttttagggttttcctttttataaagccattttaactttgtttatttcttcttaaatattatttgtgctctgaaaattccactaaaatttatttacgcattttaggtttttaggaaatataaaaaaaatcctccaagccttatttgacttttaactttgcacattttaattgttggaggctttcacaaggattttaattattctaggcataatttcaaggatgtattttagagtcgttttgggacgcgacaaaaatgattttagcctctaaatctagatgctaagatcttgtttttgcttttaaagtgtgtttatgtcaaaatgtatctgaaaaggtttttgcaaataatccttttgacaagccactagagttggtcatttcaaatctttttggtatttatatctattttatatgataaatgatttgaaattatttgatctcaaaattcacatgaaaatttatattgaccatatttggtcctattatagcatcgagtgagtttagccactagaaccatatattgtgatttatattggttcatggacgtatttcaaactcataaaaatcaaattgtctccaaaacatctcattttgctcaaaattgcatttgggtcattttgttggaacttcaactttttatctttcttcgagcaaggaattaaacatgaatcctttaaaagtgattttattgatgctaggtcaattgtgaacgaacatatggtgatcctcaaacaaatccctcacacgagcaccatggattttgatggttttccaaaaactcggtttttacctttggttttccaagttctttaaatttggtgatgaaatattaaatattttggttatttcttgtttcatctgatttcccatgttgttgtgagctcgtggttcaaatttcgtgaaattccgagtttgtttgggtgattttgagcaaaatcttgaaagttctcgcgtgctgattttgtctgctaggaagttccagacaaagtacaaggaacttccggtcaggactctctgtggagacaaagagggccgataggaacttccggacaaattggtaggaagttccggtccaacttgcctcaaaacattgttttaaaatatgggtttaaccttaaagtttgttttggcccaaaaacgttagctcaagcttccaaaatttaaaagttcaaaagtttagatgacatgttttctaaaagggtttcctttgggtaaaaattcaaaaatttttattggacggttccaaaatttgtgaaaaatgtttcaaagggcttcatcttttatctcaaatgttctaaaaagcttttggagtgaatttttgtttttggacaaaatgtcatttatccaacatgttgttttgatcatatttggtctatatttgcatatgggggggttaaaccatttgattaatgttctttgtgaacatgggctcaattgggtatttctaacccatcttaagtctttccaaatgtcaaacttcataaaaaatcttttggttgaaattcattgttttaaaagtcattctctttatcgaaaactcatttagtgaaattaattttggagaagtttctctcaagttcaaagatcttttttgcaagcttgaattatttcagactttttctctcttttctcaacttgtagaaattttcagtaaaacttgactttgagctaatttgtgatctttatatctcaaaatgggttgtgttgttgtgatttggaaagagcttacattgtgactttcgattctctatagttggacttcactgccaaattttgtctaaattatcaaaggtcatttgaatgtcatttcaatgctctttctaagttattttttgagtttccgaaatttgaacatcttcaaattttcagctttcttaattcttttgatccttgtacatgcatgttggttgagacatgggcaatgctcccgcaatgaaaattgtgcattatcgtgtaatctatctccaaggtttgttgtagatttttcagcccatggattggattaccttcatgtatgaaccgaaagtttcggtctactaaggacttgtatgctccaatggtaaatcttttacatcatctctacatatacaagcttcaagtgtcatgaatattctttcttatggttgattgccatctattatcttgtggcaatttacatgcattattactacccaatgtttggcacatgtatattcttgcaaatcatttatgtgcaaattgttgaaattatagggtgtactcctcatttcttttcattagacaagtgcatgcttctatcaagtaattcaagcttgcatgcactatttagggggagcatgtcctatgttttgtatttttttagactaacttcttgttaagtgtattttatgtttagtctcatgagaagtgaaccattctcaaaggtatgctattcacaagtggtaattcaattaacttttcatcttatattttatctagctaccgggctgcagga

SEQ ID NO: 32964 - DNA, 4322 bp, Oryza sativa
atgcattaaatttatccttatatgcacaccttgaggggaagtttattctataccttggaagactaatggtttaaattgagtttattctttggtctcatgttggaagtggatgactcccaaggtagacttcattattgcttctatggattttctttgcaaccttgatttcataatataggatggattcttttgttccttcatttcttttgtgaaagtgcataaagatttcttttcactctttgctatgcacgtatttagaaggagttcatcctatgttgtgatgtttcataagtcttgatatgtctcttcatcatcactacttattgggttttggcttatgagacatttcattcgggcatacatgacttgtctatagcattatatgcccgacatactttttgccctcctttaagtgagttttgggagatgcattaaagagaaaatattttttttggaattatgcttttgtgcctttctccaaattaagcgagtttaactaatcaatgtatttgctatatgtgcatatgggttcttaccaattgtgactataatcaaggcctatctcttttgattggtattcttctattaattggtgtggttcataagcacaaaacaaaaaagtgcttgctttggattggtgtttctttggactccaactctttctattggaatttcgatgagttcaattgctttattcggtgttggtgcacatgtttttcttgtatacgtgtgtacctcgaggctatttgtactttgctatattgaaactaacgcttttgatagagtttcatcttgttgtagcctctttggaaaaccaaaggtatgttaaaccatttttccttcaagtgtataggacttgtgtagttcttatatacttgatgatttctttttctttatgctcccacccaaacattcaatcttttggtgtttgatgccaaagggggagaagtataaagagagagatataaaggggaaagtgtatactcgtttcatatgttgatgaaaccaaccctctagtatatgtttcatgctaatggtaacatatactagagtattctctttaaattcctattttgtgatagtgttgtcatcaatcaccgaaaagggggagattaaaagatctatgtactagaattgccttgtaaggggagattggaatatctatgatcctaagagtgcggtgattgttttggtgattaatgacaacccattgttggaactaactatttccatgagttggtgagattaggttaagttccgccatcaagttaaaagattgaagttagaagatggacattataccttgatgaggagcaagtgaagacattgatgatgcggggtatgaaatggctatctatggcaaaccggtgaagaaaaagaaaggctcggctagaagatggacattataccttaatgaggaataagtgaagacattgatgatgcggagtatgaagtggctatttatggcaaaacggtgaagggcaagcaaggctcggctacaatggaccatgcgtggggtgaagggcaagcaagaggcttggcaccgattcaccgaatccggtggtgaaggacgagtgaaggctttgtcatgatggtcatgatggactgtgcgaggccatttgaagctatgagtaatccgtatcaattataagccgcaagatggaatgccgaggatcaagaggatgtggttcttcgatgaacatcaagtcaaaatccaaagtgggcattgatcaaagcaaaggtataatttatttgggactaatatgcttaagtgtaggtgagaatagtcccaatagcgaaatggcgttgacgttgacaaccctcaaggtgaagcaagaagatgacattcttagtggtgtattagtcccaggttgcttaggagtgggctaggatgcttggagaccccccaaaacaaagcggcaagaagacttggagccgagttagactagtttactttttcgctttgagtttaggaaaaaccgtactattaagaggggttccaagtgtggttctgagataacacaagtgctcttagtggtgtccaagtgttgaaatatttttaggagctgtttttgaaaatggctctactcgggacagagagtcccacctggaggttctgtccggaacttcctggcaccgaggtgaggttgaaaaatttcataagtgctgcccagatgttcctggcacttttacccggaagctcctggcaggtttccagttcaaacttgtgagtaacggctagatgacgtcacctagccgttatatatatggatctcgtccccaggtcaccctttggccattccactttagttcttgtgttccctaacttgttctagcatctcccaatgtgattttgcttcctccacccaaatcttgtgtacttcttgagtgagagagtgattttgagggtggtggtgaggattggagaaggttttgaaggctaggatgacttgagcacttggggtatctcgttgggctatcatttgaagcttgttactcttggagggtgacctcctagatggttaggtgtcgcccgcgagtttctaacaaggttgtggattgacccgggcaagtttgtgagggtgctattccacctccgaaaggaaacgaaatactcggtgagtggaatccgaggtgaggtttaggatgtcatcttggtagagcaagcctcacttgtggtgttcttttggtgttcaagttggggatcttagtggtcacttgaaaccaaagagaagtacctaggggtgttggcttgaagaccggagacctcttcctaggccttttcttggtgaggcaaggggttaatcaagacccggctctttggagctcctcaacggagacgtaggattctcggtggagaatccgaacttcggaaaacaaatcatttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgataagtacgataagtccaaccattgcccatgctggcttgtggtaagtacgataagttcttctagggcataccgcgaaccggtccttaattgccatgggtgcgactagcaaaaccatgcacccacagcccaccattcagtcgcattttagttggataattacgaccatgaagcatggctagatgtctcgagcacgcagctcattctgatactaaaaaggtctaatactgtaattatcccatcaactgagctagtggtaattaagcatggctaagcatataattctagctaggtcacataagtaacatgagctagtcgatttattacccagggttgacaaaggacagatatcaagtaaacatggcacaagcaagcagataggtaatacccggatcccatgtaattagcaagacatgtatgtttatttgcaaatggtcaaacatttataaattgggatcaacatgctcaaggggaatgtgtgacttgccttgcttcttcaaaacaatcttccgaactcttttcctcgcgaccgtggacttccgaaacgacggattctacacgctagcacgcaaaacgaggaaaaactctaataaaaaccaaggaaacagtacataaaaagtaaacaaacatgtagatctcaattttagatgaattttgcaagttgaatggcccaattcggagttcgaatgaattagatatgaattttagaagttttgagccatttaaatgaatttctagaactaaatacaatttattgtgcaattattatttatttttacaaaggaaaaggggactgctgtcgtcagcaaggggtgaggcgcggaccgcgtccacgaaggggcgggccccatacgtcagcgacacaaggggtaccggcccaccgtggaccgagtccacggtggcgaccggccactcggccgcgcacccaatggcccggatcggccgagaccgctcggacggccgagtggcacggccaggcaggaatgcacacaggcggcagcgaccgccaagcccagaccaccggcgacgacgccagcgacgagcggcgacggcatgagaggcggcgaaagagaggatggggaggggatgctcaccaagcggcacggcaccggagagaggcgagatggtgacggcgctcctcgggcttgcggtggaggggttaactggcgccgattttcatggggagagtgggggaaatgggtgcggggtggatgtggtctttcggtagtggattggggaagatgagcgatggacggggtgtgacaa

SEQ ID NO: 32965 - DNA, 4043 bp, Oryza sativa
atgggagaggaggactcggggatcatttttatagcgcggggagctcgagatcgaggacggaaggggccgattttaaaggagaatgggtgccgccgacgtgggcaaggtgggagctcgaattgccacaaaaatttggggaaaaatgggggagagatggaggagtggcgggcaaccacgtccgcacggtcggacgtgcgcgcggaagccagaaggtggcagttttagcggtgacgtggggcgacccggtttccatgcggttgccggcggagaggctggaggaaggggaagagctgacaggtggggcctcaggtccacctgtcggtgagggaaggagagaggagcccggaaaggggttatgcagacttagggggagacgggggcccgagctgggccggcccacgagaaggaagggggaaatgagggagggcgagcggaccaaggggaggaggagggggattgggccagggcggttcaaaaacaaagagggggaatttttattgcttttatttttattttaattgatgatatgaactttgtgactttaaaattaactattgagcttcgaaaattcgcgggaaatttcagagagtatttagggcacaaagaatattacaaaatattctcggccaatgatttttaagggaaaattttaatttcccccataatttcacttgattaaattgctttaacttttatttaatttctagaaaatcgggggcgttacaaatctaccccccttacaggaatctcgtcccaagattttgggatggctagaaagaaagctggtgctggcgggctgtctgactgatctgctgacacatgctgcctctttctgattcaactgactgattgctcgatgaaccaaacctgcataagcttgctgttctgttgcttcccatacactgaatagaccgactccgattagtctgaccttgaccaaaattgctagtgctcatagaatttcttttctttggactgaaccactagcattgtctcccttagtaacctgtgagctcaccaagcatactagaaacttgcaaagctttcatgaaaccttgtatgtggacttgcatgaatgacagattctgactttattttaacctacttctgacgggaaccacaggtatcctaagaggctgcttgattggtctttcggctgaactgcaactgttcttggcactgcttgcctaagctgaacagttgacttggcctcacgggtttaccctggaatccaatcagataacctgagaccggtgtaattctgttgacgccctataattggcttcttcaaatattacccaaatggctgcactgagttgaacctccaaatgaaacgacgacgaggtgagccaacactcatctctgagacctaccccccttacagagagtagtcttactttcgcctgactgggatcaattgaactgttgtctttgaaatgtaaccaacacttttccgatttacaaagagccctggctttgaaaactgaaaacttcatcgatcaatcaaaatagagcaatgacgatgcactttcattctagcaagacttggaacttaacccttagctgaggataggaaagtccacataaaagagactctcacttagctcatgaacatattgactcttgactaactttcccatcagttctaactgctggcttgattgtcctgcttctggcctgacttcggtgtcgagttgcatagttgatttctgaaaactaacctgaccgactctgcattggaactgatgtaacttgaggagctcgagatcgaggccgggaggggcggatctgatggaggaatgggtgccggcgatgtgggcgaggtggagctcgaatcggagcgaaaatttggggaaaaatgggggagagggtggaggagtgggcggcgaccacgtccgcacggtcggatgtgcgcgcgggaggcaggaggcggcagttttagcggcgacgtggggcgacccgggtttccatggcggttgccggcggagtggctggaggaagggggaggagctgacaggtggggcctcgggtccacctgtcggtgagggaaggagagaggaggccgggaaggggttatgcagacttagggggagagggggggccgagctgggccggcccacgagaaggaagggggaaatgagggagggcgagcgggccaaggggcggaggagggggattgggccggggcggcccaaaaacaaagagggggaatttttattacttttctttttattttaattgatgatatgaactttgtgactttaaaattagctattgagctccgaaaattcgcggaaaatttcagagagtatttaggacaaagaatattaccaaaatattatcggccaatgatttttaagggaaaattttaatttcccccataatttcacttgattaaatggctctaacttttatttaatttctaaaaaatgcattattaaatgatttttaatcccaaacgaaaatcggggcattacagcaagcgccaaagcaccaatgctttcgcctttttcaggcccagaagaatggctttgtattctgccgcgttgttggttatgtcgaactgcagccttgcggcatattgaatcggcacgccccctggcaaagtgagtactgtcgcagcgcccgtccccttgtgcgaccacgagccgtcggagtacatcacctagggttgttcgacgggctcgggctcagcggcaaacactggtatccattcggccacgaagtcagttagaacttgggacttgatagcagtgcgagtgacaaaatgcaagtcgaagggagatagctccgccgcccatttgctgagccgcccagtgacttccttgcctcggagtacttcgcccaaagggtattgtgatggcaccgtgactttgtgggcctggaagtagtgtttaagcttgcatgaagccatcaccagggcgtaagcaagcttctccatttcaatgtatcttatcttcactccttgcaaggcttcggagacgaaataaactggtttctggcctgactctgtctcttggacaagggcagcactgactaccactggcgaagctgccaggtatagtagcagttcgcttcctggcgccgggctgatcaaagcgagcagactttgcagatattgctttagcgcatcgaacgctgcttggcattcgggtgtccaggtgaattttcccgtgccccggagggtcttgaagaagggcaaacctcattcggctgcctttgagaggaatcgattgagtgccgcaattcggcctgcgagcttttgtacttcacgtactgtcacgcccggaatttctatccaaaattccaaacgcttacatgtgtgtgaaccctcgtccaggaatcagccgaggcacacaataacaaattgataattgagtacaattattactctaattaataagcgaacaaaatgtcattacagaggtagatagttcctctcaatcaataaaaatctaagcagcggaaagataagataaacggcgcagacgactccactccacaggcagcttgaccagggctacaccaaatcctccacaccatcagcatcactgtagaacctttcctctgatgaatgattgaaaggtgagtatatgacatactcagcaagccacgcagcaaatatgcaagtgcacaggataacaaaggatggcatagtagggtttcatttgcataaacagcatttgataaacatttcagaatttaataaaacagttaagtaataattaaacaatattaatccaacgctatacaacataccctgttgtataggcccaaccattctgaacaaccatcccggctgtacagttctatctccaaaccaggaatataccattccaaaccaggagctaatcaaattattaccagttatagcatcttttattaaggtaagaagtgtgagactaatcatgaaagacattgttagacccgcccataaccgggggcacggttattcgaatagttttattctggccaaaggtgtaccactgtacccacaagacacagccccacatcatgtctccatgtgcctcaataccaccacg

SEQ ID NO: 32966 - DNA, 4828 bp, Oryza sativa
tccactacagggtgagtaaaccaaatctattcaaatagccgtgctcacggttattgagcaccgggacgtgtattacacttggctagactctaaattcttaacttgtgtgggatgggatattgcatgatgatttttatgctgttggagctacttcctgagaggagggaaggtggacgacctcagaaaaccatgacgactcaatggcgggaagatatccttgggatcacaatggatggtggacagaaccgtcgttgtttaatgtgaacactggtattaaaatttgatcagtctatgcaaggtcttaggcttgtgaaaagatttgcaaaacttgctttgcgcaaaggaacctgaagccattccttaaaataccttctatcatatgcatcgttgctgtggtagcttgctgagtacgtttggtactcacccttgctatttatatatcttttaggagagtgttgaagagaagcccttgtcgctacgcttgcgtatccaacaagatgatcggagtgcggtcttgttctaggtcttgttccccagtcgactgcctgtggcatgttaatcgggcccttatattactttgtcttccgctgttgttctctgatagttgttggcctacctggccctaatgtaagtatttaactcttttagcctgaattaatttgtgatatgttgtgatccaactatgtatgtgtgtaccaactactgatccagggattggtacggataaacacagaagatttccgatttccaaaatcgggggtctacactcaacttgaggagtgcaatgccgaactagatcttgaaaaacaaaagctagccgatcttccaaatgccattgaagaacagaagtccagattgagatcggctatcaagaatgtggctgacatgactaaatctctcaagatcatccctggaaccgatgcccaagacatccaagccatcgaagaagtagatcaaatcaggcaacgagctttgtcggctatccagcgctatctttctcaatgacattttgtgtaatagactaggaattttgtaatcggctaagaaactctgactctttatctaactcatcttaataacttttatgccgattcaatataactccatatttcgctcaaaaatttgcaatttttcatatatgtgcccccctaattttacgatgtcaaaagtattgataaaattataaaaacaactaagggcgatataacaatatcggccattatgcatcggcaaaccacaccgattacaatatgaaaacaactaaggacgatataacaatatcggcaatctcaaggcgatgcaaatacatcggctatcatgtatcggcaacatcagccgatcatgcattaacccaaacacttgggtaatatttcttcaagtacttgccatttagcgctcgtccataaacttctccatcgagtccttgcaacatgtaagctcccttagacacaaccttatagatttggaactgtccttcccaattcggcgaccacttgccgaatttgttatcccgtgtcccaatcggcaaaatcaacttccacacaagttcaccttccgaaaaagtcttggacaccactttcttgttgtaatgccgagcaactcgttccttatccttggtaacctttgcaagggctcttaatctagattgaaccaagtcttccctttcatcagccatgagattataatattcatcggctgtcaaatcattttgcaactccgttctccttgagccaattctaacttcccatggtaaaacaaccccatgtccataaacaagcttataaggaggaacttggatcgaaccatgactagccatccgataagaccacaatgcttcggccaatcgagtatgccactgccgaggataatcaaaaatctttctcttaatcaatttgatcaaacttttgttagatgcctcggcttgcccattagcttgtgcataatattgtgaagaattcaacaatttgatacccatgctatcggcaaactgaacaaactcatcggacacgaagattgaatcttgatcagttgtaatggtttgaggaataccaaatcgatagattatatgctcttgaacagattgtatagcatccctagaatcaaccttcttcaaaggaatcgcttcttcccacttggtaaaataatcggttgccaccaatataaacttatgccccttgctcgatggtggattaatcatgccgatcatatcaattccccaacctctatatggccatggtttaatgataggattcatagccgatgccggtgccctctgaattgctccaaatttctgacaatcttgacatcccttgtaatatttaaaacaaccctccagcattgtcggccaaaaataccccgcacgtcgaagcaactactttatcttatgagccgattgatgagtaccacatattccttcatgaaccttaccgattgcaaccttagcctgatcggcactcaaacacttaagcaacaccacatcaatcgtccgataatagagctcatcatccaataaagtatacttcaacgctttatatcgcagtttccaagaagccgattgagatggattctgtaaatattgatgtacgtcatatctccaatcatcggctgttaatgcaacaatctcaaccttgacatctttgatcatcggcttatatcccgatgccccttgggccaaatcattagcttcaatattttgctctcgagatacatgcttcaaggttaccatccgaaactccttcatcagctctcggcacttctcattataaatcattaacgtataatttttgcactcatactcccctgccaattgactgatcactagcaaagaatcttccataatttcgatagcatcggcttcaacttccttgagtaactgcaaccctttgagaactgcctcatactcagcttgagtgttagttgcataaggtttaatagtataagcaaactcaaaacttgccccccgaggagaaattataaccaagccgataccacaaccatgagtgcatactgatccgtcaaagaacaaagtccatggcacaacctcaaccgagccgattgaatcatcacgatgaacaacaataaaatcggctatagcttgccccttgactgccttcggtgactcataccgaagatcaaattctgttaaggaaaatatccacttttcaacccttcctttcaaaattggaccagataacatgtacttaacaacatcggctttgcagatgacagtgcattcgttggacaataggtaatgccttaaccttgtacaagaaaaatataaatacaagcatagtttctccacaggggaatatttggtttccgcatccaagagccgatgacttagatagaatacaactctttcttcccctcaagctcctgaatcaagactgagtcgattgatttctcaccggccaatagatataatctaaaaggtattcccttctgtggaggaattaaaaccggaggagagctaagatattccttaatactatccaaagctttctgttgctctgtcccccaagtaaacttttgatcggctttcaatcttaataatggtgtaaaaggctttaacctcccagacaaattagaaataaaccttctaacaaaatttatcctggccgatcatgtcctgcaactctgtcttattctctaaaagctgaaatttcttgattgcattaacacttctttgaactatctcaatccccctctcatgaacaagaaatcccaaaaactggccagctgatacaccgaaagcacactttgtcgggttcatctttaggccatatttcctagttctctcaaaaaccttcctcaaatcggctatgtggtcctctatctctttagacttaacaaccacatcatcaatataaacttcaaccagctagccgatcagatcatgatatatataattcatggctctttgatatgtagctccagcacttttcaagccaaaaatcattacaacccactcaaacaagccgattgcaccaggacacctaaaagccgtcttattgatatcctcttcggccatgaaaatctgatagtatcctgcatttccatccataaaactcaatatcttgtaccctgaagcagcatcaaccagctgattggctactggcattggatactcatcctttggggtagcttgtttaaatccctgaaatcaatgcacaccctaaccttgctgtttttcttgataacagaaactatactagaaacccactcagcatatcggcaaggacgaataaaaccaatatcatataaacgtttaatctcagccttgataggttcgatgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcgcttgacggcaggcacgagctagacaccaaagccttcatcctccaggaactcctcttctgggtttgggaaaaaattgagcaagactgagtacaaccaccgtactcaacaagacacacccacaagtgcagaataaatgcaagggagtacaaaggagttatactataaagggttagggttgcagtaaacagcatttaaagacacttggttgcgcaaagctattttgtaaacacgattctagaactatacaatattatttatcaaggccgtgaacccacacgaacctgccttaacccaaggcctacgatgattcagaccgaactggcaacccg

SEQ ID NO: 32967 - DNA, 9658 bp, Oryza sativa
tgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataccaataccaataataaggtcataacaaaggtaagtaggcatggctagataaaactgtgataacgcgggaatttaaataaagcgataatgcaataatttaaagcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaatttagagacttgaacggtccaattccgagttcaaattcttaacaagcaggaacactggcctctccacgtaggtcaagtcttcgcgaacttcaatttgctctgagtcggcctgctcggatggcactcgaagacatttcttgagttgcgacacatggaacacatcatgcacgttgcccaaggcggcgggcagctccaactggtaagcgacttctccgcgccgagcaatgatacggaaaggacccacaaaccgaggtgcgagcttcccttttgtctgaaacctgtgtacacctcgcaatggcgtgacccgaagatacacaaagtcatccactgcgaattccaggtcacggcgacggttatctgcataacttttctgccgggactgtgccacctttagattatcccgaatggttctgaccttcgcttcagcttctctcaggatatcagtcccgaacacttggctttccccaacttggtcccacaagagcggtgtccggcatttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatcggtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggaggagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagtgtcacgtcctgataaatccattccgaattaaaattcgttttcctaaaaggaataatagaattaattaaaattcgaaaagaaattggcaaacactaaaatacgtgcaagaaaaattcaaatgtgacccggagaatttttgttaaattctccttggtctaaaatgagccctcaaattttacttgaattttcagagcaccggaaatatttattaaacaacaacaacaattatcaaagttcaataaaaagaaaatctaaaaataatcctcctcttcctcctttgggccaagcccagcccgaagtccttctctcctccctctctttctctccctctccttctctccctcctcttgggcccccttcccctcccggcccactccctcctcctccctctctctcccgggctgcctcttttccccccccctcccctcccggcctgtccggcccaggccgcctccccctcctcccctcctgggccgtgtcccggcccagccgggcctctcctgcccgagccgcccctcccccccccgcgcacgtgcgccgcgcgtgcgctgagagcgcgcctggccgcgcggggcccacgcgccaggccgccgtcgtcttcttcctccgcccggccacctctctctctcttcccgtgaaaccctactcccttcctccctcaaatccgtgtgattcgctcatgggattccaaaattaaataggggaaattaaaccccattgaatcctcttcaattcccccttaattcctccttgaatggtgcccccaatcgccgggaacggccgcgccaagtccggccgccttcctttgccgccggccaccattcccgtcgccgttcccgctcctcccgtggccggctccctcccccatcctataaaatgggatcctcatcccccgttctctcgttttagccccatcccgagcctccccgtggtccctagctccctccccaccgtcgccctctctctcccacgtcgccggccgcctccagccgccggtgccgcctcgaccgtgcgccggccggccgcgccgtcgcctcctccagcgtcgccgccacctcctccaccccggcttgccctccgtttcgcgaggtgacccccggagctgccttcccgccgtcgccctcctcttttctccgcgccggccacctccagccgcacctcccgcctcacccgtgcaccctccggctgcgccgtcttctccctcggcctcgcagccacctcctctccctcggtcagccctccgtttcgcggggaaagcaccggagacgcgtcctcgccggcgtccagtggcgtcgccaccacttctccgtctccggccggctgctgttcgtcgccggtgcgccgaccgacgtcgccgtctcctccgttgacgtcgcagtgccgtcctctctcccggccaggccacggcgtcgcccgaatttcgccggaacgccgtcgtttccgcgccggcctttccttcctcctcgtcggctcgtcgccccgctgcaccaccaccttcaccaatgtcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgcagcggcgtggtcctcgtcgtcctcgtccccgtgcagccgctgccggctgtcctcgtcgcctcctcgccggtcccggttgtcacgcccagaaatttagcccaaatttccagactattttgtgtattaaatccctgtccaggaccagccagggtacacaaaacgacaagtaatatacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaatattgaatctccactgatcaacgctacgccacgttgaacaggcccaaccaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcgcaaaaccatgcacccacagcccaccattcagtcgcattttagttggataattacgaccatgaaacatggccagatgtctcgagcacgcggctcaacaagaaactagaatgtctaatactgcaattatcccatcgactgagctagtggtaattaagcatggctaagcataaagttctagctaggtcatcaaagtaacacaagctaggcgatttattacccacggctgacaaaggacagatatcaagtaaacatggcacaagcgagcagataggtaaaccctgatcccgtgtaattagcaaaacatgcatatttatttgcaaacggtaaaacatttataaattgggatcaacatgctcaaggagaatgtgtgacttgccttgcttcttcactttgatcttccgaactcttttcctcgcgaccgcggacttccgaaacgacgggaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatggatttatataattaaactcgatttattgcgcaattattatttatttttacaaaggaaatggacctcgctgacgtcatcaaaggggaggggcggcgccggcaagcgggccccaccggtcagcggcacaagggcgccggtccaccgtggaccgggaccaccgaggcgatccaccgccggtccacgggaaccgacggcccggatcggcccaaagccgatcggacggccacgaggcggcgcggctggggcacgggcacggcatgaaaccggctcggccgagccgtggtgctgggcagcgtgcggcctccggaggcagcagccggcggcgccgaacggcggcgagcagccggaagacggcggcgctcacgggcagtggcgatgcacgcgaaagggaaggggagcgggaggaggggctcaccgagcgtgcgggccgacgaggcagagcgggaggtcgccggcggcgggaagaggcggcggcgctcctcggggaggcaacggcgacggcggttcggcggcgttccgtgaggaggaaccggcggccgatggtcggagggacctagggaaggaaatgaagaggttaggagagggtagggagttgcggtgcggcgggaaacgccgaccgaaatgacgacggagctcaccgggaggcacggggagatgagtccggcgacgaccggcgaacacggagggattgctgagccacggatgatggctgcggtaccgcggagggcgacggcacaacactgggcggactgaagaggcggtgcggcgcggccggaggcggaaatggcgacggtggctctggatgcacggtggaagggtggttgcggtggtggaatggggaaacggagcggaggccggggtagagcttggcacggcgttgccgacggcgcaagcggcgaggtgcggcgacgactaacgcggcggcagcggccggctgaaggcggtgtgtggcggtagtggctcggcctcgcgatgggaaggtggttccggcggtggaggagggagatggagtggatgccggggtgcggcgaggcgctgtgatgctataggtggcggcggcgcagcgcggcagcgacgggagcggcggtggcgggcggctggagatcgccggcgagcggcggcgaaggggatcggcgtggagagctcggtagagggcgtgggggactcgggaaaacggggaaaaaggaagaggagtccacggggattgattttatagctcaagggggcgaggagagggccggggagcggcggatttcgaggggaagtggggcggcgaagtggagctcgtggggaggtcaaaccggcgccgtttcttgcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttattttgttttctttttatttaaattgattcaatgatctttgtgctattaaaactatttctcgagctccgaaaattcacggaaaattccggagagtacattagggcacaaagaatattacaaaatattcccggccattgatttttaagggaaaatttcaagttctcccattatttcacttgattaaattgatttatcttttatttaatttctagaaaatgtattattaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcgaactgattgattgactggttgatcaaacctgcacgattgaactggctggattcgacctttctgttcctttgctttgcgaaaactggaccgactggttctgcatgaactgacctagactagaactgtggctgctcacgaaacttacttatcttgatctgaactgttgatactggcagtttgataacctgacaattcaccaggctggctagagaagggtgaagttgttcctaagacttgcatctggcatttgtaactcattgatcctacgtccgcttgaacgggtcctggctcgaatgacacgtaattccaggaaacctgcttgacctgtcttttgtctgaactgcaaccgtccctgatgctgcctctcaaatctaagctattgacctggcctcaccggtgtacctcagaattcaatcagatttcttgagatcggtgtaactctgctgacaccttgcaactggcttcttcaagtactacccggattgttgcactgggttgaaccttcaactaaaacagcgatgaggtgagccaaaactcatctccgagacctaccccccttacagtgggtagtcttactttctcctgactgagaacctttgaactgttgtccttgaaaaataaccaacacttctctgatttgccaagagccctgactttgaaaactgaaaacttcatcggtccatcaaattgaagcaatggcgatgcactttcaccccgacaagatttggaacttaacccttagttgatgataggaaattccacataaaagtgactctcatttagctcatgaacacactgactcttgactaactttcccataagttctaactactggcatgactgtcctgcttctatcttgacttcggtgtcgagtttcaaaaactgaactaaccgactctgcattggaactgacacaactcgaggagttggggtgtcgctaacaaagctcttgatgtgatgacgctgacgccttactgtggaacaaccctctgagaggtgccctgtcatacatcttccatggatagttggacactttgcaaaaactgcgcttgaaaaccataaccacaataggtagcatatattactcctgggattggtggtggcttagctgtgctgatttgctgaggacttggtggcgtactatctgaggttgcgggtgcttcctctttgaaaacaaactgactatcgctctgatcctgattccggcttgcatctgagcttgtacttgttgttggagacactgttgttgcatctgttgcatcggactttgcatctcccgcatcaatacatccatcatctaatcttggacaccaaatgttgatcacgagcagggttcttctggcactgggataccttgtagctttcaactgaaccattgattggtgactttaatacaccgtcgttgctcttctctctaacactgactatcttctgccagggcggaagagaggaggaagagaggggttgctaaagataaggtactaagccacttgcctactgatctgttgtgagtagatttttatttttcaagttgcttaagcaaacaacctagtatggtcgcatccccaccaatgatgcaaaccatacccctacacacaagcaaacaacacacgatctagaagctaacgaaactactcttcagggaaggattgggtttaggtcatctccgggaaaactccacttgatcttcgcggaacgacgactccgggctgaacttcttgctcctactgcacgaagcttgaggcttgaattgacttccgaacagacatgaagctggcggtttctcctccatgtttgacaactaaaagagttggagggacagggaggaaaaattttaataaactgtttcgcaaagaaatgccgaagggcgagaggagacacttcgcaaataggattttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccgaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataaatacaaggctgagtacaaccaccgtactcaacaagccacaccaacgatgcagacgtgcaaggggaacacaaggacgggttggtgcttatttgcataaaggcggttgtaaaacattttattgagcaaaccagtaaacagttgagtaatttaagaatattgaatttcactgatcaacgctccccacgttgaac

SEQ ID NO: 32968 - DNA, 21366 bp, Oryza sativa
cccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgccgccgaagccgtcccctcgccgttcgtctccgttgtgcccgtctgtctccgccgcgcccgttcgtcgttggcgttcccacgcctcgtcgcgtggtggtaaggatccgtcctctcgcttccccgccctcgtcctttcggtgtcgccccgtacccgttgtgcggttgtcgacaccggtacccgtgtgccggtgtcggtagtcgttcgcttgtgcgtgtggtgtccgtgttagtgtgcccgctcggtagccgcgtggtttctacgtgtgcatcccgtgtggtgtctagtggagtccgtttgttggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggtttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattattttgatttaaattattgcattaccgctttatttaaattcccgcgttatcactgttttatttagccatgcctatttacctttgttatgaccttattattgttattgttattattattaccttgttcaccctagattaaacaaaacctcaactagtggacactctactcatggttccactagtatgaacttaggtagatgcttcgctggttaattaggcaacattaggtggtttttataactttagactttgggaattctcatatcatatggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtctcgcctgcctgtcccgggggttccggccgtaggcgggattgggtcggtactcttgtctatggctaggatgggttggaaactatgtcacgtcttccgtctgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtagctctaggatcgtctttataaaatggctttgggcaactaagtgacttttaaatgctgtttactgcaaaacttaacctctatgttattatccccttgtactcccttgcattaattgtgcatctccggtgtggcttgctgagtactgtggttgtactcattcttgctcaatctttccccccctcagtaagagcagcttcggagaagatgtcttaggaggagtcctggcttataccccagttgagcgcctgtgaagatggagccgtaggcccgcaagtccgctgctgtttatttttgtttgtcaggcctgaagtgcctttgtaataatgtaaatattatcgatataataaagatgtgtcttttatatcatgcttgtgtggtgtaccccggcttttcctgggacggggattaatacactggcgttcgggaaaaggcaattttcccggtcgcgacactgagcctcgcggatttgatcgagcaaggtgggcttggcttccaacgcaaccaagaatccacgacccactatgcttagattcagggcttccatctgttggttaagttcgggtggaatgccacggacgttaagagtgttgcaatggctctttcgacttagagcgtcggcgaccacgttggccttaccaggatggtagtgaattcccacatcataatccttgatgagttctaaccatctcctctgccgaagattcagatccgactgggtgaagatgtatttcaaactcttatgatcagtatatatttcactgcgattcccaatgagatagtgccgccagatttttagagcatgaaccaccgcggctaactccaaatcatgggtagggtagttgccttcatgaggccgtagctggcgtgaggcataggccaccacatgaccatcctgcataagcacgcaccccaatccttggcgcgaagcatcacaatacaccatgaaatccttgcgagtatctggcaaggttaacaccggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgcaaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcatcaatgaacaccacaacaaacttatccaagtattccatgaacactttgttcattaagttcatgaagaaggcaggtgcattggttaaaccgaacgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccctagggggaagtactcggacgtatataccccttttctttcaactcttccaactgtttcttgacttcggccaattcatttgctgccatacggtagggtcgtttgtacagaggagtggttcctggagcaagatctatccggaactcaatctctcgcttgggcggcataccgggtagttcttccggaaacacatctccgaactccctgacgatggggatttctgacagtcctatctgatgaagttctgaactactgacagaggttgggggtgcaaagaaaacaaccgattgttccggccctcggtacagagtgacagtgcgtctcgcgcaatccactactccttggaattgagccatccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcggagcgaggttgttgctgctgttgctgctgcgaggacgatccccctggatagggattggtgtagcggaccctttggttagcaccctgttgattgcggacattcgccaagcggcgcttgtgcgactccagttccttgtgcttggcttccaagcggatgctcttgtccaccagacgttggaaatccggatagtcaccggagactagacggacggacagctcagggtccattcctgccaagaacttctcctgcttttcctcatcttcccgcacatcctccagggcgtaacgggccaggttgttgaactcatgcaaatactccatcacggagcggttgccttgcttcaactctcggaattcccttttcttaagggccacgactccggcgggcacatgggttctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttattggagctagagaaggttggtggacggatgcggaggaactcggcgagtttacagtgttgtgggggtggtggaggagcattctgttgtggcggattttggaggtggtggaggaaagcagtcatcatgttggcctgctgggcgaggatttgggtgagaatagcgttggtgtctggtggtggtggtggaggcggaggaggaggtggaggtggactgccatggttgttgtggttgctgccttcgggttggttgccatcaccggtattagcacttctcctggtcgtcaccatctgaaaaccccacacaggaccagcaaacagagagagctgacaattaaagctaaccacccacgactaccataattcttgaatttattactgctattaaattagttcattaaagttcaagttgcttaagcaaataaaataaagacaggctccgacacagttataccacacaccggcataaccatgccccacacgactccaacaagaagacaaacgagaaagaatacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctagttccttcttcagctgcagattctcttgacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgaagtcgcgggctcctccgcggcgagggtggtagcggtagggcgagtgctgcaactcgtccgggtagcgctggtgaagagtgccgatggcgaggagagcggcgttctggcaagcggcggggaaagaatctccacccgcggtgactgccaacgaagtccgctcgggagagccagtgaggatcactgcagtaacctcccaagcagcgtggggctctgcatcgtcaccctcctgctccggaagcggcctgccctggtagtccactccatgtggataccccaggacaacgcacatgccccgcagctccaagacgaaaccagtcaggtccagaccacgacggctgatgctgccggccatctacaaacaaaaacaaaaagaaaaacaacattttaaaggtcagattttggcgataaatgaagcaacaggacagagagagactagaggattttcacaaataagacaggatttttttttatttttgaaaatattgctaaggcttgggatctacggctcgtcctagggtcaaaggtggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaatttattacatgggcagcgaaggcccagcacacacaaagacaaacgagaaacagtggaagactagggcgacgaccacaggcgcttgacggcagacacgagctagacaccaaagccttcatcctccaggaactcctcttctgggtttgggaaaaaattgagcaagactgagtacaaccaccgtactcaacaagacacacccacaagtgcagaataaatgcaagggagtacaaaggagttatactataaagggttagggttgcagtaaacagcatttaaagacacttggttgcgcaaagctattttgtaaacacgattctagaactatacaatattatttatcaaggccgtgaacccacatgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcaggacaccggccctgtgccatgacatctcgactaccgggccgtagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccaaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattaaatagcgaagcatctacctaaaatcatactagtggtaccatgagaagagtgtccactagttggggttttgtttaatctagggtgaacaaggtaataataacaataacaataataaggtcataacaaaggtaagtaggcatggctagataaaactgtgataacgcgggaatttaaataaagcgataatgcaataatttaaagcaacataattttataaactgggattcaatatgctcaaagatgatgtgacttgccttgctcgctttcccaaacgtcgacttcaacttccacgaagagcggatcttccgaagctgcagcgtctacacgaccaacggaaaagaaaaggcttttactctaataaactccatataacaagcaggaacaaagcacaaaaatgggttcttgactttttaaggaaaaattagagacttgaacggtccaattccgagttcaaatggccaagttatggccatttgaaggttatatgctctttaaatgaatatttgcgaatttcttcatttaaattttaatttaaaaatggatttattgcgtcagccgaggggaggggcgcgcggaccgggtccacgggggtggggcccacgcggcagcctcacggtccacggtggaccgggtgcacccgggctcgcaccgaccggcgccgtgggtcccacgcgtcagccgcacccgagggcgcgggcggctgacggccgggccccacgcggcagccgcggggcgcgcccgaaggcggccacgccggcacagccgacgggaggcggcgcactcgtgccccgatggtcgccgccggcgaccaccggcgcggcggagcggtgcccgagagaggggagggaagggggaaacgaatcggcgatccacggctcaccccgggtcgacggcgacgacgggaacggcgaccggagcggatagaggcggcggcgcggctcgggtcgacggggacggcggcgttccggcggtcggcgaccgaaacggagaggtggacgaggtcggcgaggttgcggcgaacccgaagaaggtgacgccgaagcgggagaaggtccggggcgacgacggcggcggaccggagctcggcggcgacggcggagagagagagcgatggcgcgagctcgattccggcggggagagagagcggcgagtggcggaaacggtggagggaggcacggggaaggtttatatagggttgggagtgggagagggcggccggacgagggggaaacgggcgcggaagatccggccgccattgatgcgccggcgaggttagggggaaagtttccgaacgaatccgagggagagagggaggaaaaaatgggggggaaagagggagggaatcacggggaatatttcccccctcttgattgcacgcgggacggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcgcgcgcgcggggaggaggccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagttcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggtggagttattttttttatttttcccgggccgaaaggaacagtaatgggctttcccttcatgggcttattactgtgcggctcggtcgatggaaatttaccgtttcgcctaccctcgcgacacgtgacgctttattactggtgggtaggcgaaccattgcctgggtgggctatatattctctccctcttttcccttttcactgccacacttgtcattttcactgcgcgcgctctcttccaccgttctatcctttcacggcgccccttgacccctcatatctttcgcccgttctctttgttcgccactgcacacacccttcgccatggctcctcgcaagccaaaccacgggccggattgacgacgacaccacagcctttttggggatttctctcatagatgacggcgagctggcgaagttggtcagctctggggtgttggttgaggggcaggctttcgcccctgggaaggccgtggtaccgaagcccgtcgacaaccagacggtggtgttcgccggcttttttgaggcggggcttcggtttccgtgcaacatgttgttgccggagatccttcaccttttccaggtagagttcccacagttgagaccgtcggcgctagtccggattgccatcttcgactaggcgtgccggacctccgggtttgaacccagcgccgaactcttcggcgccatattttttgccaccatgaattcgaagatggtggtgaccccggccggaacgaagaagacggtgttcgggagcgtgaacttcaacgttcgccccaagcgctccgatctctggcctgtgaatgccgccatgtcgaagtgcgatcgccactagatggcgaggtggttctatcacaccatccccttcgaggctgggtccgagtcggcgaaggccctccgatgtcggcgcatggtgattgcgccgaaccggaaacccaagatcgccgtggacggcgcaatggaggcacggttcgccttgctacgcaaggtctgctcccgcctcagctgccgcgacttggtggaggagttctgtatgcttcacatttttcccctctccctgtcgtggcaagtcacggttgaccaagacgaagaggtcgacggtttgccgaagctggttcttcctgaggggacgaatggtgagaccacgctttcgctatgcacttctgtgttttgctattttcccggttcaacgcttaatatggctacaccttttattttcatagtgttgactctcgatcaggccgacgctgaagcctggaagatgatcggcgatgtgtcggtcatcgagtacagccagctgctcacacgacaggctgccggtcgggcgaaccttgtttatgacggcgaactgcctccccgggcgaacccccacaaggccgacgacgatgcagggccttcgcgaaagggacgcgtggacaagtgaaactggcccctagaaagcgatgggtccctgcttgctccgattctgacgccgacgacgaggatgacgtcgaagagcgtgacgacgaggaggaaggggaggaagaagagggggcggaggctgcggccggaaaggctgcgaacgaggcggttgaaaaccgcgccgagacccctggctacactcctactccaagtccagggcataacgagaccggggtggagtcgaatagctcccaccttgatcgaaaggatttggagggagcgaaggtgctggttgcgttttcggcgggcaaggtggcgaagggggtagtccggttaagaaggccgccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacagagcgaaccgtgcgggcccatcttgacggatttaggaaccatcttcgggccaaggatgatgagattggccgcaagaatttggagatggaggccctcgccaacaccctcaaggaggcaaaggtggaaaacaagcgactccaagccgaactggagaagggaagagaggctagagctgaggtcgatcgcctcaaggccgagcttaaaaaggaaaaagcccattccgccgcgctaaccgactattacaatcttactgagccgaagatagaggctcttcgcctggaggttagcaaggctgaggcaagcgctgcagaggagtcgcaacggttttcgtgggagatggcgaaagccaccgagtccgcaaaaaggcatgccaaactctccgccttgccctttccgacatgggtgcgagggtgcgaggagtccctgccaaagatgcctctatctttgacttttcggagtggacgcaataggccggtggtgcggtttcggactacgccactgcgtacggtgattcctgtgcacatgtatcggcggcgttcactatgggccttctacagtagtttggctgtgagcatgtcgccgagttccctaactatgcgaagggggactgggaggttagtgcacaggacgtttcgcctacgctccatgcgtggcagaagcagttctggcagaaggatggccgatccactgctaaggcgcgccttttggagcaactggcgaaggccgaggcggcagaccaaggcgaaggcaaggatgcggcagaaggagggggtggaggcgatgcccaggatcacccagagttgtgaggccctccgccctttccttagatttttgtagtttttcttcttgcgtttgccgtgaaaggcgaacaatgtatatttggctgatggccccttacccttcttattgtagccgaaaatgaccttttggatatttggaatgtatgacttagtcttagtcactttttatggtcgatgcctttggtgcatgtgcttgcgccattttcgcattacgtaatatttgctctttttcgcccattcttactatgcaattcaccttttgccctatctgcactgtttagcagggtgttcgccgaaaattgtgcattcggcccctctctgggaattggcaaagcaaaaacgagaaattcgtggtgttgaagggtctgccaaaagtgcgatgctcgtttcggcctgtttatcgcgagatggtaataaatggccacagctataaggtttttaaggttgctggctggctgcgggtgcaccccgggcgaaccttagaagattacgatcgtgttcatacaaaatgtttggaggatatggttcgcttttggcgaagtcatcagaagaccgatcgacaggaggcgatctcccagcgtcgttacagtctagtctgtgtttcgcccccttctccacttagggtcgtgtatgatattagtagcgatgatgatcctagttcgcccaaccattccttagagagtgaggacggttgtgggggcgaagatataatttatctgtaggctgggctgcagagccatcgcttttctttacttgtaccatgttgtatggtttgtattcttggatgtgtattttcctcgaagtcaataaagatgtgctttatttccttttcactattttttgcattgtcacttctcgtgctttcgttaggtcggaacatgtcggcccctttgcgtgtattagcgaaataggtctatgacttttcagctttcggcttccgttttcgatctgttttattctacattgaaggaagcacttgtgctttcgttttgatcgaatgtaacggtgttcagttagttgtttctcgaaacaagatgttgcggtttcaacgttcggcgagcggtgcttcggccgattcgtttcgccccctggcattttcgctgatcaggcgtttgccttagggtttttccacagattatcaatcacacaaataagaaggcgagagacacaaagattttatactggttcgggcctccagggtggataatagccctacatccattttttttgtcttttttttcattttcctcttttttttgcatttttgtgtcgaagggcttacatagtgccgaaaggcttacataacaatatgtacatttttacatgttggcgatctgggtgccacccgttctacacatagaaacgctggagagaggcagcgttccaggaatggtcgaactcttcgccttccagtgtcgccaggcgaaaggagcccgtcctggacttgtgcttgatgaggtacggtccttcccacttcgattcaagcttgccaaccgccactgggttcgctttcttccttaggacaagatggccaggcaacagctccgtcggtcgaacttttttgttgtaagttgccgatgtgcctgtggcgtatttgcgcatgtgttcaagtgcttcgactctcaccccctccaagagttcgagcgacacttcgcgcccctcttcgcccccagagaacatcacccttggtgatgaaagatctatgtactagaattgccttgtaaggggagattggaatatctatgatcctaagagtgtggtgattgttttggtgattaatgacaacccattgttggaactaactatttccatgagttggtgagattaggttattccggcatcaagttaaaagattgaagctagaagatggacattataccttgatgaggagtaagtgaagacattgatgatgcgggggtatgaaatggctatctatggcaaaccggtgaagagaaagaaaggctcagctagaagatggacattataccttaatgaggagtaagtgaaggcattgatgatgcggagtatgaagtggctatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttcccccttcctctcttgggccggctcggcccaactctccctccctctctctcctctccccgcggcccatcggcctcctccccgcgcgcgcgccgctgacaggcgggcccgcccgccaccctcgctgacgggtggggcccacctgtcatccccgacctcgcgccgcgtccgccgcccgcccgtgccctagcgccgccgccgccgcctattccgccgcctcccgccgtccccgcgcgcattaaagtggggggaatcactccccgtgattccctctctcttttccccctcttttctctctctctctccctcggatccgtttggaatcgctcccgcaatcttcgccggcgtcttcaatggcggccgagatctccgcgcccgtttcctccctctccggccgcgctctccccctcccgacgctatataagcgttccccgtgctctcctcctccgtttccgccactcgccgcctctcctccccgtcggaatcgagcccgcaccgtcgcaccttctctccgccgtcgccaccgagctccggttcgccgccgtcgtcgctccggacctcctccccactcggcgtcacctccttcggcttcgccgcgtccccgtcgacctcggccacccctccgcttcgctcgccgaccgccggagcaccgtcgtcctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggggtttagtagagtaaaagccttttcttttccgtcggtcgtgtagatgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccatactattattgttattgatattattaccttgttcaccctagaataaacaaaaccccaactagtggaccctctatttatggttccactagtatgaatttaggtagatgcttcgctgattaataggacaacattaggtggttttataattttagactttgggtgtattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagttggtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggtaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaacccctttattattatccccttgtactcccttgcattaattatgcatctccggcgtggcttgctgagtactgtggttgtactcattcttgctctatctttctcccccccccttcagtaagagaagctttggagaagaagtcttaggtggagtcttggcatataccccagttgagcgcctgtgaagatggagccgtaggctgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagatggtatcagagccatctcgactgtaggataagccaagtggataaaacctaaggacatattttataaatgaaactatttgcgaaagctcctctttttctccttcccctaatgctatttgcaaaaggtttactcttttcttccttcaaatttcaactagtactagatggtcagctttgctaagaagaagatatcgccaattgtttgccgaagctccggaagactgcaggatccgctagcgaagcaaaggaagcagtgaagccagatgtgaagcaggagtgaagatcttggaaaacccatcgcagaacctaagccgtcctctagggtagagtcgtttgtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctttctctcccctttgttttccctctctccctctccaaatctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggactcatggtgacgtgccacatgttgacccaaaagaagcaagtaacatttgctttatgtgtgatgagcaagggcactatgcaagggagcgtcctcagcagaaaagaaaaacaccaatgcgaaccgaagatgaagtccgtaagatgatcattaccagcacagaatggcctccaccaggaatgacaagacgtcagagaagaaataccttccgaggtgcaccacagttgacagagcatcttttagctagtggaggtagagtgtctgatagtgaagattcagatcaagtctcctcagatgatgaagatgaaatggaacgtaaggcatgctctcgttgtggagaagtcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaagattaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcagcaaattgtcatccatgcatcccgaagcagtcctatagcccgcgttgca

SEQ ID NO: 32969 - DNA, 10775 bp, Oryza sativa
cgaggaggctagcaagaagataggttgggcggtcttctcttcttgtccgacttcttccgtcgcatcttttataacaaacttgcctagcaaaacttctccactctggactgcttggctcaatctcctgttgcagatggaatcttctcttcacctgacttttccctggttgcacctctagctgacttcgactggattatggcacttgaagatgggacttccgttctagaacttctcataattcatatctttggcgtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttcttggttcgataataaacacctttgctggtatcttctatcaatcacctcttaaactttgtcaaccaagtactcttcactccgagagttgtggatgcttctggtgacgatggggtcctttggcttgctgcctttcagtgaaaccttgaagtgtttcgccaaaagctatactaactgtcgttgcctttgatccgaaaaggactcatctgtaactcttagtccaaacaaatgtctctttggttaatcacttgatttttcttttccatcctcaggttggttattagctcgaggttagaatatagttcctctgacacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttctactatgggttatgattaacacgaggcctcacaggtatgacgtttgctccagtgaccacaaggcgagtgacttgtcttcttcttgcataatggccggagtgatgacgcaggttacgcttcggctgtggacaatctctcgagaaatgacctggttctttgcagttgtaacaaatcaacgtcttctttgctgagttgtccgcctgggaacgatcgtcctgactaggagttggaattggtggttggaaatccttgctaacattggcatcagtggtaccattattgctatcacccttggagtctttctcagagtcaaaattgctagggttgccattctgggtgccttcattgatactatcgtcgatatcttggtgaatgatgttgttgttgtctacattgcgttcatcttcttggggcaggaactcgtgatacccaacagaagatccgatgatctgaagtggctcagtgcgctgtctttggttaccacctgaaaatactgggatgttgacaatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttttcttcatccgtttccacatcttctggtgcatggcgagccaaacgatagaactcgtgcaggtactctgtgacggtcaaatccccttgcttcaggtagcgaaactctcgttttcttagtgtgatcattcctgcgggaacatgtgatctcctgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgatggtgcgcaaccactcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggttgcgttgatgcttctctcattcccattggcttgggttcttgagtcatcggatccatcattcccatagccttggttaccaggattatccatctgtcacaaggtagaggttgagaggggaagcatacaaggagagaatagaccagaactagagacaagaccttaaaggaactaactcttttttttgttgatgtgttgtttgttttgcttattctgcaggttgattaagcaaacaacctagcatggttacatcaccacccaccgatgcaaaccacgcgctacacacacaagcaaggaaacacacgacaaacgaaacactagagggtggcttaggttctgcgacgggttctccaagattttcactcctgcttcacagctggcttcactgcttccttcgcttcgctagcggatcctgcagtcttccggagcttcggcaaacaactgacgacatcttcttctttgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccatacaaacatgatatgaaaggcacatctttattacatcgataatatttacattattacaagggcacttcaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaatcccacctacggccgggatacccgggacaggcaggcagaactgagcccctagcagcagggcaccaaccctctgccatacgacatctcgactaccgggccgcagctcgtgtagccttcatttgccctggagaatgtccatcgacacccgacttcatccatctccaatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaacaattccatagtgtccaaatgatatgagaattcccaaagtctaaagttagaaaaccacctaatgttgcctaattattcagcgaagcatctacctaaatttatactagtggaaccatgaatagagtacccactagttggggtttttattttcctagggtgaacaaggtaataataataacaataacaataataaggtcataacaaaggtaattaggcatggctagataaaacagtgataacgcgggaatttaaataaagcggtaatgcaataatttaaatcaacataagtttacaaactgggtttcaatatgttcaaggatgatgtgacttgccttgctcagagagaacggccttccgaaccttcggcgacgaccacgaaccacgctttggaaacctccggaacgacgaaagctacgcgaagcacacaagcaaagctacaagcctataaagaagcaataacaatacataaaaacaaagcacagggttctttaggttataacaagcattaggagacttgaacgggtcgattcggagctcgtatgaccaggatatgatcatccgaagtttaatgctgttatatggagatttgcgaattattataattaagctttgcaattataaaacatgtgtaagcgctagcccggaaaggacaggaaggctgcgccgttgacatgcggaccccacatgtcaacctaaaggaccgcggtagaccgagtacacagaggcggtccacgggtcgacggaagcggatcccgtgtgtcaaccgaggcgagtggccgacaaacggactccactagacaccacacggactgcacatgtggaaaccacgcggctaccgagcggacacactaacacggtcaccacgcgcacaagctaacgactgccgacgccgatacacgggtaccggggccgacaaccgcacaacgggcacgggggacaccgaaaggacgaggacagggcagcgagggagagggaaccttaccaccacgcgacgaggcgtgggaacgacaacgacgaacgggcgcggcggaggcagacgggcgcaacggagacgaacggcgaggggacggcttcggcggcgatccttgggcgaaggcgagacgcggccggcacgaggcttgacgacgcggagccgaggacgaacacgaggacggggctgcagcgatcttgacgaagcgaggacgacgaacgagaacggcttgacggagggacgaacgccacgacgatcgggaacgacgagaggacgaggacgacgacgaccggggccggcgaggaggctacgagggcagccggcgaggagacgacgagggcagccggcaacggctgcacggaggcgaggacggcgtggaacacgccgcagcgatgacgatgacggaggcggcgccgcaagacgacgagccgggcgaccgatgggacgtcgacgacgagaacgatcggagacgacgatgaaacgatgatggcaggcagcagcggctgagcggaggaggggacggcgtggaacacgccgctgcgatgttggtgaaggtggtggtgcagcggggcgacgagccgacgaggaggaaggagaggccggcgcggagacgacggcgttccggcgaaattcgggcgaggaggaggtgatgccggggaagaaggcgatgccgcggtgtcgaaggaggagacggcggcgtcgatcggcgcaccggcgatgaacagcagccggctggagggagtacagtggcaccaatgccactggttgccggcgggggcaccgttccggcgagtttccggcgaggagacggtgaggccggtgaaggggacggtgttgcagagccgagggaggcgacgacacggccggacgatgctccggtgaggagggagaggcggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaatttggaaggaacggttggatccggggcggatttggaggaggaaacgagctagggttccacgggagtgagaggagccgggcgggaggaggaagacgacgcccgcctgacgcgcgggccccacgcggtcgggcggcggcgtcagcgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaaaagggaggagaggaggacttcggactgggcttggcccaaaggaggaagaggagggatttttaggttttctttttattgaactttgataattgtttttgttgtttaataattatttccggtgctctgaaaattcaagtaaaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaaatccacccccctttcaggaatctcgtccccgagattcgaggaggctagcaagaagataggttgggcggtcttctcttcttgtctgacttcttccgtcgcgtcttttataacaaacttgcctagcaaaacttctccactctggactgcttggctcgatctcctgttgcagatggaatcttctcttcacctgacttgtccctggttgaacctttagctgacttcgactgggttgcggcacttgaagatggggcttcggttccagaactttgcatagttcatatctttggagtcaacctcatacaagttacccacttcacgttatgcgtcgatatcagcttgtcattactaggataccatgctcgttatcatgagaatatcatgcttgtcatttacttctaacttaccactattcacttcatgttgtcctcagttagcattcaacgtattcctttacacctttgaccttgatgtgttctttcccgatttctcttatcaatcacctttcgacctacttctttgcctggtaataaacatctttttcgatacctcctatcagtcatcttttgacctttgtcactaagtactcttcactccgagagttgtggatgcttctggtgacgatgtggtactttggtctgctacctttcagtgaaaccttgaagtgtttcgccaaaagctatactgactgtcattgcctttgatccgaaaaagacacgtctgaaactcttagtccaaacaaatgtctctttggttaatcacttgattttcttttccatcctcaggttggttattagctcgaggttagaacatggttcctctgaaatgagaccctaggtctcctttgacagtaaacaattatacacataatctcatatcgacatcttctgaaagagtcctcatagaacttgtttttattacacctttctcccatattacatgaatacgaggcactgccttaaacaaaaagggaaggtgcttaacatcggtacattgcatcctcaacatgaatcatccataaacatagcaagctcactgtttctagacatgaatatatttatttattacatgattgctgcaaactttcgattacagtgataagtagcgaactgaaaatcacaaacatggttactcattctgattctggagagatatagatggcattgtcctagttactgcatcatccttgattggttctgtgatgatgtgataggactgcatattgctatcattcacaggagaaaaattccttctgattgctggttgaagtggataatggtcttctgcttggtatcaccctcctgaggttgatttcccttcgctcggcctggagtaggtcggggagagaaacaacttcttccatcgacgacaattcattgctgaggctgtcagtgcagagaatggttggtgctgaaggtattattgctatgatttattgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacactcccctggtggatggtcttcttcacaatgagggcagagtgtgagacacatgctagcaatgtgtccaatttctccgcaacgggtgcatgcttttaattccatctcttcctcgccgagacgtcggggggactcatattcataatccgaggagacttgatctgacccttcactatcagatactctgccaccatggcttaggaggtgctgggtcaactgccgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcgtgcttagtacgtgaccccacgtggtacgaaaggctaggaggaaagcaattcccgggattcaatggattctcttcattgggctctctgctttgcacactaggctgcaagcttgacttggtgcaaggaggctggtttagcgatgcctgccctgctaaaccaaaggaaggagcttctttggtatatacccatggacaattcagggcatagtgtccttgctctctacaatcctgacaaaaggggacatcctcttctggcattggaaagctcattgacctgggtggcaaatgctcgatcaaacacatactgattttggtcttgacttccaaccaatggtagctgtgaaccaagcagcatgcttggaatggaccaagggtgtacccttgttaactctcttgaggctagtggtggatggagttgaaaacttgagttactggaggcatgcctgctgacattctttcctttttctctgttaaacatctgttacaaggattgaggtgagagaggaaacaagccaggaaagaatagaccagaactagagacaggaccttaaaggaactaactcttcttattgatgtgttgtttgtttcacttattctgcaggttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactccttcacagctggcttcactgcttccttcgcttcactagcggatcctgcagccttctggagcttcggcagacaattgacgacatcttcttctttgcaaaactaaccatctagtactagtggaaaatccgaaggaggaagaaaagagaataaacattttgcaaacagcacagggaaaaggaggaaaaagggactttcggaaatagtttcatttataaaatatgtccttaggttttatccacttggcttatcctacagtcgagatggctctgataccagcttgtcgcgaccgggaaaattgccttttcccgaacgccagtgtattaatccccgtcccaagaaaagccggggtacaccacacaaacatgatataaaagacacatctttattatatcgataatatttacattattacaaaggcacttcaggcctgacaaacaaaaataaacagcagcggacttgcgggcctacggctccatcttcacaggcgctcaactggggtataagccaggactcctcctaagacatcttctccgaagctgctcttactgaaggggggaaagattgagcaagaatgagtcacccacagtactcagcaagccacaccggagatgcccaattaatgcaagggagtacaaggggataataacatagaggttaagttttgcagtaaccagcatttaaaagtcacttagttgcccaaagccattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattataacactgacttgggtacattgctcggcttgcccataaccgagggcgcggctattcgaatagattatactctgatcagaggtgtacatctttacccacaagacacatcttcctcacgtgttaccacgtgccacataccaccacggtatacagacggaagacgtgacatagtttccaacccatcctagccatagacaagagtaccgacccaatcccgcctacggccggaacccccgggacaggcaggcgagactgagcccctagcagcagggcaccaaccctctgccatgacatctcgactaccgggccgcagctcgtgtagccttcatttgccctggagaatgtccatcgacccccgacttcatccatctcca

SEQ ID NO: 32970 - DNA, 3474 bp, Oryza sativa
aaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaattaccacaaggtgtcaatgctcactttcagccccagccatcagttgacaagacagaggccagtatcggcattgtacctttggatgttccagcacagcagccaagaaatcaagtaccagatggagaacccgagcataagaaagttattgtctgttacaactgtggtacctgttaaggaagcggacatgcccatcgccaagtggtcactggagcaaatgcagtacctgttaagcctggcgctaatcagaagcaaccataatactcttatatcagtgttcaaatacttttgttttatagttgttccccgtcaatcatgtaataacagagaaacatgagataatgaatgagcttgataagtttattgagggatccgtgttaggattgcaagtgctgtgagttgtgtacattttgttgctgattagggagacctagggtctcatttccgtaagctcataatctattatgaatcaaataacctagcgattgatggcgaagcaaatcaagtgattaacccaagagacatttgtttggactaagagtttcagatgtgtcttcttcggatcaaaggcctacacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaatcctacgattgtctcgtcagctagtcagctccaacaacaacatcgatgatatcatccacagcaccaatgctcctcttgctccacctaactctgcaataaatcatggcaataatacctacagcactaaccattctctgcaccgacagccccagcaaagaattgtcgtcgatggaagaagttgtgtctctccccgacctactccaggccaagcaaagggcaatcgacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaataccagctatatctctccagaatcaaaatgagcagccatgtttgtggtttccagttcgctacttatcatggtgtaatcgaaagtttgcagcaatcatgtaatacagaaatatattcatgtctataaacagtgagcttgctatgcttatggatgattcatgttgaggatacaatgtaccgatgttaagcaccgtccctttttgtttaaggcagtgccttgtattcatgtaatatgggagaaatttgtaataaaaacaagtcctaagaggattcttttggaagatgcggatatgtgatcatgtgtataattgtttactgacaaaggagacatagggtctcatttcagaggaactatgttccaacctcgagttaataaccaacctgttgatagaaaagaaaaccaattaaactgtgttgggttaaaaagccaatgagacagtagttgggggtaggagtttggatacgccttttacagatcaagataaggattgttggatgaaacccataagggtacctgccatgcctctacattgataagttcggatatacctgcaaacagttaagaagatccaggagacatcaatgtttgagaacatagtagtcgatggttggtaattagtctatcaggtatcagaagagggtcaaaggtgatatggcagaagaacaatttggatgctccccatctcgaggaagcactaaggatgatcatcggcaattaaaccctagtggcatagatacagatagcaagcaatgtatttccctgaaggtagtcagtacagctttctgacaaaccacatcaaggtgtcactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcaaggaagacccctaattgtaattgccccgcaacagtcaccttgtcattaagtaagcaagatgacctaggtaaaagtgtttttatgaaggcaaagagtgaaatcttcaactcggtatcagatgctacacggagtgaaaagtacaagcaccggttaccaggcaatgccatgacttgggagatgatccaatgggaaagaacacatcaaggttaaaggtgtaaaggaatacgttgaatgctaactgaggacaacctgaagataataaggggaagtaaactgaatgtaaagaaagtgaatccgagttgattgttcgtgagggctattcccagttatgaatcaagtgatatgttcgaagataatctacaggggtcagattaaaagcacatctaacaacgaagcctcagatttgacagggtaatgattagacaataacaaatccagcaataaagccattggagaagacgtcaaagtatgtcaagtgggataaactggttctcttgggaagcataacttatagttagagtggttgacccttgcatcgaatagcagaagtacctagcaccggagaccaggaaagctaatatgagacagttggtggcaagttagaagtgaatgacaggcatgatatccttatgatgacaaacctggtaccctagtaatgacaagctagtgttgacgcatgacataaagtggtgacttgtatgaggttgactccgaagatatgaatcatgagaagttcgggaacggaagcatcattgaactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaa

SEQ ID NO: 32971 - DNA, 12547 bp, Oryza sativa
  unsure (1)..(12547): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcaacaatttagccaaccccacagcatttcaggtatagccccttcggcccagccggaggggagtacaggtcatggtgcgcctagttggttgtcgtcgaatcagccgggtctgggggctttgccttggagtcaaggaccgtagttcgacttcaacaatattgctcaggcaccaaccgttccgccgcaagcaccaacactaggcttcgtggcaaaccaagcaccaaaccagtccgccatggcatggccccagccaacattcgacccatccatggcagctcaccaagcatcaccaatcggagctgggcagccgaacaccgtggcccaacctcacgcgcaggccgtgacttcgcctttcgccacaccgtatccgtagcaaggtgccgtgaacagggcagggggcgaaaaggggctactgctgagtgggggaatcaagacccgtccaatcccaccccagttcaagttcccacccgtcccacgctattcaggcgaaattgacccaaaggaattcctctctatctatgagtctgcgatcgaagcggctcatggcgacgaaaataccaaggcaaaggtaatacatcttgctctaaacagcatcgcccgttcttggtacctcaatttagcagctaatagcatctactcatgggagcaattgcgcgatgtctttgtccttaactttcgagtcacctacgaggagccgaagacgcagcaacatctactcggcattcgccagaggtcgggagaatcgataagggagtacatgcgtcgcttcttgcaagcccggtgtcaagtacaagacataaccgaggcgtctgtcatcaatgccgcttcggccgggatactcgagggcgaactcacaaaaaaaatcgccaacaaagagccgcagacgcttgaacacctgcttcgcatcattgacgtgtacgcatggggcgaagaggattccaagcgatggcaagcaattcaagctgagtatgataaagcctccatcgccgctgccaaagcccaagtacaagctcaggtcgccgaaccacctcctctcgctgttcgccagcctcagccggcgaaccaaggataaccgccaaggcaaggccaagctcccataacttggaggaagttcagaaccgaccgtgcgggcaaggctgtgatggctgtcgaagaagttcaagccctccgcaaggagttcgattcccagcaagcaagcaaccatcagcagcccgttcgcaagaaggtccaaaaagacctttactacgccttccacggacgctctttgcacaccacggagcaatgctgaaacattcggcagcgtggcaacgtgcaagatccaaggccgcagcagggagcagctgtcgaagcacctcgcgaagacgttcaagaacaagcacccccggccgaacagcgccaagatgtgcagcgtcgagtaatccaagtgattacaagggccgacccgccgaatcagctgtcgaaatgacaaaagaagatgcagcatcaaatggtccacaacatcacttcggcgggcgaaggggccccacaatatctgaaccagcaaatctctttcgggccggaagatgccgaaggagtaatgttcccgcatcaagaccctctggtgatctcggccgagatagctggcttcgaggtccaacgaatcttagtcgacggagggagttcggccgatgtcatcttcgctggagcatatgccaagatgggattaccgaccctagcccttacccaagcatcggcatcgctccgtggtttcggcggtgagtcagtccaagttctaggccaagcgcaattgctggtagctttcggcacaggcaaaaacagacgcgaagagaaaataatgtttgacgttgtcgacatcccgtacaactacaatgccatcttcggctgtgcgaccttcaataagttcgaagccatttcccaccacaattatctcaagctcaagatgcctggcccggtaggagtgatcgtggtcaaggggctccagccttcggccgcttcaaagggcgatttggccataatcaacagagctgtgcataatgttgaggccgaaccacatgatccggcgaagcacgcgccaaagcccgcccctcacggcaaggtaatcaagatacagattgatgataccgatcccacaaagcttgtatcgctggggggcgacatgggcgaagaagaggttgagaacatcctagaggtgctcaagaaaaacattgataacttcgcctggggccctgatgaggtgggaagtgtttcgacagatctcatcatgcatcacctggcagtcatgccggatgccaagccaaggaaacagaagctacgcaagatgtccgttgatctccaagaagcagcaaaagccgaagtccaaaaattgctcaaggctagggtcattcaagagatcgaccaccccgagtggctggcgaatccggtgctggtgcggaaatcaaacgacaaatatcgcatgtgcgtcgatttcacaaacctaaacaaggcatggccgaaggatgatttccccttgccacggatcgaccaactcgtggattcgacagctggctacgaactcatgagcttcttggatgcgtactccggttaccaccagatccacatgaacccggccgacatccccaagacatccttcatcacaccattcggcaccttttgccacctcaggatgcctttcggcctgaggaatgccggggcaaccttcgccaggcaggtgtacaaggtcctttacaagcagttggggtgaaatgtagagggttatgtcgacgatatcgttgtaaaaagccgcaaggctttcgaccatgtgtccgacctgtaggagaccttcgacaacttacgcgcggcgggtatgacactaaatcctgataagtgtgtttttggtgttcgcgcggcaagttgttgggtttccttgtttctgaaaggggcattgaggcgaaccccgagaaaatcgatgccattcagcaaatgaatcccccgtcgagcgtacgtgtcacaccctaaaaatcctaaatatataaattgttgtttaattggaattatttttaaaaggctagaagagaagatttaattttaattaataaattccaatataaaatggggccagataaaatttcattaaatactttgtttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctcctctctctttcccccggcccaagtcggcccagtccgcagccgtccgcgcgcgcgcgctcgctgtcgctgacaggtgggtcccacctgtcaatcttcgtcttcctcgcgccgccaccaccgcccgaaccctagcgccgcgccgccgccgtctccttccaagttcggccgcgccttttccttctccggtgaaatcaatagaggggaaatgatctctgggatctcctccaccttttctcttttggaatcatcggctaatttcgtttggaaatccgtggattcgaggtcgattcggatcggtctctctcctccgaaccctaacctttccttctcgtcgccggtcgccatgggccttcgccaccgccttcttgcccctataaaaggatccccaagtccgccgctacccgtggccacccttgccttcgtctctcgccgtcggaagcgccctagcgccgtgagaccttgtgccgttgtcgtcgccgtcgctccagccgtgcttcgccgtcgttccactcgtcgccgtcgctcggggagaccgccatcatggtcgtcgtcgcatcgccgtcctcgtccgccccttcgccgtcgctgtagaccgccggagcatcgccgtcgtcgtcaagccgaaggactccgccgccttttcctcgacaccgccgccgtctgttcatcttccgccgtcgttttggtcatcggtgagttcgccgcgtcgcgctctacgtcctggtgccctccgtttgtgccgtagcgccgtcgttcgccggcgagcttgcgctcccgagccgccgccggaggtgacgtcgccgctgacgtcatcgggaccgtccgccgtggcccggtcgtggaccgttcgatctcagccgtccgttttggataggatcgatcccgaccgttcgttcccgcgaaccgctgccgtgcacccggtccaccgcaaaccctagccgctgacgcaataaaccctttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcttttttgcttagattccgacgtttccggagagtccgttttcgcaggagaagaatttgaagagttccaaggccagcaaggcaagtcacacagattccaaacaaccctttgagcatgttgatcccgtttaaagctactgtttctattcaactattgcatttattttcgaatgtcattgggtggaattaacctattgtttgttatagcccctttgttcttgcttactttattccttgataccttgggtgtttataactcgactagttgggctatatatattggttcagctagatattagatgtgattgcttagccatgcttagaaacattagcacactattgggataacttatgattcactattaattaatgatggcttaatgatagttcacgatggtcaatcgtgattggttaattaattatttgccaattaaaacttgataatggtgggttgtgagcacatggttttgagagatcgtgctcatgacaattaaggaccggttcacgagtttcggttgtgaaacattaaccgtgccaaccacaagccagcgtgggcaacggctttacctttggtatagcatggttcattgcggagcaccagactgagaagtggcggagataagcccacgggggtcgctggggagtccatgccttgtttataagggggtgattatgatccaggaaaggtgcgctgcggtggattgtgttgtgcgaggggtattgtcacagctcctttccgaggtaccgtggtggtattgaggcacatggagacatgatgtggggctgtgtcttgtgggtacagtggtacacctctggccagagtaaaactattcgaatagccgtgcccgcggttatgggcgggtctaacaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatatcatatactcaccttgcaatcactcatcagaggaagggttctacagtgatgctgatggtgtggaggattaggtgtagccctggtcaagctgcctgtggagtggagtcgtctgcgccgtttatcttatctttccgctgcttagatttttattgattgagcggaactatctacctctgtaatgacattttgttcgcttattaattagagtaataattgtactcaattatcaatttgttattgtgtgcctcggctgattcttggacgagggttcacacacatgtaagcgtttggaattttggatagaaattctgggcgtgacaagttggtatcagagcccccttgaccctaggttatgccaaacggttacccatagaagccctctaaaaatattggaaaagtagaactgttctcctccccttctcttttaattaaaccaaactaatagcacatgcaattcataatctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttagatgccgtgctacaagcctgagtacttgtttggtgttgagggatttgtccaggagttgcgtacgatgtcctttgccataggatttgggactacccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatctctaccatcctcgcaaccacagggaagtgaccgtggcagctaccttgagactgaaggaattgagaatgatgctaccacaaagcatttggttgagatgctgtgggctatggatgaaacccgtgcagagactgtgttagcagctcaagatcgtgaagaccggaatcatggtaagatttgcaagctataggacaaagtggatcgtttagagaaggaactagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcgaatcctccggtcgtcaacgtaagtgatgatgaaggagaagaatccaagcgcacccattccaagatcgagtggggagcaactcaagatgatgaagacgagccgaacgagccttcaatcaactccgatgcccggaagaactagaatgccttgtcaaacagttgtcttagatcgttgtgttagtttgcttgttttaagtttggttgtgtgtgtctcgcatgtgatttacatcagtggtgggatgtaagtccatgcgtttgtttgctttcgagtgttaggtagttggtgagtttagtggtgtgagagtctttagttttgtaataatgaaactcacttaagatcaataaaagttaaattaattctctgtcctaagtagtttttcccggtttctcttcttgtgatcctgcccatgccagatggtgctcactcgcagcaacgggaatggccccaacaacaacaataacaacaacaatggagagaatcccacacttgcccaagtcctggctcaacaggtacagcttatgaacataatgatgcagcaacttcagaaccagcagaaccagggaaataatcatgcacctcctcagaacaagttagcagaatttcttcatgtgaggccgcctactttctctagtaccactaatcctgttgaagctggcgattggctgcatgccatagaaaagaagttggatttgcttcagtgcaccgatcaggagaaggtctcatttgcatcacatcagttgcatggccttgcctctgaatggtgggatcacttccgcctgaacaggactactactgaacctatcacttggcttgaattcaccgctgctttccggaagacgcatataccatcgggagtggtgtctctcaagaagaaggaattcaggtcgctcactcaggggtctcgctctgttactgagtatctgcacgaattcaatcgtctggctcgttatgctccggaagatgtgcgcactgatgaagagcgacatgagaggttcttggaaggacttaatgatgagctttcttacccactcatgactggggattatcatgatttccagaagttagtggataaggctattcgccaggagggcaagtacaaccgcatggagcagaagaaacgccggattgctcaattcaaggcacaacaagggaatagtcagaggccgcgtcttactttaggaccccagtccatgcgacagggaggttcttcgtctgttgttcgtccgcagcgtcagttcttcaacaacaatgcgggcaacaacatccgcaatcaagctccacgccctgttgcagcttcgacacagcaacagcctgccaagaaggagcaaggcagcaagcccgtggtgtgcttcaactgtggagacccaggacattacgctgacaagtgtccgaagccccgacgcgtgaaggttgtccctgcccagagcaactctactgtaccagcatcaaaggcccgtgtcaatcatgttgctgctgcagaagcccaaggtgctccggatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcctgttagaatccaaagaccttgatgtcatcttagggatggactggttagccagatataaaggtgtgatagactgtgccaacagaaaagtaactatcaccagtaatgatggtcgagttgtaactgttcatgcattgtcttctgagcctttaaggtcaagactgaaccaaataactttggaagagattcctatagtccgggagtatcccgatgtgttcccagacgatttacctggtatgccgcctaaaagggatatagagttcagaatagatttggtaccaggaacgactccgatccataagagaccttatagaatggcagccaatgagttggcagaagtcaagaggcaagtagacgatttgcttcagaaaggatacatcagaccgagttcatctccatggggagctccggttatttttgtggaaaagaaagatcatacccagaggatgtgtgtagactatcgtgcactaaatgatgtgactatcaagaataagtatccgctgcccagaattgatgatttgtttgatcagcttaaaggtgccatcgttttctccaagatagatcttcgatcagggtatcaccagttgaggatcaaagaggaagatatacctaagacagcttttaccactaggtatggattgttcgaatgtactgttatgtcttttggacttaccaatgcccccgctttcttcataaacttgatgaataaggtgtttatggaatacctagacaagttcgtggtggtctttattgatgacattcttatctactcccgaaccaaagaagagcatgaagaacatcttcgccttgcactagagaagctacgagaacatcaactgtatgctaagtttagcaagtgtgaattttggttgtctgaagtgaagttccttggtcacgtcatctcagcaggaggagttgccgtcgatcctagtaatgtggaatccataaccaattggaaccaaccaaagacagtttcaaagattcgcagtttcttaggcctgcaggaatataatggaggtttatagagaatttttccaagattgctaagcccatgacacgattgcttcaaaaggatgtgaagtacaagtggtcagaaaatgtaagcagagttttcaagagttgaagaatcgcttaatatcagctcctattttgattttacctgatccaaagaagggtttccaagtgtattgtgatgcatcccaacttgggttaggttgtgttctgatgcaagatgggaaggtggttgcatatgcatctcgtcagttacgtccgcatgagaagaactaccctactcatgatcttgagttagctgcagtaattcatgcgttgaagatttggcgccattatcttttcggtacttgtatagaggtgtataccgatcacaagagtttaaagtatatttttactcagccggatctgaacatgagacaacggagatggttggaattaattaaggattatgacatgggaattcagtatcacccgggaaaggctaatgttgtagcagatgctcttagcaggaaaggctattgcaatgctacggaaggacgacagttgccattggaattatgcaaggaatttgaaagattaaatttgggaattgtcagaagaggtttcgttgcagccttagaagcaaagcccactctaattgatcaagttagagaagcccaaattaatgatcctgatattcaagaaatcaagaagaatatgagaagagggaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcgaggaaagattttggtgggcaagtatgaagcgtgaaatcgcagaatacgtagcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtggtagtcgacagacttaccaaagtggctcatttcatcccagtaaagacaacctattccggaagttggttggcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccgtagacagacggacaaaccgaaagggtgaatcagattttggaagatatgttgagagcttgtgctttagacttcggtggaagttgggataggaatctaccttatgcagaattttcgtacaacaacagttatcaagctagtcttcagatggctccttacgaagcactgtatggtcggaagtgccgcactccgcttttgtgggatcaaacaggagaacgtcaggttttcgggacggacatcctaagggaagcagaagagaaggtgaaaatcattcaagaaaggttgcgtgtggcccagtctcgtcataagagttatgccgacaatcgtcgtagagatctaagttttgacgaaggagattatgtgtatcttcgtgtcacgcctcttcgaggagttcatcgttttcacaccaaaggaaaattggtaccgcattttgtgggaccttataagattgtcaatagaagaggagaggttgcttatcagttggagttacctcaatctttggcaggagttcataatgtgttccatgtgtcgcaattgaaaaagtgtttaagggtacctaccgaagaagctaatcttgaacagatagaagtccaagaggatctgacctatgttcagaaaccaatccgtatcttggaaatagaagagagaagaaccagaaatcgagttatccgtttttacaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctacaaatcctaaatatataaattgttgtttaattggaattatttttaaaaggctagaagagaaaatttaattttaattaacaaattccaatataaaatggggccagataaaatttcattaaatactttgtttaattctataattcctagatttttctgcgatttatttgagctaaggaagtatttttaataaatggaattgcatttcatgaataatttaaattgaaaaaggtttttaaaagtctcttttagctttgagccgaaagtcggcccaaaacctcctctctctttcccccgcccaagtcggcccagtccgcagccgtccgcgcgcgcgcgctcgctgtcgctgacaggtgggtcccacctgtca

SEQ ID NO: 32972 - DNA, 408 bp, Oryza sativa
tatttcacttgattaaattgatttatcttttatttaatttctagaaaatgtattattaatgatttttaatcccgaacgaaaatcggggcgttacaccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgctcgccgaagccgtcccctcgccgttcgtctccgttgtgcccgtctgtctccgccgcgcccgttcgtcgttggcgttcccacgcctcgtcgcgtggtggtaaggatccgtcctttcgcttcccc

SEQ ID NO: 32973 - DNA, 540 bp, Oryza sativa
ccaaattaacgtccaaacatttgatgtgacatggactaaaaagtagttttagccccatctaaacacccactaagccacctcttgtcatgctttctccttcttggaagcataacacaggtacttggggtaaggctggatctctgctcgtggacctgtggtaacaattttattggaaaaagtatacccaaggtccctcaacttgtcattggtttatcgtatacgaggtcatccgaggtccctaggtggttttgaccccggttttgatctacgtggcggctgagtcagcgtgggacccacatgggccccacctgtcagctggccacgtcatcactctctcccctcctctcctcctctctcactcttctcctgtttgggtaggcagctggggaggacgtcggtgggttgctgccttctgtggggagaggagggagaggactagggcgtcggcggccggcgacgggcgacacgacgactgcggctggcgactggcgaccccccgccgccattgctctcgtccgccattgcagaagccacaggcac

SEQ ID NO: 32974 - DNA, 1648 bp, Oryza sativa
gccgccgccgccggccgccggacctcctctcccgtctcgccccgtcggtctcctccccacccgtcggccggcggcgcgggcttacccacagcaccagagagaagagtgagaaagagaagaggaagggagaggaggggaaagagagaggaactgatgtggacaggctgacatgtggggcttacgtgggtcccacgctgactcagcgccacgtagaccaaaaccgggtcaaaaccacgaaggacctcgggtgactggttttgtatagttaagggactccgcatatctggttttgcggttcgaggacgtttttatcccgataacaagttgagggaccttcagtgtagggtttagggttgtgcgcaccggatcgtcgagagactgcacaggcccaccaaacatgggctgtgtttagaccaaagtttggatccaaacttcagtcattttctatcacatcaacctgtcatacacatacaacttttcagtcacatcatctccaatttcaaccaaaatccaaactttgcgccctgaactaaacacaaccatgaaaactatcgctaatattgatggtaaacgagggtggttttaaagttctagcaccgtgcgataaagtttggttcacgctaaaattaaaattttggttaaaattggaacgatgtgatggaaaagttagaagaggcaagcacccactcaactagatgctaaacatttcattaggtcgttctgaggtggaatcgaaccactctgttgcgattattaaggcagggtgctactgtaccagtagtagagtggtcaagtttgtatgtgtagaaaaattttgatgtgatgaaaaagttaaaagtttgaagaaaaaatttataactaaacttggccttactttattattactaatccaactaggattgtactgatatggatcggcttataacctgctaactacgagtaagttttattatacctgttcttaccaaagtcttgtgcactgtagcatgataatacttgcacgtagtaatatttggggcttttaactatagatttggcaaataactatttgccacccctatcttaatgacatatgggtccatatgtgtctatgacatatgagtctagtggtaaaaagttaattgccacatcaaaatttgataaatggttaaatatctcagtaatatttggtcgacgtgcaagtggaattgtttcggaacaggatcgatcatgcaggcaggatcagcgagaatctgtagaatctggcagccgtggcatggtgctccgtgcacgcaggcttagcctcgctagccgccctgcagccgtcggcgagtttctctgctccctgctgtgctgtctgcgagcgctgcgcccgaggccgccccgacaccgctgagtcgctgacacctcgcgacaagcctggaccaaagcaccggctgcacgagccgaacgtatccagggctttggctcgtactcgtactacgcccagtgcatcatttaactcgtcacagctttgacaggaatgttaaaaaaaaaaagctttgacagggagcaggcaacaggagtatgtgaatgttcatcgatctgcagaattcatctaacctggacaaagctcacctgttacagctagtacctcttcttgctacagtagcaatttcctgatgaactt

SEQ ID NO: 32975 - DNA, 409 bp, Oryza sativa
ttttctttagcattttgatctcgagtactttgttgtcatttgtagagacgttgatgtcgagaatgtccagcagcgcgggcaacctgagttgccagtgttatttttgttggcgacgacttccttaggttggttatttttgttttcatctcatttactctttcgtctggatcgacttgctttgctgtgttctcgggagaaaagagcagtttgccttagtcgtttccatgctaagcagacctcgagagtgcgcttgctgaccaagatcgccgcatccagtattggaggacgaaatttgaggtcgcggaactcgagaggactatgctggaggtgaagaaggaccaggccgtgcaaacactccgaggtcgcaaggtgtggttcagctcatatctgaagagttgctgcacgtcca

SEQ ID NO: 32976 - DNA, 612 bp, Oryza sativa
aacaatattttttgaatagatcctcggtgccagttttgttgacattgaccactctatacatcttgactgtttgggacgtgatgatgttggctgccagtgtcattagcgctgagtgctgagatgttaagatctcgacctcgacgctacagtcatcgagtcattccaagatcaagttagtttaagaatctatttgtaaaataaatttatagaacaatcaaaatataggggaaaaaaccagcatgactgcacggacgatctgcggtccgcgacgcgagcgattaaatgcacggagtttacgtgacaccggccgtggcgggccggaggagtacgtacgcgctgcaacgcgcgtacgatctcccgtgaaccgcggggctcgtacgtacgtactcaccggccgttggagagaggcccccgcggccgcgcgcggcgcccccaccgaccggatcgtctccactcacgtttgtccaccgtaccacgcccgatcacgaacaaacggatggatggatcgatgcatctgcgcgcgcgacgagagcgagagtgaatgagctcatgtgcgcacgcatggctagctgcctgcctgccctgcatctgcgtgacactgttgagagtagt

SEQ ID NO: 32977 - DNA, 1379 bp, Oryza sativa
acggtgtttgacgtgcaccgtggatcttattattatcaatgcctgaattcaccctagttaattatgtgttccagaattctgatacctacctccatctctcttaactcttgcagagtgtgtctgactgaaagtgatggcctcttgcatgcacgtggtataattcacatatatatcgatataagatgcatatttttttcccaagcgaaaatggggggaaaaagttggaaaaaaagatgtttaattttcagtcacctgaaaatatataaccacaaattccgttcacttttaaatggcttagattgtgcaaagattcgtacaatgcaacaaccttatcttctcccccttgcggcacgcttctccaacccatcgcgagctcatgcaagcgtacgtgtaaggccacctagatatgtctcctcggttctgccactcttctgtaagacgaacgacgatgagctatccttggcatgccttctttatcttctgtggctctcccgttcctagtcactccagatattccacgacccaaccaccaatcaagtgacttaaccctatttgattcatcttagaattattataatctgtattataaggagtaagttcaaacaaacaaatagattattatgatagattatcgtaatctataagccagattagtgtaatctaataatctcctttggaggagcctttttttgattatgggttggctaaagacccactatccttagatgcctccaataatccagagaaacaaacagctcacagcttattctatgtcatcttattataatccatcttagagtaatctaaatttaataatttatattacaataatcttaagctgaaacaaacaaggccttaggtggtgccaccgtgccttgccactcgctcgtttcgctgtcaccccttccatccctctaatgtcgagtaaacctccttccccctccatcaacccctaccataaaatcctaacctacaacaccatttgctctcgtgccgtcattgaagcacggatcttgatatatgtgcatcttatgttgagcaaatttgaccagaattttgaagattttaggcgagaagaaatcttgtgatccccccttccaaaaaaaaggaaataatataaaacccaatcgaggtgagcactatcgtttgcccttcagcttagctgtacctaaaatttaaattttaaatcttaattttagagttgattttgatgttttttcatcatagtttattttttaatgttagtttttaagtcgctaaaatacatataaaatttattttctgtccaataagaattatggtttacaatcaattttaggtaaaacaatgtaagcggtaacgatgcgatagagtattatggtttataattagttttaggt

SEQ ID NO: 32978 - DNA, 1409 bp, Oryza sativa
tcagtgaagcacacaagctcaaccccatattttttgctattaatcgtcttcaaacacctgaaagtaggtaagtgattcaaatacatataactgaatattgaccgccaaaataaaatcactacttgacaaaatttagatataaatcaaatactttgaaaacagatacagtattgaaagaaaaaaaatacaagcactagaataggtaagcccttgcccttcagaataaaatgtatgtagtactgcagtacagtaaaacaggagctgaaattgttgtacaaaaaaaatcaagactgagtgactgacaactaaatgcaaaaagggcaattactaccttctttgatttttataaggcttattctaattttaaagagtcctcaagattaaattttgaccgttgttttctcataaaatatattctaggtatccataaaaaatattgagcaaaagagctttgaaatgtgtctatattggcttttacactaaatgtacttgtaacttgataaatccttgatcaaaatcaacaaacttgagttttgaaataaaaatacaccttataaaaatcaacagaggggatgaaagtaagagctgttcaaactgtttacacatggagacacaaaaaagaacattgagattaattgtttatactcacacagcattttgaatgtcatataggcgaattgattcatcatcacatgctgtcacgaggtaatttgtagccttgctgtggaaatccatagaactgattcttccattctgaaatacaaataagccccataagaagaatgaaatggccagtgcaagaatattttaactaagtcagtagatactaggcaacattctaatgtaaagtgaaatatgtacaaatggttcatcaaagaatatgtactgaatatacattaattttcagagtacacattgagattgctaattgacatcccgaccaacatacccgcaaggaattattgaagaaagagcagccaagaaactgacaggtgtgattgtacatgatgggtgaaaggcccgaattaaacaacagtagcatgctctacagttagactagatgaatttctttgttcttcacattctctgtttagtttcactcacactttatgaattgctaatatctcacgatatgaaatgtaaatatattaagtacaccaagagataaactgatatcttttcgattggttaacattgtttacaggacttattacatgcaaaaaaagtttccagtccaagctaccacttagctgtcagggttgatctacttagccctctgactgcgaaagtgtctagataaccccatgaactatctaataccatctaaataaacccgataaggttttacacatgccttttgccaccatagcagctaatgtgtcaatgcttcaacaaatctatactccatt

SEQ ID NO: 32979 - DNA, 713 bp, Oryza sativa
caaagttaaggcaaagagaggaggtgtggggtagagaaggatgagaatgagagaggatgcgcgtcggcgccggtgctcaccggaggcggaagcagcaggaacaccgcaccgccgctcgcgggatggatggagatcggccgcaggcgacggggcgaactcctcgaggagacgggagtcgaggccgaggcgacgccgggacggggagatggactcggggtcagaggcgagagtatgcgatggaagcagcagggcgcccggcgacggagaccggcgcgacgacggcgcaggcggcgagccaaggagatgacgcgggccgcggcggcgtcgtcgggtagcggaggccgcgacgcacgcagcctcagcgtccgcggagtcggtggataaatggaccgagcccagccgtgctgtcccgggcacgatggcgcgtgggccgtgccgtgcctggaccggcccgcggtacggcacggcctgctcggcacaccggcccacgtgccaccatcgtgcccgttccggcacggcacgggacggctcgataaagcagccgtgactaacgggccgccgtgctgtgcaggtgcggcccagtttaccactaaaacgcgggatgtataggtatgggaaaaagtacaccgacggtccctcaacttgtcatcgagttacaaaattgtcccccaaccataaaaccagatatccaacgtccctcaacttataaaacc

SEQ ID NO: 32980 - DNA, 208 bp, Oryza sativa
agacccaccagcggatgcttcttgtcggcggcggtgctcgccggctcgaaccgtgcgctcctgctgctgccgacttttgctgcggcggcggcgttcttggaatctgtggagcgtggagggtacacgtccgggcgccgacgacgccgaggcggaaatgccccacgcggtggccggcggcggcgggggagccgacccggtgctgcggcgc

SEQ ID NO: 32981 - DNA, 2630 bp, Oryza sativa
ttttaccacgtcgcatataattctttttttttactccgacagatttgttttttaatattttggctctttttttactgcgtccacgcagattgttttttttggccggacttttttttcacctggttttttttggcgcccgttttttaggaatcagacagattccttttttatttcttcgcgcccttttttaccgtggaatcggatttgttttccttttctttttctcgcccgttttttgatcagacagatttgatttttcttttcttttttcgcccggtttttcgcccgttttgttttggatcggacaaatttttttcgcctggttttttttgtcggcaaaaaaaaagtggtgcaaaaaacactagatccaattcctttaaaacagaaaaaaagagaaaaaaaatgtgattcctttaaaggcgaaaaatgtgacgacaaaaatggttcctaaaaaataagaagttggttcgtataaaataaaaaatgcacgcgagaaaaaaatggaaagtgcgaaacatagtggtgcgatttctaattactatatatctcttctctatctctaatctaatctaactatttaaaaatagaaaatgcacgagaaaataaaaaccgttcaataaaacgtgtgagaaaaaagtcagaaaaagcgcaaaaaaacgctaaaaaatgttttccatcttccataaaacaaataaaaaaatgcgcgagaaaaaaacggtcagaaaaaacgtgccatttctaaaaaatggtttgaaaaaaccgtgcaaaaaaaacaccgtctattaaaaaacaaatcgctttgaaaaaactgtcagagaaaatactaaattgatggatgcttgactcggataggatccatcgattttttgccatctactatacggcttttatttcgtcatatattctcctgtattgaaaaaaaagcaaaaaaggacatttgaaaaaacaagcaaaaaaaaagcgcgagaaaataattgtttgaaaaaacaggcaaaaaacacaaaaaaataaaagaaaaaaagggagaaaaaatatggtttttgtcgtcagtaaaaaatgcaaaaaaaaacatgctatgaaaaaaatatttgaaagaaatacgccatttctaaaaaaatggtttgagaaaatcacgcaagaaaaaaaacaccgtttataaaaaaacaaaccactcattaaaatacaaacattgtcattaacatgattatacatgaaaaacatatattatcattagaatcttttcacccattacaacgcacggatataatataaatataaaagcaagaagaggaaataataataaagggagcactgtatgaggtagctagtagcttggtgcggtgccgagcgcgtagctcttgagaaggtcaccgcagatggggagtgggcgggtctggaggctacattacctggatacttcccaaaagctacgtatccgtatctgatacgtggaaggatacggatacgtatcggatacgtatcccatgtgtatcggcgatattggtgattttcagaaaaatcaaaaaaaaaatctggatactcccccgatacgttgagataccttctggatacgatcgagagaactaaacatcgctttatcctgcaactccacgccgttcgtcgcttccgtggttctcgcatatggcccgacaccccacgcggctcgcgactcctagcgccgctgccgctgacggacgccaatcgcagagttgtgcgccgtcgccatatgcgggcgtaacaccggatgctgaatgcagtgctgccgccgccaggcatagcaccgccgtccgccgccggcgccatctccaaccaggcaaccacttacttcagcagtgaggcaagcaagttccatcggtcgattcagttgttggcctctcccatgcagctatgctagtgttagcaatgattttctttttcttttttaacttcttgtccctctttctattttcttggtacaaagtgctacttttagatcggatgaaatttcggattggaatatcaagtgctaatgcatctaacactctcgacgtgtatgttcattacactcttggaataaacctgttggcaagttattggcaagttggcagtcttcagtctgcatcatcattctcggggttaaatcgcttcaccaaccttagtcaattacaattattagaaaatatttccatgacattatacgagcttatttccatgcaagagttcataaatttatatattaaatttttatattgttaatatatatatagacgtatccccgtatccttagtttttcacaaatgccacatcttcgtatccacgtatcgcgtatccgtatcagcgtatctagctaacatagtctggaggaagccgagaggattggcgcggcggaccatggtggcgaggccgacgtcctgaacgagggtgaccggcgcgcggtcgcgacccacctccatctcgtggcattcggtcaccgggctgctgagcagcgccaccgcgcacaccaactcggcaccgcggttgtccacctccaccagctccatgcggtagtgccccgtcgcgtccgttgtcccctccgccgatctctccaccgacccgctcgcgctcatgtagtgccggcactccagccgcacccgcgcggcctggatcgccgt

SEQ ID NO: 32982 - DNA, 2377 bp, Oryza sativa
  unsure (1)..(2377): unsure at all n locations
cgaatgagtttgcacgttacaaatgccactgctttctttccgtacgtacaaacgttgtacatgattgaaaacaaaattttcctaatcttcgctggaagaaaaaacatatacatgtacataaaacagacagaaaaaacatacattcaaatatgaatttctacaatataaagataaaatatattacttcccaaatataaatatatttagttaaattaagaactataagaaatatccaatcaatgttcttttaaaccatcttctaaatctatctgttatatactaaaattacattaaactttctctcaaataaattagagaaaccctagaaatctattatatactaaaattctattaaatgtcttgtaaacactactacattatcgcgtgacgctctaataaaattagagaaatcctagaaatttagagtaaaaaaagaaaaccatccaaccttgaatttttacttaaattattagacccgctattttaaacattggattagagctcttaaaattcccatgtgttgacgcgaaaaacacgcactggtctaaatctggcacattaaaattccctagtttaacatatccttaatacccctgtcacagtaaatctggcacacgcggacctctcaggttgcctcccgtgggtgactccaaggagccctcagcagccctagtcgtcgccagctgcctcaacgcctgttctgcctccgccgccgccgttggtgacgatggtggtagttttttttaccgcccaacaccacgatgaagtagatcggagagatcaacaccatgtgcgaattagcaggaagatcggtcgatcgctgttgtgaccgtgctcgccatggatgtcggaggagttgaatcggtagttagcaaggacaccccttcaccgctgatcctctcttccaaccggcaatccgctttgtntgggtcgataaacatgcaatgcggaggacatcacatcaatccgaacgtgatccaagaagggatattggtctagctgatgaagggcgcaatggcaccctcttatccggttgtgccaataagttccatactgatctgttcagcgataattttattcatgttttcggtagtccggttcgatgatggcttctttcattcgcttggtggtggcagatccagtaggctagtactttgtccttggtggctacacattggtactgcttggtctgtatagttagcaatctgatatattggttgcttggtcagcgaatgctaaaggcggttttgtggaattgtggttatgatcagattgtgagtggattgtgctaagtccatccagatgatggcacagagtactagcaatcactccagagtgaaaacctaatgattccacaacatcgctgcttgtgtgttattcctttgttgaaggtgtgatgtcaggcttcgaataacaatctagccttgtgttccaatagcagcggcagacaaaatgtcatgtatttctcgagggcgttgtttcggagtaaataactaggattaacctcttgtcttggttctatttgagtgagctgctacaagacaacatgatatgtttaggtttgtcttagtgtttttttctattttatttttctagacttttgtgcatccctagttgggtcggatttaattttatttttaacaaaactcttccccttatcttaaaaaacactaaaagctggtaacttcaaaaactcacagaaaataacatttcctcgaaatcattattctactgcactatttagagcatttgttctaagctattctgaaaattctatttataaaaataattaatttgtagacaatccatggtataatagtccgttcaaatcgggataagtccattttacacccctcaactattatatttatctaaaatacacccttaactttaaaatcgggtattagacgcccctcatctcttaaaaccatgcaatttatacccctcatccaaaccgctctggttttttcttaggaggcaatccagtcaacctaggaccacctgtcatttttcctttcttccttctctctactggagcagaacgaactacgcctcactctccggcagcttggcgcaggcgaggtcaaggttgagcggcacattcccgagcccttcctttggtatctcggcacaggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32983 - DNA, 764 bp, Oryza sativa
tagtctattgtattagttgtttgtaatattagctataaaatgacatggagataatggagccagcagcagactatactattaaccttgctcttactccagtatatactcgctggcgttgtcagaataaagaacaccggaacgagttgcatgtgtatcatgtgcccagccgtccaagaacgattcggctcttcaaattggccactatcaagccagcacgctctcgaagggacagcataaatgaatcgatctagcgaaatctaaagttgaattcttttcccagttcaagcaagcgcaagagcgaacaaacggaagtggctctcgtcggtgatccacgcgcgttaagggtggggagaggaagagagtacacgcgcgaatgaagaatcaacaccgtaccagcggggattccgatgcgattgacgatttttgttgatatatgttcccatacatgttttctccgtgggaatcaatgtttatatcctattcgatactcccatttcttttacttcgcgggacaagaacccaaggccgtaatagttgtaactttgtttagtgggttttctttgctagaaattctagtcataaatcggtatattttaatccaatagcataacataataaacatgatatatacaataaagaatggtttttccacggtgataaacataaatatgctagcaagaacagtagcaactaaaaatatgtttaacactgaaataagaaaaacataacagagaaagctccggatatagaagaggaattgttgg

SEQ ID NO: 32984 - DNA, 409 bp, Oryza sativa
ttggtgtccacagacgacgccggggacggtctcccacatcatcgcgccaccgccactgcccccgccccaccactacccccatggcgaggagccagtgacaccgtcccgccgagggacgggtcccagcggaggaggaagtgggggccgacgaggaagtcgtgggtgctgtgggcgagaggcgagaaggagagcggcggcgcggcatcccggtgccggagggaggacgacggcacggctatcgaggaatgggttgttgaggcggacgtggtcctccttggtagtctgagttaacgagagaaaagaggctaggggtaggggaggaataggaataaatatgtgggctacgtgggctgggacatcctgttgtgggctggagtgtctccacccggttacttcggattttgaagag

SEQ ID NO: 32985 - DNA, 4316 bp, Oryza sativa
aaatcacatggtgggctgtggatgaatggttttgctggtcgcacccatggcagttaaggaccggttcgcgggatgccctggaagaacttatcgtacttaccacaagccagcgtgggcaacggctgggcttgtagtgtagctttcctctagtcaacgcatctaggcaagggtgggcgtgatggagcggggcaggccctgcgacggcctctgtcgcttccggattcacctaggcacgagaggggactgcccactgccttgcgcggagtgggggtgaaacctgaggtgtggtgtgcttggttagagggggttatgcgaagggtcctgtcacggcctctttccggtatgtcgtggtgacatgtcggcgcactgtaacgtgtcgtggggctgtgtcttgtgggtacagttgtacacctctgatcagagtaaaactattcgaatagccgtgcccacggttatgggcggtcaaccagattcaccgtgattagtctcaccctagtgtaatcttttgattttggatagtttaggtggatggttgggcctgttgcaacgtgggatagcgttggacagtggatagttaatgttaattaattattacaactgtttaaatctttcaacttctgtttttaaatactcgctttatgcaaagaaccactttagctcttctttgataattccctgcatcatgcctctattccggtatgacttgctgagtacagggtagtactcagtcttgctctattttccccaaccccagagtacgagtatgtgtcagatgaaggtttctccgaggagtaggctttgtccgtgccgtcgaggatgcctgtggagtggtgttcccgctgcagatctagtcaaggcttagctcctgttgtctttcgtttttccgctgcatttatgtaagacttttaagatgtttgtaagacgtggatctgaatgtcaacattgtcgtttgtgtaccccggccggtcctggacggggattttaatgcacattctgcttggaattctattcgggaatttctgggcctaacaccaccgggccgtacacggcagcgtgattaccgtgctcggcagcaaccacatagtggacgatgtccgtgagatgccgatcgtcgaaggcaccggcgcctttcgctttgctcgaggatatgtgcaggcacacacctatgtaggatcaaatcacaagaactaagccaacaagagagggggtgaatggttggtataccctaaaaccgaaaacttttagcagaaataaaagttaccctcgaaatcgacggaagtcggtctgaccgaagatgttctgccggtctgaccgagttgaatctccggtctgaccaccgagatcgcttgctgcgcctgtcaccgccgccggtctgaccgccgtgctcccgccggtctgaccgccgcaatgccaccggtctgaccgccggtgacttaccggttaaaccgccgaaacccggtgaaacacaaatcgaagaactcttaaagtagatgactttattgattatctctatgtttacaaagtgcaccaacagcactccttacaaaaattttgactaaacgcgaaatcctaactcaaaactcaactcaattgctctcaaaagcgataccgggaagcctcacgctccccctctatttatacatgaggtaggtagcctaaaaccacgaacaaaactcatactaagagtcctaaacacattaggaaaccctatagtataagaaagaaactttacataaccaatcgtatcaaatttggactccttccaaattcgactctgcatcccatacgcacacaatacctccatcgtatgccatatggaatccctatcaaccacgtgcatcaactctagcctaagtatcccgcatgatctctgaccaccacggacgttgtcttatccccaagtcgactcccggtccatcaccgcaaatactctctcgagacatcgagtcacctacacatgaaataaacaaagaaaccatattccaagaccaagctatctctaacttgactcattagtagcaaacaacagtattacatacgtatagtatccatctagaagtcataaccatgaaataatcacggatatccaaataaacaacctgaaactgaaaccgacacagcgtcggccggtcagaccgcgggccggccggtccgaccgctcgatcaccgccggtctgaccggcacacactgcccggtctgaccggtaagatgaaataacataagtatcctgtagattcacctgtgaaatccaatcatctccaaaaccacttcgtgaataaattccaaataacaaaaccaataatctccaatgcccaattgttcatcacagaataataatcaaaaacacctttgatcttacaatctcccccttgatgaacatattggcaaactcataaaaaatgttttggtgtttggaaaaataaaaaacaaaagtggtaaaaagcacacttcgtacaaatgtacacatcgtgcttgaaaatccaaaagaaaacttctccccctttttaaaagaaagaaattcccaattgaaccaaaaacatgctcttctcaacaactcttcaaaaattttccttgcttctccaaaaatccaaaaatccaaaaaaaaatttcacattacttcttccccttatgacaatgatttcatcaagcataggaattatgttcattaatgtataagagcttagcatacatatagcatatcaagtcatgtgttgcaattaaaagaagatgaacccatctataatagaacaagcatgcattaaagtatacccatgaaccaaagattttacaattaagcttaaatcaacaatcaaaattcatgatttcatacaatttataatgcaacatctgaacaagcacataggttgaaaaataaacactaaacacatatacctattgcatttatcactctttctcaaataacctttagcacaaaataaccaagagaatttttgaattttttcttttcttgagcctttttgctcatatttttctcttttattccaggtacatccctgtcgtcaagactgtttccagggattcagcacccattattttgctcacatcgaatacgtccttgtcgtcaagactgtttccaaggattcggtattcatttttttcatatttttattctcttttcacaatgagcaattaaagctatttgaggaataacaattcaataaagcatatatatatatatatatatatatatatatatatatagcatttacaaatcaaaccatatgctagcatcaacattgcatatttgcttaattcaagtatagaatttaagtgtcatgcatcatctcctttaaaagcgaaatctaaatctcatgaaaagactagaatacatacaagctatgctatagacaaataaacctttaaattattgctagcatgcacaagaaaataccatatgcataaacaaagctctcttttatcaatttttctcattgtcatattattgcttgataaaaccacgaggtacaaactccccctcaaaccatgccaaaaggatgaattatgcccaattcaccacgaagaaaagcaaagcgattagaatccaaaggtttagtaaaaatatcagcaagttgtaactttgtgtccaaaaactgcaattcaacatctcccttctcaacatgatccctcaaaaagtgaaaacgaatatcaatatgctttgtgcgtgagtattgaacaggattcttagcaatattgatagcactagtattatcaaaaaagagaggtactttctcaaaagtaagaccataatctttcaaagtagataaaagtcaaagaatctgtgaacaacaactagcagcagcaacatattcagattcagcacttgattgagcaacactagattgtttcctagaagaccatgcaatcaatgatgtaccaagaaaatgacatgttccactagtacttttcctatcaattctacaaccaccaaaatcagcatctgaatatccacttaagcatatataagatgaagtagaataccaaatttcaaactcaagtgtatgattcaaatacctcattattcgcttgaccgcttgacgatgtgaagcacgaggagaagcttgaaagcgtgcacacaaacacacagcaaattgtatgtctggcctagaagcagttagatacaacaaagatccaatcatacttctatactctttttgatcaacagcttcaccatcttcatcaggacccaacacagctgtagaaccaattggtgttgaaattggtttgcaattctccatcttgaaccgtctcaaaagatccttcgtatacttcgtttgatgcacaaaagtaccttgag

SEQ ID NO: 32986 - DNA, 845 bp, Oryza sativa
ttgaatgtgcaaaggagcagcgacttctgaagttgatccacgttctgtatcagtactggtcgaagttgtaatctctagaggtccatctcgatcagcatcaacagtacccgaacccaacgaccctggccggtctgaccacacgtcctgcgccggtctgaccggaggtgtgccggcggtctgaccggcctggcgcccggtctgaccggccgacccgacctcatcgtcgtcgttgtcatcgctctcgtctacaaaaatacgaccattctccacctgaacctgtgacagtgtacctgcaatatcgagtctagtacctggactagcctcatcaaaagaaacttcgcaagtctcaacgattttgttagtctccaaaataagtacacgatagccatgagtatgtgcggggtaaccaagaagcaatccatcggtagaacgtcccacaaacttatccaaatttccagatttcaagacaaagcacttgcaaccaaaaacatgcaaatgtgaaactttgggttgatgtccaaatcgaagttcataagaagtttttccaagtttagatctcaagaaaacccgatttgaaatataacaagcagtgttaatagcctcagcccaaaattttctaggagttttatattcattcaatatcgttctagccatctcaaccaaaacacgatttttcctttcaacaacaccgttttgttgaggaacatgaggagaagaaaattcatgttcaagacctctttcgttgtaaaattgttcaaaagaagcatttttaaattcaccaccattatcacttcgaattcttttcaaagaaccaggaaattcaagctccaatcgaagaaacaaac

SEQ ID NO: 32987 - DNA, 39502 bp, Oryza sativa
tgttatcacaggtgaaacaggattttcaaaacagctttaaacactcttccatagcgagaaatattcaacatagaatcaccacaagaatcaaaaactttacttccagttttcttaaagtgaacctcaaaattttcatcaacattttgtgaaactgaaagcaaattatactttaagtactcaaccaaagctacattcttcaattcaaatttctcatttaccttaaccatacctgtagcgagaacggcactcgtagcagcatcaccaaaaataatcgattcagtcttagatgccttctttagggaggagaaccaatttttatcaccggtcatgtgccgcgaacaaccagaatccacgatccacacgttctccttccttgccaccaaagcctacacacaagcagaagtcgaagcctcagtactgggattagatgacaataaaattttagaaatccagtactgagacacacgaccagaagatccaataggcatatatccacatgcaaaatcaattttagaattttcagaaaaattcctccgaggccggtctgaccgagggtgtgcagccggtctgactgaggcttcaccgccggtctgaccggtggttggtctaaccgaggctattcagccggtctgaccggtcgtcggtctgaccgcgggacccactacggtctgaccagtttcctcgagggaaaaccagatttttgccactttgattttgcaaaagcaatctctctctcctttttctgtttatgagctaatctgaaacaaaaaccaacaatatgtccatctttgccacaaaaagaacaagtatatttttcatgatgattagacacattggtagaattagaagatttagcaacacaagcaacaacatgagattttgcatgcacaacattggattttgaagaagatgcactcatagtagacatgataccagcagatttaaaaacagttttgttagtatcaggtttaaccaaaatctcaccccttctagcaccaacacataacacaacaggaggatgtctagaattatgagcataaggattaaaacctgaaccacgattatgtgtgctaacctttgattgatccaaaatcatgttgaggttctttttaccatcagaaaatcttagcaaagaatttttcaaataagaaacctctttttccaaattagcacaattttcacaatctaccatgacacctttgcttttacgacatttagggcaagaaagcacttcattgtttttcacaacatcttccatgtactcaacacgacctaaagcatctttcgatttcaacttattcaaattacatgttgagcaatccaaaacatcatgaggttgttttaacttcttagcagaaatcatgttaaacatcaaactagcatgaaaagcaattcgatatttttgcaacaactttttggttaaaaacaactcatccaaagtgcgtgtgtgtaacgcaaaactacaagcaagagaatatctatttttcaaatcatgtgcagcattaatatctctaatttttgaaatctcattcattaaaacctcacaatttgagcaatcatcatcattaggaataagagattttaatctagcaatttcagatttaagagattcaatgataaattcctattttctatacatcttctcacacttcttattttttttcactcaaaatattaatagcttcctcaaaagcacttacctcattatcttcatactctgtgtcagattcaccacgcgccatgaagcaaacatcggagatgttctttcccttatcatcatctccactctcaccatctacatcacttagtggctcgaacgcggcgcaaacttgttgaaaagccttcctaagattctccatcttcctcccttggtatgaacccttcggcttgttgttgttgttggtcttctcaccatctttgtcttctttttgcctctcccaagcttaggacaatgcgaacaaagatgatcaattgaaccacattcaaagcaacaatttggaccacctcttttcctgttcctggcattattcatagctcgagcaattctgttagcaaccaaagccaaattctcctcctcgatctgttcgagttgatcatcggatgtggcattaaaaacagcaagaaaagaaggcttagatgaagaagcatcaacatccaaagaggaagaagaaaaaactaaagcactcgatttagaatcaacttttcgagaaagaacatccatctcatgtgttttcaattttgtataaagtgaattcaaagtcaaagtagacatgttaacagactcctgaatagatgtaactttcatctcccaaatagacatgtcaagaccattcaaaaagtggcgagaaatctcagattgtggataattagcatcacaagaagaatcaacggatctaagattactcaaaattttattaaactgagaaagatagtcatccaaagcttctccaggtttcatctcaaatttaatatactcctttttgaaaagatcacgacgaagttctttaatattatttgttccttgatgaaaattactcaaagtagtccaaatctcatgaacagtttgaagatgggcaacacgatcataatccgaacgagaaataccactcaaaagaatattgcgagctttgcaattttgttcaaaagcggttttttcagcagcagtattaatagcttcaggaatcacataaggatgagaaacttttctccaaatatcataatcttcagccataatataaaattgcatcctactacaccaatgagaaaaatcagttccatcgaaaacatgaggcttagttgaaaacctagcgggagtagccatggcaaaaactctagatcgataaaaatccaaagaagaaaacaaggctctgataccacttgtaggatcgaatcacaagaactaagccaaccagaggggggtgaatggttggtataccctaaaaccgaaaacttttagcggaaataaaagttaccctcgaaatcgacggaagtcggcctgaccgaagttgttctgccggtctgaccgagtggatgccaccggtctgaccggtgttgaatctccggtctgaccgccgagatcgcctgctgcgcctgtcgccgccgccagtctgaccgccgtgctcccgccggtctgaccgccgcaatgccgccggtctgaccgccggtgagttgccagttagaccgccgaaacccggtgaaacacaaatcgaagaactcttaaagtagatgatgactttattgattctctctgtgtttacaaagtgcaccaacaacactccttacaaaaatttcaactaaactcgaaaccctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtacaagaaagaaactttacataaccaatcgtaccaaatttggactccttctaaattcgactccgcatcccatacgcacacaatacctccatcgtatgccatatggaatctctatcaaccacgtgcatcaactctagcctaagtatcccgcatgatctctgaccaccacggatgtcgtcttatccccaagccgactcccggtccatcaccgcaaatactctcccgagacatcaagtcacctacacatgaaataaacaaagaaaccatattccgagaccaagctatctccaacttgactcattagtagcaaacaacagtattacatacgtatagtatccatctagaagtcataatcatgaaataatcacggatatccaaataaacaaccagaaaccgaaaccgacacagcatcggccggtcagaccgcgggctggccggtccgaccgctcgatcaccaccggtctgaccggcacacactgcccggtctgatcggtaacatgaaataacagcagtatcctatagattcacctgtgaaatccaatcatctccaaaaccacttcgtgaataaattctaaataacaaaaccaataatctccaatgcccaattgttcatcacagaataataatcaaaaacacctttgattttacaacctattttgtggacttcaacaccagggatgccattgttgagtacagtgcctatgtcttattttgatattctactgtatctatggattgatatactactacccaattggttcattggctgatactgtacgcttcagcaatccctctcctttgctggcgggtaattgaatatggcttactcaacaatggcattcctggtagtaaaacaaaaggtatttgctttttaatataacctgccatgtttcgcaaaaagaaaagaaaaaaaatcgtatccattaagctagcttttgtgacttggagggcttatattaattttatatactaacagaaagagtaaattgtattggtgatacacaaacttgttaggtgggtacaatttagtacataaacttgtaaaacgctcgtttcattacatgaacttgtctacttcatgcggacaaggaccaaaataacttataaatgttaattttacgaagttgatgttgattaggatgtgacgtgtatacgtgtagtaagcatgcataagacatgccatatttataaatttggtatctactttatccctcattatggaaatgatgaatttcatatatttctaacatttatattattgcttgcttttttaaaatttttctactatcactatatcctattctattttttttattgaagaggtgtatatctaatagtaaccttctcagatatatgtttacatagtatcctaatcatcccctaaatcaataagattagccatgtaatgtcctttttgccttcctccgcacgcaccagataagttcatgcaccaaaacaagtgttttacaaattcgtgcactagattgccccacctaacaagttcgtgtaccggcgatgcaatttactcctaacagaaaattttcttcctgtgtaagtgtaacgggggaaggaatacgatgtgttgctgtgggctgtggccttcttttttttctttttttctcttatgagagtagtggtttccctgcgagcccaattggaagaaatatactggtccggaaacccatagagaaaatggatttgaatgaatgagcttgagaggcccatctgaacagtcatcgctgtttcttgccttcatgtggtactgcttttactacctcgtttgtaaaatataccaatcgagtcatgcccagattcatagcactaaaatgtgtcatatcatatatacaaggttatcatctggtacaatggccggtggtatgttcacccaaagatcaaaggggcctggggatcctagatttggaaacaatgaacaaagctttgttaaggaaatggatctggagattggaaaatgaggaaggttggtggtaaagctttttgaccagtaaatacatgggttgcaaacccatatctttattgaaatttaaaaatggagactcccatttctggcatgggctcatggagatcaaaaacatctttctgaaattctgctccaaggtgataggcaatggtgaaaagacacttttctgggaggacagctggatagggggcaaacctttaaatgaacaattccccaacctttacaacatcactttgacaaaacatataactgtggcaaaactgaaacaaaaagggataaattgcatcaagtttacgagagacctgagtggagggagattgagagattggcacaaaatttgtactagttggggtgatgtgcaattaaaagataactgcaataacaaactacgatggaatttaactaaggatggaaccgtgaactctttctacaaagctttgaagctacaacaagtgcatttcccacagaaaaaaatttggaagttcagaactcctttgaagattaaggtttttttgtggctcttcaccaaaaataggatcttaacaaaagacaatttatacaagagaggctggagaaaaggggataaaaaatgtcagctctgtgatagagaggagactgtgcaacacttgttttttgaccgtcccctggcaagattaatgtggaacactgcaatttgtgtcctgaatctgaacccagcccttgatagtcaaaacatttttggagattggttggaaaaacttgataagaacatgaaagacttagttatggtaggaatggctgctataatttgggccatctggaaatctagaaataaagcttgttttgaaaaagtttatccaaaagaccccactgatgtgatctttttggcttgccattgagttgattcctgggcactactgcaaaaggaggaggcaagtcgaagaagactgctactgggatccagactcataagatagggcggcaaatgaagtctacaactcgcagttcggatggagaatcaacaataaaaggattgagggatgagatagatataagtgatgatgttttgtaattccctctccttcttttttgctgttagatatctgttcaggcaaaacttctgaaaagagtcaggaaccccttgtaatagggctagcttttgaattcttaacccccatttctctgtggaaggttccgtttttatttcctgtttctttttgaagactactgtagctcgatgttttatttctaataaaagaaatgggacccgtcaggctcttgataaaaaaaatgtatataaggttattatattataggatggcgggagtagttaggccattcaccgagcttcttgtttgcattcagcctatgtgtgacacgttggagatttggtaccacatccatctctggcgctacccacctgaagcccacgcgtccaaataagggcacttatttttcagctaacattgtcaaaaaaagcaagggagatgagccttgggaagcgggtacaatggatccgaagttgccgctcctctcctccaacttttctgcaaccaccgcgagggcttggggacgccaccgcctagaccgcctcttcggccagatccgacgtgtgggctcggggaggtcgccgccgccacagcgtgagctcgaggaggctgccactgcgtggcagcagcaatgaggaagatagaaggtggaagaaggagtcgacgaagagagagaggccgcgccgccgaggtcgattcggagccgacaagggaggcgacggagagggagaagagcctcccgagatccgtaactcggcggcgccgtcgtccgcatcttttgcctgcccgacgtggagccccgcccggcgtcgtcaccgcttgggccatgccaccacctctcctctacactgccatcgttgtggccgtggcggcggccactgccgatgttgtttgggcttctagagctgcgggggcagtgccccgatgctcgcttgtgcttggtggtgtccggctcgtcggcagggatggagatggactcacggaggagcgggaggttgagcaatggctccggctccggcagctttgacccacggcgaaggaggcagtggagaggtttgggctcggacgatgacatcgctgcctccggccctgacgaggagaggtggaggtgtggagccctgctcgccacaggtgccgcttcgcttcctccgcccgagagagagagagactggtgggaaaagtgagaggagagagagggggagagataaaagtgaggagagagataggtaagacccactataagtaacatgcattgtggagtatatagctaatatggttcttagtctatgtggtatgtgaggtcggtaaaattttgggacgcattactattgctcttaatcatgaagagtggtacacatatatatcatgaatataacttgtcacatgcatatactttcaacaactcaacacatctgaattgtggcaaacgttctggttcagtgatagcataattcacacaattatatgcgtaggccaaccaattataatatatgcatgggcggcccaggcccggcggcactctatgcttcgggcagcatcgaaaactcatgagccacaatcagtgacaaagccaggatttggctatatataggatgagcctaaaagtcttgcaggggacctaattatataattattaatacactaattaggttaattacctaattatagataggtgattatatgtgaaactatttttgttggagggggccaggccgctccgccactggccacaatgatttttttatcacatatgggcaggtcattttaagacacccgtagaccggctaatacctgaacgataattgtaagacaatatggggtatctgaccaatagccaccatatctatccttgtgtcctctttcacctttttttttctccaagttgctccaaattcctgccacctaactcctaacaaattcgatcgcgatgtcacaccgttgttgtgtgcgatatatggcctcattcaattcatctcacgcacatattcacagtactcaccggtgatgacgaagataccttaaccgctggtctcttcaagcggttattatcagccagtccccgggttgtgtcgtcttgtgctctgctttagtgcttcttttgcaccatacggcttgtaagacacagaaaaggggaaaacatacaaagatatctcacacatcggggttttttaggatttttaaaacatatgaatttagtggcactttggatacagggacaatccctgtcacatcggatgactggacgctaatttagagtattgaacatagactaattacaaaactaattacatagatggaggctaatgcgagacgaatctattaagcctaattaatccatgattaacacatgtttactgtagcatcacataggctaatcatggattaattaggctcaatagattcatcttgcggattagtccagggttatggaatgggttttgtcattagtctacggttaatacttttaattagtgtcccaacatccgatatgacagtgactaaaattagtccctatgatccaaaaaccacattaaaagatcgcgaatttggttggtccataggaaataaaacacatgaattttagaggaacttgttttgtaggagatatactagagaggaaagacgagaacacatccgacttctcaaagggaaaaaaacatggggtatatataagatcttgtcatatagcttggttgtagccaggacaaagagtctatttaggggagctttaagattctgagaagcagctgatgagaatctggagaagctgggttagttcatttttcagattccacagctacagattctaagaatctggataaaaagctggattatttgggggagcttctaacagctgctgctagaagctccctcaaacaggcccaaagaggcttagagacctcctaccttgctagcatagaccgctctcagccatgtatagttttctcttttaacccttaggggttttactttattacctctatattttaatgaaatagcacaatatcatattgattcctcagaaaaaaatgtcgtatagcttattcgtccaaaaaatttagtataatatgtaaaaatatatgtaaaataaataatattttattttttaataagatgaatgatcaaacgttatgtgaaaagtaagtggcgtcatacgttttggaacgaagggagtatattgcttaggagttaaaggggttattggtaagaaagggtttttttttccaaaagaagctaatagggaaattttggtaagaatcgaaatccttcaaaatttatttgtaattccttttatctaaatgagtgttaatgaattgaatcacaaaactacatatttgacattattttttcacaaaaaaataaatttaaagtattatattagagaactacaaatttaaaacatcagttttatcataaactacaatttttttccaacctcaataatactatggatataaactctaaaatatgtattttttataactttatcactaaatatatagttttgtgatacgatgttttaaatctgtagttctgtaataaatttgacgttaaatctaagtatttatggctatataaatttactcttcttttaaaaagatatatacggcgttgagagataggaggtgtcactgtctgtgtgggcccatatggccatggttaccagatatatgtcggcaaccaggtcagcacgacgtaacccatgcgtcatgctcgactctctttaacctgattactgttgttgaatgttgatacatttcagaattcagctgatacaagttcagtactaggtctaactatatcaacaaggagtattttgcagctagctgaatttctctagagaagttttgtgtcacactgacaaactcctgaaagagctgaattcttgatgttgtagctggagcatcatttgagagtatgcctcaagtgatcgacctgtttgttgtcagataggggaaggagtaacagacactacttcaaaagcatcagttacatctgtacacaaagaatttcagaatccggttgccttcaaagtttatcttcaacctcagccttcgttgcgatccgttcaactcgttctatcctaaaatataaaaagtcatgttttcaacaatgtctatgtttaaaaattttgactaatagtgttgtacatgcatgtatcattagattcgtatttaaaaatacattttcatatgatgcataatatatatagaagtatcatgatagtagaattgaaattaatagtcatagtatatgttggaaaccgtgtaaaaagctaatacctgacatgtgttacggagggagggtttgtttgatttggtactatgccaaaaagatggcaatgtggtatgttttggtagtgccattgttggggaagtagcttcgacctcagcaacttccggagagcctcctaatgcgtcgaggggggcctccgcttcggaggtatcctcaggggacccaaaaggaggattcgggctctccaccggagccaagtctaaggattgtggcctggctgactggctccagaggggaatcccctgtcaccgagccggaggtgaggctccattagggcttcgcaacagctctgagggagaccagcttcggagcatctcccttccttgacggagcccgaggcatcagcaaggatgggcgttcattaaagcgcactagtagccgccaaccaccctcggacaccctggtgcggctggtgaggcagagaccagagctcgccatggactgggggagggatattacctaagtaatagcctgtagccgggccatcaggggaaccccaaagtgagccaagatgccgccttaatgggcgccatccctgcatttgtctcccaggaaatgactcagttaccccctaggtgggcctatctgctcactgggaagggtttaggtctgtagggttatgaatgtaatttcccatgtcttgtacagactataaatgtgtacataatccccaaattgaagaggaggaacgcaacagaaaaggctagaatacactagttggatttgctccaacaccattttttttatcaaaatgtgtgttcttggcacattttgatagcaaaacaaatactaacaaagtactattaaaagggtcaacaatttggtatgacttggcttcaaaccaagatggtccggagtacaattttgtttcatctattttgtgaaaacaaattcatctagtgatcgatctagtatgcgcctcagagcgcatgaagagcgtctgacagagataggagagcagtagtagtagatcaccctatagtctattccctccgtcaaaaaaaaacaacaactaatattggatgggatattttctagcataagattgttcgttgtactagaaaaatatttcatcccatacagtttggattttttattttttacggaggtagtatagcttagctgctttcaagcttcaacgactacttctaccaacatctgaaaccaacatccaagtcatcatgtccaagatgtctccgtcaacaagaagggcaaactatctgatttgatttgatttcgtacaccagtagcttcaacccagatcatctggtccctctgcaattagtggcaaagaaattctactagtaaaataatccatatgatccacaatgatcttagcttggtgatcagtttctttgacacaatctagaagccgaccaaccacaaaactttttccagtgtttgctccacaaccacaggcaaccaatcgatgcctccgtttgtgccattccaaaggtaaagccaacattgcatctgtgctcatcaaccctaccacttgtgatcttttctcttgcttccagtactacaaggtcacctggaatcaccagcctttgagaccaatcgccgcccgccacgtgtcgccttcccttgcacgccatagagctcatcacaccaagaccatggtggcactgctatataagtagctcatgagcttcacctgaacaacacatcaagtagtgacactcactcacacgatagcaagaagctagcttggttgctcacattgagctcaacaatggaggccaagggagtggtggtgatcacccttgtggtcacacttgcggcggttgcgagggcggcccgcccagaagaaaccaggccgggcttggcccgccgcgggtcagcatcctcaccgacgactcacctgcacttctacttccacgacaaggtgagcaagccatcaccgacggcagtgcgggtggtggacccggtggacccgtcatcgcggtccttctttgggatgatcaacgtcatggacgatccgctgacggaggggcccgagcccgagtccaagcccatgggccgggcccaggggctgtacatgggctcagaccaggccaagctgggcttcctccaggcaatgaacctggtgttcaccgacggcacctacaacggcagcgtggtcaccgtgctcggccgcaactgccccttcgacgacgtccgggagatgccggtgatcggcggcaccggcgccttccgcttcgcccgcggctacgcccaggccaggacgcacaccctggacctcaagaccggcgacgccattgtcgagtacaacgtctacgtcatgcactgatcacaacaagatggagatgatgcttcacacaaagcgtttgcatttctctgaatttttcacaagagtgtttttgccttctcctctgaaaataatggcccttgttgaaagtgattcactcaagaacacaggggagtttagttgctgcagtgttgatcttgatacaaaaaaaatggagttctagaatctctataaaaggtggttcttcttggtttagtctttcagtaataactttcttggttgcagtaacacactataccgaagaacacagacaacttttagttgcaggcttaacaaacttctgtcatataatcctgatttcttaaaccagtgggagctttgtttgtgatgcataatgcatttatttatttccttacctgaaaatgtgtgatgcacatttttacttcacaaactaagttcagtctgcagagactgcattgatgcagttttggttagtcagctcattgctaaacaatggtgaaatcatatactagtatctcattgagtagaagagtaaacaagaaagcatcagcacatgtgttgtagacacattatgttgttcatcaccattcaattgagaaagtgttcatgctaatttaagcccctgcaagatgcaagtgtcaattttgaggaaaaaatactcatcgatttgccaatggtgttaccctcaaaaataatttgccaatgatggtacctgcaaacaagtaatcgtatagtctgcacgcgtgcaacatccatgacaaaagttcagaaatcttatcaaggttatttgacattttttagaaaaaaaaaagagcactagctattgctttaagcatgactgctcctttctgccatccccactatgatcttaaggtgaagtggcccaaaaaagcatccctgcttccctgcttaagcatgatctttaattattgatcacactagtatatatgatattggagaagaaattctgattatttggaggaaaaatgttcagcacattttcttctctcttccaaccatttgcacaaaatgtacatgtgagctcctcaaatacagattcatgaactcaaatattgcgcgaacattaaaccaaccttgtctagtatctaaagagctataaactaaatttctgcattatctcagttctcagctaaaaccctctctattttcaggcatccctctccctacatcagaatttgcagggaatctacaccttgaatctaatcgatcacggcgatgaaatcttcatcaatatctgaccaagtggtgctaatgttaccgaagctggtcgatccactgatgcctgtgctagccgagctggttgatgatccactggtactcactggttgatcaagaggaccgctatggtgcggcgcatcagccctcagtctcgcggcttttatgagaagatgaaggtccatcaccatgtcaatgatgcagccatcagtcttcatcttatcagcatggtacagtgtctgaaccttgagcatcttacgttgatcacggtcactgaggctcctacaagaatttcatgaggaattattagtgaaatcagcaattgtgcttttgcatattgttcatgacaaaatagacacgacagtcatagttatataccctgataccaggcattctctgatcattccagtgtgctgagacagcctgatgttcagatatgtacaaggtgagcatcaggttattattcattgaatgaacctggtgtatatggcaagagattacagtaccttattgtaaattctgccattggatagagccattcaagtctcctggtcatctcatcggcgatctgcgtttctgtcctctgcaataagaagatgcaaagttcagaaagaaatgaagatgaacagtatatacaggatacacatttttgtcaggtaatcggaattgacagaaaagagtggtcacctggtcgtcaaaatcgccgtgtctcatcctaggtagcaaaactgatctgattctataaggcagtgcatggaacaatgaatctacagcacattgcggaaccgatgatgcgacggatacctgcgattgaaactttatgaacaaataaaatcagtttcgacatttcagttagtgtgccaaatcaactgaaaaccggaaatatgtttatatcatgcacgactacacttgatcaatgaccaagatcctagaacaatggcctaatgactgtcaaagaatcttaccaaaacttgtatggcgataacgatccttgcgtaattcagctggagatcagcagaccctaaagtttgctgagggctcccattagccttcacagatctatcctcttcatgttccttgtagaagacacaattgatctcagaaggcaagtaatgcacaatgtacacaagttcctccacaatctgcaacagaaacagcatttgtgtatttaacataaattcgttattgaaaaatgtgataaacattaatcatcatatcacacagtttttacgtactttttcaatcttcttgacccaaagtgctttcttctttgcgctttgcacgatttctttttcaatgttcaccgcattttggaaagtctcaagtggcatacctgcacatataaaaaaatgttaagaactgatgtgaagaacataaatagacatatttctgattagttgtgctgatcacacaaatggttttgggaagcacctgtctgcttggcttccctgtacatcttctcggagactcccaatcggcgcaatgcttcaaacagtatctgcacagaagaaaatagaacagcaacatcatttcagtggttcctaaaaagaaaatgtgttgaaccaacagtggtaatgacattagaaaatatgtgactaacacacctttgtcttagtcacaagttccatcagatcctccatcttggatgctgctttttcatgggaatactcctgagttatgggaccatactccaatctgcgcagtgacaagaggcacacaaatgaacactcagatagaataaaatatgattgagccatgaattatacaagaacagtaatgtggtggcagctaaaattttacccagagaaatgcccttcaagattgtgccatttgggatccctgcacatgttcccaagcctagcaacagatgccgcaaaatctttgaactgttgtctgcataaaccaagcccaatgaatgtaagaaatcttgaaaaacacatataagtaataatttatataaatagtaaaagcattgaaatttatagaaaaagtcattaattacctaatttcatccccaacaagagcaagcaactggctctgatcatctgagatcagactttggacgccttggttctgaagcacaacacgtttcaggtaccttatgttttcctcggagaggaagttcatcaggttggaacccatggcaattgtgttggctacctcaaaggccaggatctttatttttctaccctttttggtagcaatatagttccttatgctgccgatcacggtcttcagtgtcggagatttagccactggttcgttggaatcctctgatggattgcctgatattcctttgctggttctcctgacagaagtgtccatttctgatacctaaatgatcaaagaaagatttagtctaattgatgcacgatgtattgttcttgattagccacatcacaaatattgaaatagataggttccttttaaaaggaaatggtgcattttcatgaatgatccgcaaaaacataaccaaactgtgaatatgtcttccccacaaataaaaaaaaaatctattaatatgtcttccacacacacacacacacacaaagctgaatatgtcttccccacaaattaaaaaactgtgaatgtgtcttccccgcaaaaaaaaaatgtgaatatgtttaaaacgtagatcctaaatcccacatttatgatgtttctttttatctcaacccagcatatgcatgatgatgccctagcatattcttctccctggaacaccaccatttctgaaactttcatcccaaagaaatcaaatcaatgcataaaaccactgcatcaaatccagtttttaaccacaaaattagcaagcatcaagaaagagtagcatctgctcttcaaacaagaagatgaagacgaacatgagtagtaacctatagatatcataccttctctttgcccttgtcgagcaatgctgtcttcttggatgccggtggcggcgcttcaccgcccgccttgtgctcgccggaggcctccggcgccgtcttcctcctcgagctcgagctcttcccagaagactgcgccgtcgtcgtcgtcgtcgcctgctgctgctcgccatgggaagcaaaagcttcatcgcctgaagacgacggggagccgcaaacgatgccaaccacagagcagaaacgactcatcttcatgatctgatcacaaagaactcaaaaactataccgtgtgatgatgcggacgagatcctatctgaccatggacgaacacgagaggttggccatggagagcatgcaaaatgatcataaaaacagctcggatcgattatatcaagaaccaggaataataatgccaagaacgtgtttatatgttcagagatgaacatcgaaggaggaaaaatggagcagctagcaaaaaggaggaagcgattgaagaggcgatttaatgtagagcaacagggtggtggcaaaaaagtctactcagtaaagaattcgaaaaattaaatccaggtttattatatgtgttcttctctcttattagtttaatggttgactgctggtgtatcaggcagagaacaggacatggtcaacaccccccccccccccccccaaacacacacacacacacacacatatcagatctgctctatttttctcctgaataaaaatatatgagtagatcgagcatacttctctgatcatttccagttttggttagtcatatgccagaagagctagctaagtatgcactgctgaaaaaaaattgtactacccatggcatgtttctaagcaaaacaaaggtacacatactagattgcgaaagagtgcatactagatttagaaaaatcgaagaaaccttttgttttccccgtgaaaaccacgcctgtggattggtgaattcttcgggattagtgcttcgacaccccctctaggatttgtgaagcctagatcttacctctctctgagcgggggcggcgaagcttgtggtcaaagcgacggcaaagattgtcggacgaggggtgcggcgcggtggagatagctacacttgtgtaggaaggtggggatatgatggagtggacaacttgatggtaggtggggtaggagacggtggtggggaccgaggaaggaggcggtggtgggaccgaggaaggaggcggtggtgggaccgaggaagggtgtgtgttacagttaataggcatgcgccgaatgcttggtagggtaacgattaagtaaaaaataatattaaatattttttacttgaatgatattaaatgtttgagaaagggctggcggtcacataaatgaaaaaccttgttacaatcaatgatgaaatctacctccgagattatgatgaaacattaatggtggaggatgctttgccgcaccttacctctctccaaacaggggcggcaaagctcatggtctaggcgatggcaaggacaactggacgaggggtgcggcgtgatggagatagcaacactttgtttgggaaggtgaggatatagtggcatggacaacttgatgataagtgtctataaggtgagagttgggtaggaggtcacggtgagggtcgaggaaggacgggcaatacatttaatagtcacgtgccgaatgcttggtagggtaacaattaaggtgaaaaaaatgtgacattaaatgtttgagacacataaatgaaaaacttgttacaattaatgatcaaatatacttcaaagattacaatgaaacattaatcacgggggatgtttcgttgcatctaaatgcaccaaatattaatagcgaaggatgctttgccacatataaatgcacaaaatgtatgttatgttcccacttattaaacacagttgaattcttttatgaaaaaatagtgaagtcgatacaactagcatcaactatccgacacaattttagtttgaattccaaatctgatccacacattaagaaaaaaataaatccagtttatgagtagtaatgtggttgtaggaaatgatatgttgtggattgccaagggtggaataggggaggggggttgttgtcaaaaaggaaatcaattgcattaaaaaacaacgatttttatggtgatgagataatgattattaaagacttatatttatagataaaatgtaacaaaagttctaagcatgctatattccatattctcatatcattttaaggtgatggaagtaagttccccaattctaatcatttttattggtggaacattttctttgatacaataattagatagttagattatctattatacaaactagttgcaatgaacccaatgatcgtggaaatcagtttgatttgtccactgaatcaacacagaatttgaaggttcgtattaattaattgtaaaattttatatgggtatggaaataaaaatacagatgggtaaattttatttttagctaacctttccttttctgcttgtactaaattcctatatccattgtacatgattctatagactcacatcaacttccagcaattgtaagtactcttttaattttaaagaaaaattaggattgtttcatgatgtgcattctaagaaaataataacaattttcatatcacaaaattgcctattaacattctaactttagaattgtgctctttatggtaaatgatgtctaaaatgaaataaattaacaccttcccgttcatcatcctgtattccagttcggtgctaaatgagacaaatcagaaatcattcaaccaatttagtaatctcattatgtgaaatgcactagttcacaatttagaattaaatacaacccataattgaaatgttcctgtaaatattcatcaccaagaaacaattcctaaaagttaaagcgctgccattgtatcatctatgcattttattggagctttgttgtaatttaaatctacatacaatttacttgatttggatgaaacatttagctaaagaaaatattttcttttttgcttcaaagtcttgaggaaatataaaatgtttacattctaaaataagtataagagtttataaaaataaatccagtaggtctatgtatactgtatttatggaaagtacccaataggatggatgctattaaatattaaataatgtactgatagccaagattagcacttcggaagaagaatgaaaataatgtgcatgtgccaaccttgtgaaacattgagtgaaattagcacatttcttacacacgcaaattaaaaaccatgttgttttgccacccattgtttgttgaattggctgggtgtggataatgaaattagaggagaaaagcaaagaagatccctaagtttattccattattccaaagtagtatatatggaaccttatgacttctcctaatttatatttgcactaacatgcacaccatgcatctcattgttctttcatccatagtaggttacttaattctttgcttgagaagcacctgcagtactgtgctagctagcttttgattacttataccagggaaaataaactaggtagggatcaatagggaattattcccatgtgcttttcacagtcaatggacttagttattaaataagcgtcatcatgtttgtattacttgcctaaacacatcttgtgatgtgatgtactcccttcgtgaaggtactctcaccttttcacgaagaattcattataaattttgcaccccctgatctgaacggaacctttcacattatgagcagaagtcaaatgctagattaatttccccttttgcacaatttgaatgtcaaatatttttttactagcaatctaatctagtttgcttctcgtcaactgttagacaaaatggacagtgggtctaattaattaaataccttgagttttttcgtgtctttgttaaacttcaactcgcataatgacgttttagcttaagtgatcgccatagcttaaaattttacatgctggattacgtcactgccttttaactcaggggactggtaaaatataatgagcaaaacaatgtgcatgtgctgctcctttgcagaagccgccctctggaacgtctcattaaatttaattacccctaaaataaacctcattatatatatctccattcactgtgcattacatgaacgaccttggcaatttttgtacatactcctacaaacattagaaagtcgctcctgtgatatgggcatgtaagcatgtgtttgatttataagatgaacaggtgagtctacttttgaatgaaagtatttggttagagaacaggtggaacgggatcattcttgaaatgaaatattcttctaagatacatattgacattatcccttagaaactagtagaccaatctaacttgtttttctctttcgttaacatatagaccatccatcccctcactcacaataaacgtatagccaggacaaggtcgggaatattcatagatgagtacattcacggtgatggttttgcgtgtatgtctttattatttaatacacaaattaggaacatgtctttattttacattgcaatatgaccataccacttagaatagggatgtcaatctagcgtaaagcacaggatccaatggttttcttttcggtcgtccccttacgttttagtactaattacggcgtttagatggtaaatttttcttttcacctctgaaaaactcgtgttctttttcgcgttgggctggaaccccaatagcccattccgctaccgtccattttcccctcgaaaactccactgacagataacaacaaaatcatctccagatgtctgatgccattctgcttggcaacaccggtttcaactcctcaacccccagaaacagacagtctagagatagaacagagcatcatcaagaagtggctgcatttgcagtagcaacagccgtttcaatcttctccagacatttgacctcacacacacaaacaaatgggggcagcgtcactactgcttgaaaagtgacaaagctgagtcttaaaacttccgaaaaatttcatcatatgcatgatgcaggagaagctaccaaacaatcacaaagttaggtgggtgggcaggagaagcgccgctgcaaatttccaaaccttgtatcatcatcatcagctttggatacagaaccaggcataacctgggatcatacacgtggttcttggtgtggagaagttagagaaagcttcctgctgaagcatgaatttttcagtcttcatgctgtacatcatcagcatacatgaatgctgttagctaggcttaaagaattgagggagttgaagggcgacaatctgtcagagatacccagggcactgattgttcctgcagacgagaagatatgagacgagaattgagatatgcaacatttcgagattactgatgcaaacaagcatatgtttgtacagcttgtgataccgcgtaatggatagtgcgtatagtaaggccctcgtgcaagaaacataccatagaaatgattcagtgttttgaatttgatagcaggtcgttcagctcatagacaattgccatatagcaaaacttgtattgatcctgcagagtaaaatgttgaattaggacagtatctgcaggatccttattctgtgctactcttaggtagcctcaggcactgttatttcgatggataatattctgacaatccaactaaagcatatccgtaatccagaaaacccaactaagccttaaagacaagaaagtcaccgattgctgctttatacgtactgtccttacaaagcaaaagatcaacggagcaccatattttgtaataaaaaaaaaggctaagcgtcagatttagggtacagttgtcacttttcacgagtcacatgttcactaactgcagtacataaaataaataacaacatacttcttctaaggtacataccagctccactatacagaaactattgtcaaattcagaggattttgtagcagaggcagagaaataaagagccacacatacctctgtttggaccattccaggtcgctgggatctaaattttttgacagttttagaaagatccaaagcagacatgtcaccaagtaaaatcctctctatagtgttgtggatggtgatataagcaccagttctcccaatacctgcactgcagaaagaaaaaacaatagtattgagtttgtgtatagggataggtgcacatggaagaatggcattaatttcaatcaaacctgcaatgtgctactattggatgctcttttggaatgccatataatcttttcaaaatttttcgtacaaaagcactgtcatgtggcaccccatggtcaggccagtcagaatacagaatgtggagaacatggcgaactgtaagtgactgaaatgtcagaaattagcagtcaggagatactctggtcataactcttcagcatagcaatggaacatttcttatgatgacatcttaaggaaatagagagggaagcaaacatggaggaagaagtacaggagaaaacatggaagcaatgagaagaaaaaaaaagtaagaaaataagatgggttgcctgtttccagctatagaatatgcaacacacatagcagaaggaagcttgataatatattcaactaaaggtaaatacagcttgtatgccatggataatttgtcgtctcactcagcaaatttaaacacgagcatcctaagggcctgcttggaagtttggtaaatatttacacctgacaaaatattacagttgtaatttcctatgcagtagcaccccccttaacatgattgtttaccttgtaaaatactgtttgggaaccaagcaaacaagtcatagtcatatacggagtactttgaatgcatcgagcacagatcatgagcaaatttgactgtgtattgcccaatagcatgctttagaagcgagtacacaacaaatgttttagaatcaaggaaagcaaattctgaatctatacatgcaacaacacaacataatttatactcactggtataaagttcagaccgaatcattgaaaaagctatgcacattcagggacaggggtgatgaggatgaggcgtgtgctatgctatcaaaggcagaggaaatccactcagcactggcagaggtcactggcatcgccatctgttgttgatgcccatgttctctagagtaactaacagagtgaccgctgctgcacctgctaatgggtttgctgcctatctccaggagggctgtatcgagaacagacgacatgacaacttggatcaccaatatgaggggggcagtggcatggattcaagctggaggaggcccgcgtcgctcattcaagccaggaggatgttggtggttactgtagaagtggcagtggcaatgaggcactgaggcgaggagggtggagcaagctcgagctcaaggcaagcctgagatttctcagaaaaaatgtgtgaaaaatagtgtggccttccaaggtcatccattttccagtcgtatgggcctaagatagggatagttaatgggttactgacccataaaagcacctatttcaacttccaagtccagaatgtaaaagttttcagaagtgttgtactcacattaggccaaaaaccggacttccaagcaggccctaacctggggaaatctctgagctatgatacaagcatatagatgtaattcttcatttgtttaagatatgccgcaaagaggagcttaaatatatccatctacgaacaactgtaatcttgaaattgataacctatgatgcaaaacataggaataggccttgctagtataacctacctgttttttgaacagaagtataacctaccttacacttcactaatagcaacaagaaaacgtagctgatggcctttgaaaatctttacctcattctgctgtacctccaaaccacgcaattctaagacaccatcgcatttgaactttgtgatcttaacactgaattttccataatccctttcttctccttcgttcgttggaagatacctgtcacactgccattttttcaaagttaataatttaataaaattttattaaagtaattagttgaaaatagtcggaaattcaagttgtatgtctacatcaatgaacttaatacattttttggtatcatccagtaatagacaaatactccctacattcctaaatgtttgacaccgttgacttttttaaacatgtttgatcgttcgtcttattcaaaaaatttaggcaattattaattcttttcctaccatttgattcattgttaaatatacttttatgtatacatatagttttacatatttcacaaaagtttttgaataagacaaacggtcaaacatgtttaaaaaagtcaacggcgccaaacatttagggaaggagggagtagttctcaaagtcataatctcaaaacaattatatcaaaaacataaactaagacagaaaatactatccaatcatcatactgtaattgtcatgcaagtatttacagtactcattctactgtaatattgaatcgattacataaggacaatttgttaacacagcaatcatcttacatgccatgctattttctgtacatcaattccaaacatgaaatagacaaccaaaagtaaattgtaaatccaaatcagattacactaagcacttcggtagaaatcaaagtattgcaatatgagcaggcaggatcaactcatggttgagatcagcatactgcaattggcttttagcaagttaaaatatgcatatgcgaagcaatcatgagtgtatttgggttaagaattacatagaacctctgaacctgacagctgtatgtgtcaatcgcaagcataaagattcaagatcttaattttctgttcattttatgttctcaattgcatatgacaatctaggtgatgtatatgtgccctccatagagatgcaagctatttcatcttccaatggccagattacatatcaatatatgatgataataaaaccatctgagatgatgcatacatgcaagtatgtaacagccgcatccagatttgcaacagtcaacaaaaaaattcatgcccatttgaacaaagcaaaagagggggatccatggagatgtgaaattaagacttcagcatgacaatgataatgataataaaaatattaaaacatgtaggacatagttggataagtggagttggggtagcctcaacataatgcagggaaagagcaacccaataatatgttgtaaagacaagtaaataaaacttggaaactgagaattcaggagtgtacaacattagcaccttggcaccatcaaatttagtgaccataacaatcacaggacactggttttcgtagaccatctgccagaaatccccaaatgtcttgaccaagggaccttgagtggaaatgaactttgtatgactttgaccttggtcatcagtctgtaaatattataccacataaataacctataaggctataacaaatccagaggtcccatgtcccatctaggatttgaaacattcagtattgaaaaagatggaaactcgtgtataacataaacaccaggaaatatgcccctgtgtttttacctctataaggcttgcattgatgtattcattgcttgaagggtgatcacttgctgagggctttaaacgtacccgggtttcatcaactaaagaagagaagttaagtcaaactaataatacgtcatggaggtctcttggctaacatacagcagccaacacaagttgataatgctcacatggcatgacatcactgtagcggtttttttccctattagcaggattttgagcagcagtaaattttcccgtctggaatgctgtctgtatgtcctgtgaaatatagaaccagatatgaactactctcagtctttcacagactttgtaagaaatgcagagcatgtttagacaaaaaaaaaatagtaggattcaaaaatttaaccaatgcttgctgcctcaaatgttttattaaggagaaatgagttgcaactttatatcactcaatttcaaaagaaattcagaagatttctcatacttgataagaagtttgaaagaaataataataattgagaaatcaattccaacatttctcagtacattaggtcatctgaacaatacatagtccaatacatgtttcttctcatatatatggacgaaagtgtagccagttttccattacattgggtagagtatggattttgaaatgtgcaataacacgacacaaatatagatttgaatgaaattgtcataagacttctcatcttcatgagttttgttctccgtacagaaaagagtgtctaatcagttggttcatacaacatttgatatggttgagatgccactagaaaaaataattcatagttggataaatttggataactactcgtctcataaaaactactataaatttggataacctgtatatgatcattgtaaggggttagagacatgaagaatacagttatatacccccaagataatgtaagaaatggagcatacatatccctagtccatataagtgattgttgattgtaatatcaaatcacaatcggttccaacaatgatggcttaatagctttacacggtacgcaacccccaaaatgaactactttactgcatcaaggtacatgtgatgcagtagttaactaaatgagaagaaatatgtccagttttggtgaagagaccacgggactagaattacacataaaaagtattactcaaaatgaaatatagcctttttcatcatcacgtactagtttgggtgaagcataggactagcaacaaaaactccacaaaaccaaaagtatattgttctaaagtccatacgtatcgaatggatcatactgatattgctaagacaacggcccgtgttagctatctccattctcccacgagaaagatagactgcaatcatcttttatcccgctgaaaaggcactgaaacaatgcacttatttccgtatgatgcaatcacatgaattctcctctaccctgatgctttacttcaaagcaatgcaagtatgcagcagaccaaccaaacttgtaagacaaaatagcactagttaagtagttatcatcatacagttcgactagctactgagttcattccttaattcgacaattcccaaggacgagtaaacgaccctaaaataaaacctagtgccgaaccagttcgcaattgtttatcaagcgagtaaacgaaataaacgacgagcgcaaaatggggggagatttttttttttttttggtttaccgggagagcatggaattccttggaaatgtcaatggcagctgtttgcttgagcttcttcttcaacaccttgagcgcctccttgcagtacttcacctgttcccgcgtgagcgccggccgcggcgccggatccgcgaagaggacgaaagggtcaaacggagcgggcggaggcgatccagacgaaggcagcgggagccgcgagccgcgtggtggagccgaggtgttggcttggcgggggccgccgccgccgccgccgccgccgccgcggccgcggccgcccagcggcgagttccccgtggctgcggcggcggcggcgtccgggtcagggtcggggtcgagcacgcggcggcgcttggcggtggggggcgaggcggggcgggtcgtcggggtcgccgtggcgggcgagcgcgtggtatataagggcgcttccgcgaggtgggtgaggggagaggccggaggcagttgggatggaattttcaaagtggacttgacttggcgagcaatcgacgaatcgtgatggcgatgcaggtgcagaggggaagagagagagagagagagggggggtggggaaagcagatccggtcgcggaggaggtaatggcggacgcggtggtcggccggcggcgacggcggcggcgatggccggcgatgaggacgattggcagatactattcgaatttttgggatttttttttgttggttttgttgtgtgtgggtggggccgtggggggtggggaactggggattggggagcgtctgttatgattgcgaatttgtgattgaccgcgaaccaagtcaatgggattgtcgtaaaacagtgttgttatatactactccctccgtaaaaaaaaaacaaacactgattttcgtgttcaacgtttgaccgttcatcttatttaaaaaaaatataaaagaattaaaaagataagtcacgtataaagtattaatcatgttttatcatctaacaataatgaaaatactaattataaaaaaattcatataagacggacagtcaaacgttggcacggaaacccacggtttgtctttttttggacagagggagtaaatgttagtgttgtgtaataaaaaaattgatgaagtgaaaacattataagacttaaatgcatgtttagattcatagttacaggatactctctccattctaaattgatctacatattttataggtataccaagaccaagaaaagctaataactcttttatagtgttatattcactctagcaacaaacttcatgcatgcaccatctccactatttcctagccaatagaaaatcaagatattacatatgggttataaatacgtgtgtgtatggatacatacgttaatgtccatttactccaatgcataaataacgaatagatttaatgaatcaacacaaatacgtagatcatttaggaataatctaaaaaaaattatatatagatcaatttagaatagagagagtatatcatatcttgtacgagaggttgatttattctaggatgaagtaagtatctttaagtagcgggagggcagcgcgacggacggcgcaccggtggggcgatcctgtgttgttagctgctttcccgtttcccttcttcttcgttgccttttcttttttcttcttcaatctcgtcaaatggcttgatgtgcggtccgtgcctgtggcagaggacgccatggtcgcagacgggcttaagcgcctcgccgctggcgtggaccgatgcggttgcccacggccgcgtatattcgatgacagcggcgacagtggttcattggttttttttaattcgttgaatactatacgtggagttgcagtaagatgtagagtattatctagatggattacttataagaaaacccccctagcttcgggaaccatttatccaactaatttgtcaaacgaacacgtgaattgcgttcatatagttttaaattcatcatttattttgctcaaccactgcttacgcaagatggatctagccattgttttgatttcgagtgacacaaaacatagaccggggcactagtctgttttatagtcaatttaatttaaaatgaagatagtatatattgaccgttccgtcgtcaaatcaaattgtgaactgcaattataatatatggccgtctcttgcagtcttcaaaacaaaagttaattcaaatgtaacttgtaagaaagagacggagccatttagcaaacaaactccaagagtccacaactgcccgctcctcgagcggtgaactttttctctttttttaaaaaaagaagaagaggaatgctacagtagacccagccatttttcaattctaaacgacaaaagactgtttattaactagtactactagtctatttttagtgattttaagttagaagttaagagtgttactgagagcaagtttaatagtatagtcaactactaacttcaaatcatctatagtcaatgtaatagctaattcatacaatagttgattactatactattaatacctcgtcatactatcatacacacattacgtcttgtagtccgtgctacaactgactacagatctgtagcccgatgcttttttttctcttcttttatctctttaaaatatatttatagctggcttatagcctggcatctgctctaacgtgtgcaagttggatttcaaactttcttggcgtcaaattaattcaaattatgcgaagtggggattgcatcctagctcagcttgtattgattaagaaccttgcgttgaagtttggttcctgttcaccaagtttgatatccgacccgttcgaggtatcgacacgaatgctcatacttttcttgaagttaaattacaccttaaagcaagtacaataatagactataagtcagctataaacttatatggagaagacaagagaggagaaagaaaaaaaacgggttacaaatttgtagccagctgcagcacgaactctgaaacgttacgtgtgtatgacatgtgggaccaattattaatgatgtagtatatatttgtagttaactattgtatgaattggctattagattgattatagataacttgaagctaatagttgttgtctatagtattagagcctatttggaggagcttaagattataaaaagcagctagttggaagccagcttctgagaaactggaaaagctgggtttctgagcttctggcttctagttcattttctggattatataactatatcttctcataatttggatcaaaagctggactgtttggggagcttctgattctatgagaagctgcagcagttagaagctcatcaaatagaccattaaacttgctcttatggttgtgtttgatacaggaattcccaactcccctctcgttttccgcgcgcacgcttttcaaactactaaacggtgtattttttgtaaaaagtttatatacaaaagttgcttaaaaaatcatattgatccatttttggaaaaaaaaactaatacttaattaatcacgcgttaatggaccgctccgtttttcatgcgtgggtgatgggttcccaacacccaccaccgaacacagcctatatttgcaaaaataagtatgggtagaaatcagattttgtacaacttactaaatagttatgctttgttacggataaatataaattgcccacatgatagtattgtttagaatatacttcgtctattccatattgatccccatataaatttttatcaaaaccaagcaaattttaactaccatatcggggtaatcggggtaattaaaagcaagggcgaagtgctcgcacgagagaatttgggacggcgtggacgcacgcgcgtgtatccacgtcgccccccgcgcgctagaaggctgttgattttggtgcgctctggttactcgccagcagcgtcgtccgatcaagcatctacgatgaagagcgctggagctggtaattttgcaaaaaaatcctctcttaccttgataatctttcttaagtcctcaatgtaagttcactgccttaggccctctatatgactgtccaagtataggacagcgccctgaaaaagagaaagtaagggagttttatgaaaaaaaaagaacacccaatccccccattccctcgaaaccctagccactactgttcccccgtcccttctcttcatttcccttgcccttgcgccgccgccgctttgccttctcctcgccggcgacgacggcttgcccctcgagcttttttgccgtccatcacgcgagggtggacgggggagttaacttttggctgccctctactgccatccaaaaaccctagccgcaccgaagtcgccgcctcctcacaaactcctctgcgcgttctccttcgtccaggcgctgctgtggtcgttggtgaatcgtcgacgccgtggtgaacctgcggagggaccagaccacgtggggctcggggcgaggtttggccgtgacgcctgtcgtcgcttcgtcgccctccccctgcccaatctctccatctctcttcccagttaagcagggagagtggtcatgatgcagaacgagggcgagagggtcgatctgctggccctgccactcgatccggtgggtagacgccggcctccccctcctgcgcttctcctcgccgccgacgccctcccttcccccaacacacacacacaccataataatactactcctctctcttcccagttcaagtaggggtggtggtgatggagatcaaccagggctgctggtgatggagaacgacaacgaggtgatcgatctgctggcctatcgctagatccggtgggtacatgcactcaagctcgccatgaaggtctggatcagtgatgttgcattgccatgggctattgttgtgttgaattctccgttggttagtagttctttgtctctgtaattcatatttgattccttttgctttgtgctctcttcagccgatgcaatccttctccatctccacagtgggttggcgcccttctgctcaagtttgaagctccgctgccgtgcggcgccgacactgtttcgcaattgcagatctggccagcaacaggtaatctgggaaccatctgtcgtcgcctagccaagggccatttgcaattgccttgccattgttatttatggtgtaatttacttaggggcaatggatgtatgcaacttcatcattaattgagaatccatatgtataggtattttgggaacctttttttttttgccttttcctacttccacttcaattttactaggtgatattttagttccacaatggttcaccttgaactctttttctaaatgacaatcatatttaacgaaaccttcactgcatgttctgatatgattgctcaccatcatctcagccactatctcaaattgcttattacagtggtcggaggtatgatattttgcatgcctcttacaagtaatgctatggcctatgtaaatgtctgcaagactacaaggaatctgtgaatctatcctgctctgctgagggattctttattttagtacagtagagaactgagatcagtgcaaatcgaggtaattgatgtttactctcacttactacacattttatttgttgattcacattacatatatgcttctttcaaagaaatgaatgtccccgtttattagagattgtttaggggggagttgttttctaaatgcctttgtgcttcatttacataagcaaatgtttattagtgttgatgcttctagctacatggttgacaacatataaagattaccttgcacataatgaaactgaattggctctttttttttcctaaagaaactgaatgggctagacctattttcgtatacattgatatattccattaattgcattttcaagtatacacttatattggtttctagacttgatacttgcttactaaaggtttctggacttgatacttgctcactaaaggattttatattgcagaattcaggctctatttctgctccttaacatcagaattgaagttatgtggcagattgtgttagaacaaaaaccttcagagaagctcaacatttactaatagaagtacgtttttggacttgtgatgcttctggtgaggtttttggactagaccaaccaatagcatttaggttgttgggctcggtgagatcattacaagcacttgaaggtaactctgttcttcatttggcctttaggatttgagaggcaaaaatcattgactaaaattacaaactgtaggtctggctaagtaattggatgattcactgtggtgctgatgcaagtcagcattggtagtctttgaagatgcagaatgaactctactaatttagggctaagccatgctgatttaaactgatatatatttagtgctcctatagcaattggtgaagaaattgtgtggaagtttctgttacaatgatgaaattaagaacatgtttggtaatatataaatactataaattggatctgaaacgtgttgtggtgagctatggcacaaaatcctctttccatgaattgaacacataatggttagaggtcggagattaatgatatggcctatgcaaatatctaccaagattcctacacccatcatgctctgcttagggacactgcaatttgctccagtagaacttgaaatcagtacaaactgctaagtgggctaattgctatactctttcactttctacacaattttctttggtgattgacattacattttttatttgttcttcgaaagaaaaatgaacctttcagttcctttccatgctgaaatttcatacgttgagtgccagttacaccaaaagagctgaatgcgtggagccacaaggttgcaggcaggtcaatatactttggagctgtgatctgttgctctgtagatcctgtgcagtcagaggtttggtttgctttgtaaggacgaattgattttttgaaactagaaactcaagtgaatttggcacacaccattatattgttcttattttgcatctgattttgaggtgaagttcacttggtcagttaagttatagccaccaaaggttccatatcagattccacatatctaaatgctcatttatattacatgaaatacttcatgaaccatttgtgcattttgtaggttgtacaaatggaaccttccatcccataattatggatatgaattggtaaataactctgtaaattaaagaaaaaaattccttttaagcttttgtacataactctgtaaatattttcgtgtcaaaaattacagatggtgatagtaaaattatatacaattgcggatgtgataatatgccttatataatcttagtagagctttttgaagtatgcaaatgttttttactgttcaggctactcctgaagttcgaagccttcacattggtcaaatgttttcattgctttagattaggtgctctcagcgtctctctcatagtcatgctatttgctctgctttgaagctacatagctcttaatgaaatgtttccctattaccatctataagctacatagctcttaattaatgaacggtagggcgccgcgaagcgcgcctaaaagtcctagtatttatttaatgtgagcatatatggtggaagagaactaagaaacacgcagactttaagtcccacatgcatagaaaacgaggacttaactacctatcaatgtctgcatacatgcatgcctaaatgcaatataagctacatgtcaaacgaagagtccaaggttatatgatgaatgatgattgatatagaatagaaggagtattagttttgaggattttgtaggatcggactgtaagaactaagttaaccagaagaggtgaatggttgaagtaccaaaaaactgaaatttttagcagaactaaaagttacacaatatctccatcatatgccatatggaatcttcactaaccacgtgcattaatcgttagcctaagcatcttgcattatatcttgatcgtctggacgtcatcttctcccaagttgactcccgattcatcattggcaacgctcttctgaggcaaatcacttacacatgcaccaaccaagaaaccatatctgagtgcaagttctcaccaacttgactcactaatagcaaataacaatattacacactagtatctatctagaaatcataaatatgaattatccatggatatctaaagaatcgatcctaaactgaaaccaacacaacgtcggtcggtcagaccgctcacatacgttggtctgataagcaaccactttgttagtaattcttgttcatcacctgaaaattccaatcatctctaaatccacttcgtcaataatctccaaatatcaaaaccgataatatcatatgccaattgttcattacaaaataacaatcaaacactttgattttactgattttagaataatacgttattgtaggccaaagccccgattgtttattattaagatgcaaattatacatcggattcggttaacacattttttaaattgctaaacgatatgttttgtgtaaaaactcctatatagaagttgctctaaaatattaaataaacccatttttaagtttgcaataattaatactcaaataatcatgtgttaatggcttgccttattttatgtgcgcaaaaaaaatcttcaccttcatccgagacaaatgggagccttagaaatgaaataagatagaactgtgcaagattattttgtaatattaaagtacatgaagaaattatcgatatggtggggagcacattcagtactatcattcttttagaatgtatactgctttaacatcaatcatctctaatttaaatttcttcatatattatttttaaccactcttctaccactaaacacccttactccctccatcccaaaataactcaacctaaaatgagatgtgacccatcctaagggcaacatcaatgttacttgcccaacttggtagtagtgtgtcagtagtatgggccaggtctacaagtagtagtaagcaatcatgcactccacaatgtatcagcatatcagtaggaaacaaggtagggccagcttcagaaaaaatcaccgatggcaatctctagccgtgacttatttccatgcattttatcagaaacaccgtgcaaataagatagtttaattcctgttacccgattgtagccgtgttaccgggctgcaactacttactagtcctacaatggttactaccgggtaataagtgagtatttaatgcttattacctgctaaaatgctatattgtggataccctaagagtgtataaagttggagtagtaaatggctgctatgtagatatgttgaatggtccaatcgaatgtagaatggtcccaccacacatatagattgtagaggcatatgtgctcgtccaattgagatcctctgcagtactgcatgtgcagtactgctcactaacatgtgggccccacaggccctcgggcccacatgtcagtgagtagtactgcacatcgggcccacatgtcagtgagtagtactgcacatgcagtactgcagaggacctgcatccgtgctcgtttgcatgcattacaagtgttagttttttttatctaggaatgaatgcttattatcaatccctagatcccaatttgatcatcctctagtaaaggttaacaagatcaataacatcaaaatacttcctccatcccattttaatcattctctaagggtgtgtttggataatgggaaatgagaggtgggattgggattgggaaatgaatgaagggttaggattaaatgaaagggggagaatgaatggttaggatttaaagatgtcttttagtgggtgggaaatcatttctctatcccatttgtcaaacatggcctaaggttattgaggtttttccaaaatgggcatcatttaataaatgtatcttcgtttatttatgtaaacgaagagtaaattcacatcattaaatatgttgcatgtaaccaactaatattattttttattagagtaacggtatactacaatacttaaaatatgagcatgataaaatcatgggacatgaagccatgaagcaccttgacctcgggatacattgtttcccatggatacagcaccatttcagcccatattacatggacctctcttcgtgatgccttccggaccgaatcacttgggcctcactttgcatacgagcccattccatcctgtatgggccgcacgtagccgaactcccagttccagcccgtcatatttaggcgggaaaagtacaccgaaggtctctcaacttgtcgtcgggataaaaaacgtcatcgaaccacaaaaccggatatcgtgggtcccttatctatagaaaaccggttacaataggtccctcggtggttttgatcccgattttatcctgcgtggctgctaagtcagcgtgggaccttatgtgggtcccacatgtcaggatgccacgtcaacgcctttctctttctcctcttctctcccttctctctctcacttctctacgctgcgcaggctagccgacgggaggggaggaggccggtggggcgcggtcccgcggcgccgcccgccgcgcgctccgcgaggtgggccgcgacggcatcgtcgtcgtcgccggccgcgccgtctccggccagttcgccactgctggcgaggacgcggacccgtcctctggcgccgcagcggcggcagcgtcggcggcgggcaggcgggtgtacgtgaggaggtcggtcaccggtggggcgaggcaggagtgcaggaccgccgccactgggcaatcaaaccgatttgttaccatggtgaacacccagaagcgaggttctcaggctcagcattgatcccgttgttcaatggaggaaccacattggcgaggacgagcatagcttagcttaattaactaatgataagctcgagctagctagcctatatatacacatggcactggctcttgcatctccacacacacacacacattcaattcacatacaaaaactaagctagctaagctagcgagattatcacagtatatatgggattcacggtgacgaggacgagcaggtcgctggtggcgccgtcgtcgccgacgccggcggagacgctgccgctgtcggtgctcgaccgcgtggcggggcgccacctggtgcagtcgctgcacgtgttcgaggccggcggcggaaacggcggcggcggtggcgagccggcgagggaggcgctggggaaggcg

SEQ ID NO: 32988 - DNA, 5276 bp, Oryza sativa
aatgatgtggtgccttgcaccacgggcctcttaaggtacacccgcctcccgccgccgacgccgccggcgccggcgccgcagcgccagaggaaaggtctgcaccagcggtggcgaactgggtggagacggcgcggccggcgacgacgacgacgccgtcgcggcccacctcgcggagcgcgcggcgggcggcgccgcgggaccgcgccccaccggcctcctcccctcccgtcggctagcctgcgcagcgtagagaagtgagagagaagggagagaagaggggaaagagaaaggtgttggcgtggcatcctgacatttggggtctacgtgggttccacgctgactcagcagtcacgtaggacaaaaccaggatcaaaattgtcgaggaacaaattgtgaccggttttatatagttaagggatccgtgatatccggttttgtggttcgagaacggttttatcccgacgacaaagttgagagatcttcggtgtactttttcttatttaggcgtcacgtagcccacaatcctcttccatcctatcctatatgggccgtatttctcagatacatatgggccgtaattttactagcagtactgttctttgaggcccaaatcacacgggccgcccgtttcgtcgcgatcaccaccaccagcatcgcacgcgcgcaccgcctccgaaaacttttcgtctccccgcccaaatcccctccgcctcctccccctcccaaaattccccaacccgcaaccttctcgaagctcccgcgcgcggcggaatggccgcgccgcctccgccgccgccgctgcaccccgccatcatcatcgatgacgacgacgacgtaagcgcctccttctcctcttccggtcaccccccctccgctcgcgttttcacctttgctccgggaaaccctaacctcccccccgcaggacttcgactgggaggcggccgtgcaggagatcgacaggcgatgcgccctcgcgtcttcttccgccgcgtcggagtcggcaccgccgccggagccctcggcggcggccggcacgcggcagttgacgctcgaccgattcgtcgactccttcaccaggaggagacagatggcggcgatggagagggggccgcctgtgcctgcttcgccgcccgcagcggcgccgatcctaccgagtggcgccaggggcccccctgtgcctggttcgccgcccgcagcggcgccggtcccgccgagtggcggctgggggcgccccagtgaccgcgccggtgaggggtgctcgcgtagagcggacgaggatgtcgtgcctaagccctgcggcgttgctctggaccacgaggcagcgcgaacttggatttatccaagtgagtgttctccatttctacctgcatttcgagaagaatcactccgtcatcagtagttttctagagcattttcattggcatgcaagaataacctggtttagacacaattaattagtgcatgtttcagtattggtgtactaagtattttgattgctcatttggacctcagaatcttttttttttgtatagccttctaactccccagggaactctcctggactccctgtctccactctccaacatagatgtgcaaacattctgttcctcagtgattaataatgtaacgattccaatataagcgaaacaaaaaataacttctgaaacaccactcaaatgctcatttctgttcttgttgtagttcacttctgctgtaatcatgtttgctttgtaaatagttagaggttacacataataacttagctctctaaccaaggtatcaatgtgtcagctgtgtaatttaagtggcttttgttcatgtgttgcagctaatgtacaagtccgagagtaccaaaaaaaatttgtagagaaggctttatttaccaatacactagtggctttaccaacagggcttggcaaaacttttattgcagcagtagtgatgtataactactttagatggtttcctgaaggtaattttttgtaccatgctggaacttttttcctcttctgttgtaaattgggaaaaaccctttctgacagttggtcttcttatcttgtaaatctgaaaaaataaagggaaaatagtatttactgcacctacacgtcctcttgttactcagcaaattgaggcatgccataatacagtgggaataccacaggtattaatttctttctgtagatgttcatgcttatctggtatcagttgaagatcaaattttcttctctaccagtacctggaactattgctttttacttgttgcaggagtggacaattgacttgaaggggaatctaagcccctcaaagcgatcatgcttttggaagtctaaaagagtgttctttgtcactccacaagttctacagaatgatatacaatctggtgattatttctcttgtttgtccaattgtcctatgcttttaatatttttattggatattttacaattgtactttgtctttgaaagttccatgtgttgctttatgagtagtttagaatggcaagtggcaaccaaatattgatttatttctggaagaaacagcatcacttcttttctcgcatagtaaaaacacagttgcactagagcttccattgaaatggagtcagcacaaaagaaggcagaaattttgtgcataacagatgcatataaaagcccacacatgacaagaagtcatgtccaaacttgtagttcatatcgcccctgcaaatcatgtgtcaactcagctatataatttactcccatttgacactagcttcaccattctcttccacctttcattaagtattattacctcaattttatgtttggactgcccgcttcagaaatggaccgaccacagtagtttcttcttgttcccactatctttaatgctaccatttctctgagttgacattgttaatttggcttttggcagggatatgcatggtgaatcaactcgtttgcttggtgatagatgaagctcatcgagcctcgcgaaattatgcttactgtgttgtagtccgtgaggtatatttgatacccaagcaatctcttttgttggttatctttcatgggtttcctccatatcaagctcatttgaagaagatgatatcggtagggtgtaaatgaatgagtcgttctgacacctgcttgttatttttctacttttctgctttgttgacagttggaggcagctcgtgtgccgttaaggattttagctctgactgctacaccaggatgttagtctcctcaaaattaaatagaagtgctgaaaaatggagatgcttgctaatttttcaatcctgttttattcagcaaagcaaccagctatacaaaatgttatcaacaatttgcgcatttctgagttggttcactgtgatgaaagtgatcctgaagtcagccgttatattcagaggcgcacagttgaacctttagaggtgtgcatggacagtgataaatttgtaagttgtctatgctgtttctctcttctgaagggtcacttgtttcaatgcagataccagttggcgatgaggctgaacaagtcaatgataagcttttggatgttatacgtccacatcttgttaaattgcgttctgctagggtcattgatcacagggatgcttcaaatgtatgtttcatgctgtctttaatacatcgatcatctagatgcattcattttaggtgaagaatttatctacttctgtcctgatgctttgctgctcaggcacttctgatttgctactcatgtgcattattaattgcttattttttccagtggagtccacaccagttgcgcatgttaaaggacaaatttgatcaagcacccccgccaaatattcctttagcagacaaaaaggaaattggtatatcttttcaagctctaaccttactttatggcattatgaaaatgcttttgagctatggtatcaaggcagcacatcagtcaatcgaagccaaatataaagaagggtattgcctacactctacaaacacttctattacaatgtttcacttgcatgtcatcatagtgcataattaggctcctaactgtggatcttctgagcatcatccccttgagcatgaaagaatatcctttacacttttactgattatacttttgcaaagcagtagcagccctagtccattctgtttagaacttcgatataatataccaatatagtgagaattcaggagcttagtcagttcgttgtatttgagctgttccatatacacttctgatgatagtactgtttttggtaggttgaatggtatatgtaaataagtacctgaataaagcttgtagccttgtacatctcaacaatatcattcttccagttcctgttcccatcccatctagattcttttatttacccttgctaccttctactcaccaactactgcaccatctgctagaggcaatctcatcctccggtgagccatccctacacttgagcagtgaacacacccacatctcatataaattaattgattgatacactagactagagatctcacccttttttttttcttgattctgtgcatgctctaccgagttttacaagaaagtcttccatgcgtgctcaaatttatcatggcttttgtgtaatgaagatcatggaaggtgcttacaagaaataacacatttttggaagtaaagaaaactatggagaacttcttatctcaaggcattctcagtccaaaagttcggacattggtagaagtgttgctagatcacttccgtaagtaactttctcgtaatgtggtacatatatcttctttgtctagttgatcaataattctataatgtatactgcttgctatacaacaacctactcattctgtaggacaactaatagctcaatctatcagaataaagtttagtgcatcattccgtggatttgtatttttgtaagaatagtaactcttttgtagtatagaagtgttttgttggtgaaacttttctgtttagtactccctccgtcccaaattatagggcgccctctttttaaggaaaatcaaacttggtaacttttgactaataaccatattaaccatatatatgctaagtattatgcatgttatatcaatagattcatattttaaagtactttcatgtgatgctaattttatatttgttggaaacatacatgtaatatattaatggtcaaagtatgtcattgaagaccgcgtaaaagaaagaaaaaatataggccttataatttgggacggagggagtattacagtgacacctgaatatttttcactagtattcttgcaaatgggcactctgtcagttcc

SEQ ID NO: 32989 - DNA, 15995 bp, Oryza sativa
aattttaacagaatgagtactagatgaaattgtcaaagagcatatgtagagaatgctagtagtatgctagtcagattaccatacatgttcattttattcatgccagcattgaccaatactccaatagttactttcataatgtttatacataaatgataccactcatgaatacacgattcacatttccagtgtgatattctaaacccttgtgcacaagtataaaataatttataaatggaatcagagggagtactgaattaatacatggaaacctacaatgtcaggacagaaggaagttgtgtttgataacagcaatagctcatattaaacatggacaccaaatggatagttggaggcaagtcagcttgggaaaactaagctttacatctttttgtcaacatcttaaatcttctgatccaatttctttacttttcttgacaaccagctataatttataaacggcgaattaaggcatactagtgctgaacatgtcactatgcactggatatgcatattttactttcatttgtaggggttggttttaagtcagttagtgggtcttgcatcttttaaacagttccctatcaactatagctagcattcatgtcttagtttctctgtgttggttttaaaactcaggatgccctataattctgatgaattctctgtgctattgtgtatatctccttgctccagcaaacaatctgtttgttattttagctgtgcatcagaaacaatgtacattcgtgctttgcttaattgtctgtcagaaccaatctattatatggcttgaatgttttgttatactgtgaaacacagagaaatattgtgctccctaagaaatattgatggtgaacttgtgaggcctgctgcattcattggtcaaagttctacaggtatgataatgtgttatcggtgatcagctgagatttaattgtagatcactgatttcatagaagtatgattttgaaacatatgatctatagttctttactttttatttcaatatgctaagttcttcaattagaatatgtgttctggtctgattttcattctccaggagtttgtagcattttggatggtaatgaccatacgaaataaacatagtggtctcctacattttcctttatccaagtagtttagtggtagtaatattctatgaatggagcatttatgcatttaaacatatgaatcatatgatgtgtttatttatttcaagttttttgcctttaggtgatcaactgaagggccagacacagaaatgcaacaagctattttgcatgtattgaactatatactctgctcatccatgatttgcatttttttcttctatctgactgtaaattgtttacagaaattccggtctggggaatacaatattttagtggcaacatcaattggtgaggaaggactagatattatggaggttgatcttgtggtttgttttgatgccaacatctccgcattaaggatgattcaacgtatgggaaggactggaaggaagaacgaagggagagttgatatcctttttttggttggtgaaaattgaaaattgccaaagtgccgcaaaaattgcattttttaaatgtatttctctctcaggcattggttaccttaacttcccaaactggttttggcttgtagcggacaggagatgaaagggtacttaagtaagcaaggaaatactaaaactatgaagaagttattgcgtgatcgtcgcagatttgaataccatgatagtcctaggatggtaattctttttatcatcgtgttcataaagttgcttcttaaatctggaggagctaattgcgtaaattcatgatgcaccctataggttccacatgtttataatccagaagttaagtttgttgaattatccatagagaagtatattccttgctcaaagaaaagcaaagttgatgtgaatgtcgcatctccaatctttaataagatgtcagaggatgatggtcgattgattgctcggtactttggtgcatgcaaagaagatttctggaagccatctcttgttacatttcctagcttccaggtttcaccatgtgatatctacagagtgccacattcgttccgaacaacgaacatgctaattgatgctatgcaacaacttcaagatctttctttctctaggacaaaggtagattcattgaagatctgtgtgacttctctgtagtcatttagaaatgaaaacagaagtcctaaaattttctgaacaccttttcagtgtgcaagccctttggaaggacctgctgatgtaccagttgtaatggatgaggcacccgaaggtcagtgcttgtcatatccttcccattttagtttactcagttcatgatattaattttgcaatgttatcagattctaaaaatggtttactggttccatatatagtttctttgggcctacggtttctttaataaaatcattttttttatttgagaagatcaaagaagaaattacaattttgaaaggaagcagggctgtttaaaactaatgccgagtagcctcctatagaggttgggggtagtttttccttgggtggttggttcttcttccaccgtcgatggcattctgtcagttcccggcaaaaaaaaaaaggattttttttattcactcagcttattattgtgcatgcagagttttaagcttgctcttttctgattgatatatgacattctaaacctgtgaaccatttataggcctattcggtgctgatggatcgaaagaggtaattccccaggaatattgtggtttggaagttttatccggtgaagctgcatggagtaaaaatgttctcgtaccaagtttaccgattaagaaatatcctgtccactctttcttcagtggagattagtagccatggatgttagcggttatgtctcaatcacctttgtacctgctctaccgaggacatctgaattccataaggatgccaggaatgtaaattggcaccaaaaggtccagaacaagaccacgtccgtcaaattggctgctgacatcagtagaccaacgattgaattccattgccttgcaggttttgcttattcaagtaaacctatccttacagatgagtttggtttagttccccattcacctgaatacactgaaagatatggccgcactgatgacagacatgtacatggaactccacctcctaaaacattggtaagtccaaaagaaatatgccacaaaccctgcaattctaaaccagtgagccaggtctgtcaggtcaagaagatatggagcttagtccaagactaacatattatattgaagaaggaattgttcctgagtctccgatgcttgaagttggccacaaacatttagagacagacagtgctgcaaatgctgattttgtgcagcaaaaggttgatttttcaaaatcacacagtgagggagcaaaggccaatgagttgaaatctagaaatggacctctgaactttgaggggaaagggcaatttttttctgagatatccaaacttgctgtctcaccaggagagaatgccctagatcagactcaagcaaacaaagaagagcggatgcatccatcaaatgtgaaaatacatagtccagctgctcatactccaatggcaaatctactatgtgatagtttctctgatgattggcagcttaggtcaggaggggacacaccagggtcagtccgggaagcacccaagtacaaaagactttgcaaatatgctgacaagatcaaaagagtttcctccatgtctttagatgacagatatgatattgctgctggaggaaaccacaattttgctaccaaaagtatgttaaaccttacacactattagtgagttgagcctctttcgtgtaattctctttaattttgcaagtttctatttaggcttcttaaccttatactataatcacaactttcaaatctctcttttttttgtgcatatatttgatagattccttttgattccaaatctaggaaacaaaaggagggccaagatgtgtctggatacctttattgatgatgaagctgagtatgatttctaaaatcttttatataatatttagcaaacaaactaaagctggtcctgtaactattagtagagcttaccaatatgaatcattgtttagattaatttataaatgtcttacatgcactagggtgtctgaagatgctgatgtttcagcggatgagggtaatgatcatagtgaagataattatgaagacagttttattaatgaccaggctactcctacgggccaatttacccaaagcgtacatcatggtgaaaacagtggtgacatgatggccttctacaggtattattacttgatcaaacaacactttttaatttctacccatgtgtttgttttgaacaatcctgcttgtgtcattctttctgccccccaaaaaagtgctgttggacatgtcccttgtgcggttgcaatttcaacttttcatgttcgatatctgtgaagtcatcagtacagtcccaaattacagtatattgctttacaaccgattggttgtagtggagctgtacaattgccagttgggctttgggcgcatctgcgattagattaatttgaataagctactcagtatataatgcaaaaaactagcagcatttctatgttcgcctagaagttctgaagttgtaatcaagtatataaatttatttaaatttttgtacattgaatacctaatgacaaagtggctattatgacacaaactagctatcttatctgtaagaagtttgtacatcagccatgttggaaactcggaaccagataaatgtggagtgagcattatcctttttcagttcaacagtagccaagatttttgtatagatgagcatcgctgtggcctgtgtcatgtttctgtacttttgattaaatttgctgaaagaaactttgaaactcaatttccatctgatgttttttgcaggcggtcgctgcttactcagaccccaatagtgctgccctcaaggtaccaagatgtccctgacaattctgcttcaagaagcggaagcgcaagtgcgagctgttcttcagagaacttgcacaattctatggagactccacaagggatccatcaaccacaccacaccattggccctagtcctctaggggaccaacaaagctttgtggctagggccagctcaataaaggaacaaggtgaaacaagtctagcccattgtgagtcatccaccacattagactgcagaaagaggaagctaagtttccaacaagctgcctccatccctgttataaaccttgaaccggaactggcaccggcaccggcaccacaaccttcctcacacattactactggagtcaacaataacttcgtttgggacgacgatgatttcttcgagagccttgatctcgatgcaatcgaagcacaagcgaccgaactctggagactcaagaaagaacaatccacacagagatcctttgggaactaggcaagcatcagagataagccttctcccctttgatttagggatctgagatcgtgagagctcatgctggtgaagagtcattcagaatgttttatctagctgttggaccagatcatcctggaccatggtcaggaatcctgggatggctacagcatcaacctaccagcccgattactcgtgggcttttcaaggtttgagcttgcagatcacagtatcaggcaacaagatattcaggtgaacactgtttttccgcccataattacatcctataccattggatatttatggggagcttggaagatcaggacatgacgaagcgagttttgtaggggcatggactgttaatatgaatgtatgtatgtgcatacatcccgtacatatttatacaccctgtatcacactagttttctctctgtaaatataagttcttttgctgtatacttccaacacctcgttggataaatgttcttctgatagcctagtgagcagtatggcttctgcttggatggagccatggtcgcagctccttgctgctgcaagtgcttgcttttgcttgcaaggtatggcatagtatctttttttttctcgcctcatgtggtatatagcaatagttgctggtggttgctgcacagaatcagcaggaaaatagcagtagtaggacactattatcattattccgtacctgtcaattccgtgtcgatcttaacgtgcaaggttcggcgacaagctcgatagtgttgttgaagtgtgaacgtgtagattctggcacatgcattaattccctcacgcgtttcttcgtctcgctctcaactgtcacaactctcatcactacatctatcaacataccacaacacgagcgcataatatctcaaatctctcgcctcgcacgcaatgcaggttatgtttggcacggtctagatcagcaaaacagtttcagctttagtttcaactctacctaaaaagaaaacgagctggatagagttctcacacaaaataaactaaagaggtagagctgggtttagacaactccacaacttcagagctaaatttaaaagttagaactctaccaaacatgccagtagtaatttactgcgccgcatatgagcttaatatttctctaaaagtgtactcaggtcccgttctttttcgagtaaaatatagattttacctcgatttcattagcacgtttttaaactattaaaccatgtatttcgcgtgaaaactttccatataaatgttgctataaaatatcagataaatatgtttccaagtttataataattaaaacactactgattatgtgctaatggatttctcgttttttttaaagataactccatctttatctttagggcatgtacaaaggtagagtcggatatgagctctacgttatttagagtcggatatgagctctacgttatttagagactagcatcctacaacagttagagacaatatggtctctaatcattaatgtatcaaaatactttttcttacttttattttctttctttcaccaccatgcaacaaaatttgctttagtaaatgctaagagtcgactctgagtcgttgtcatgcataacaaccatactcctttctctttcctacatgtcaccaaatttacttgcatggtaatagagagagaccactaataaaaatcgttgtacatgcccttagtagaaacaaacgccacctttatactaacaatttagtgctaataacaacgtttaactctcatatcacaactttaaccgatagtacttttttatattggtctagagttatgttttgttggtacaatagtcatgttgttggattctctttcataacagcgtggaggactcatattagctttcggaaaaaaaaaacaatggttgaagtcagtatgctcaataaaacgttgtcattcattgaacaatggagtaaaatactaaatccaatatccatggttgcaaaagttactgcagtatcaaaacacattgacagacgacaaaaatagtacgagtagtacgaagtactgtactacataactttgtacttgtgaagtgtcaaacatggaaaagtagttatacatgtcaatgatgagaatatgagatgagtattcctgcgactgccccatcgccaaacatcatacttgtaaataaaaaataatttataaataaaacttttatgtatgtgttcctaacaatccaaaaacaaaaacaaagatgattgaaaaataaactttaatgaaaaactttaaaatcagcttcaaatttaaagttaaaaaattaaattgtttaataagtataagcataaaataaaatgaggctcgtggtctgaacagagagattctggggtgacaattacgagcgatgaaaataacattttctgatggcgtatcatggagaaagttcttccctggtttaccagtaatactacgtaaagcaacgtaatggcctgcaaggaacagacaccgccggcgttatttgtttaatgatccttatttccatgttgaacaaatcaatgtgcatgtgtgctgttttgatgtcagaaattaaattgaagttggttagaatattttgtttctgtcgtgttcagagaataacatggcacatggacgacctgtactcagatgttctagcttgttcttttaacttgatctaccttaatccctaagatattagtattaatacactactatagccacgtcaagcataggcgcttctaggggtggtcccagtaccacccaaaaaatcctatcccaatacatatatatttatatatatgcatatgagaacataaatcttaaaaaaaactcttttattattatattactatgtatatttgatcaatttatacttttaacttagttatatttagggtatttaaaaaattatataagttagaccacccatacatacgccactgacgttaagtcacgatagttttctgtaatatcacaataaacctactagtacttctagccattttcgtctaataatcttctgtgtcacttccagtaatccctagagctaaaaaccctagggaacagccaaaaactctagggatcgggtttccctacagtgaaccctagggaatggcccatagggaagcattctacgggaacaaattgattcccttgggttttcttagtagaatctagggaaagaagctttccacgtgttccaaaatgtagggattgaatgccacctggacagaaaaaatccaacgtggaaagtggtacggcaccctagggaacatttttattggagtatttcatttagaaattaatgcagattaatttagctcttaattaatcattgattagttttatttgtttattttatttcttttgcaaacaagccagtaagcattccaatcatatttttgtcaacttgcttgaacaaaaaatatatatactgcattataaagttaatctcaacagtaaaaattgggagtacatgcagagttgcccatcgaaaaacaaaagaaaaaaacacacacgcagagggagagtacatccagagttgaaaattgacgaacacttaatagatcgtggctttgctctctcaaaagacaaaataaaacacaaatatagccttctgcagtagttgtatccaatgcgaatggtacgtaatagcacttccagaagtcatcaagctgcaaaatgagtaggaaggttgaagaaaataagaacttatggaaatctgcagctacatatatatatatatatatatatatatatatatacgtgggattctctatttgttcaatataataagcacatgatttctagctttgattactaaccgcagtaataagttcttgacttctcggccttaccgatctgcatcaagcaccgaatccatcaaaaatcaaaacttcaaaatatgcacaggaaaatatctgctcgagtatctttgctaaatgctaactagagagcagctcggcaacaccacgctgcacaggtcgccgtggccttgattcacccctgtcccggcgtcgcctctcagccgcaaacaaatgcaatcagcccacgcccaccacggccttcaggagtgctgctgcaaccaccctcgaaggttgaagctcctgtcgatctctactacttgagagtagatttggtggtggagactggagagggagttgatttggggaggaagagatgaaagaacatgttgaaggaagaagaaaggggaaagtttagcagcttggggtactttattactttccaatggaaagcgaatatggtgtcagtccaaattttggattcacaaggcgggagaaactattacaacctttccacatggttggtttctgaaaaagtcagtggaccctgccaccgtggttctcctatcagtgccaactgtactagtttccctatgagcaagcaaaaactctagggatcatctcagttcccttgagttttagttccggctctagggaacttattatccccttgggttctaattagggctctagggaacatttgaaaaccctagggaccccgtggaattccagtagtgaagagagagtggtgttagcagttaacttaagaagaaaaaaagaattcctatgtgcctattggttagatcatgaaaactaattaagggatctagtacactcttaccataggtagccaaatggctgatgcccaccatctctttccataatctatacacaatctttgtaatggtatacatcaattgattgatcagtagactattagccaacagtatccatgctggttagtttaggtaccaaataaggggaagttggtaggtaggtaggtaggtacacaccacagggcttctagaacccaaggaaccaaaaggaccagcttggagttggaaaagttgctccaaaacaaaaatgatgaaacaaaaggaccaaaaagcatctccaagattaaatttggtagtagattggattgtgcactattaggtgagacatcagtgttaattagtgggttagcctagctatagttgctggccttttattttgtcctgaggccaacatgaaaactacctcagctagctacattatctctttgtccatttaccagttggaatggttgtcagtacgtccaatatgctcccaacttgtccccatctacggtgaagctgtacatacatttgtatggccattcattatttcattaaagattactcgcaaaaaaaatattattcggttaaaggatttcagggtatacacatattagataataactctatttctagatatagttcatgtacgctcctttagctgatcagacggctatcccgattcagtgtaaagcatacaccgtggatagctaaaagggtaattttaccaccttgaaaaagtaccaggaggtacggcactttttaatgtaatatttggtacgtatcttgaggtagcaaaaatttagcgtaaaatttagatactttgagatactattttaaggactataaaatttctccatttaaaaaggtactgataattagtaagaacccttaactgtctaaccacgatagctagcgccgttagctctttcacggagtacataaaaggtaaattattgaaagcaattatttaacatatcaactgccgtgagttgagccatcacgtagtactctctatccgatgctcgttaatgcgtccatcaattacaatatatatctagcttcgtcctaacataacatgagtacacatgactactgatggatgtttacttccgttgtgctgtgtttgtttttgggaccaaattaacctaacgcaaagctcatgtcaaatgaataactcttgtttcaacgacaacataaagtcgcatgctgtacaatggcccgcttgattaaggctaaaaatcagtgtccaaaaaaccgtacgatcgatgcaaaactgtaccatgttacggacttactggtaaggtttcaactttcaaacattatatcagctgggtccgtttagattatacaataatatatatttcgtacttattaagaaaactaaaatgtttttgaacaaaattaatgcatatatagtaagtgggggcctcgctctcttaattatctccaaccaatattgatgagttcttggtttaattatgcctagtacgacgacctaagtgtattatgttgttgtttgctagggaattcacaatgatataccaaccatgtgaagtctatcataaattcatattgcatatcatagggacatcattatagaagctgacctgccagttgcaataatattacaagcgctgccgaataataaatttcatcgtcactttctctgctttttcccctcctgaaacagggcaaattggatttaaataaaagagattattctaaccatttggtagaaggagacatttaagagccaaaaatagaacaaagaaactccaaatcttggaacgttgcgagagatatgattccggcatatccaaaaagtatataaaccagtgtcatcgaataaattggtgacctagactctaaagtcaacgagccgattggatcatcgacaacgcgatagataaaacttcctatgtctttatagaagactataaaacgtgacaaataagtaggcaccaacaaagaaagaaacaactcttaaaaaaataattctatcaacaccgtagaaaaaactaacttttatatataatagatctaccaaagaatttatgtggaaaaaactttggaacttacttagaaaccatcaagctggctatcagagggccggcagtgaggcggagttcatcattttattttactcttatctctgttcattttcctctgattttctgatgtggaatcactttggttggtcacaatactatatttatttaattgttttccataagttggtcaatttctctcacacatgcatcctcaattctgttaccaacttagattgcatctacatatcacgccattaataactatgaacactttcatcgggagtgccctaaaggaacattattatctggcacaaatctagctaagttgtcatttctaaaagaaatcttggatgtttgacaagatcattcatgtagcacgcttcttttgttcacagtgtttgtctatacccatcacacgtctcactacttaattgaatcaaaatagacgatgaataaatagatcgagtaacaactttataaatgtgtatagcttaatgcttaagtaaaccaattttccacacctcaccgccagaaggaaatttttgggaaccaatgaaagttaaattacaactacatcataccattcatatgggagcactctaatctatcaaggaagctgactaagtgactatcagtaaacacttttactactgacactcgatgtgccagcagagtctgaggggtccaactctagacaaaagtattaatcaattattagcagcggtaattaaattccatgagtgagagagaaaagtaacaaaagaatgaataacatattttccaattattaatagtggttatttaaagtctacgagtgagatagagaattaagagaagaaattaagaagaacacacacacacacatatatatgtatatactcccttccattctaaaatataaacacatcctagcagttttagcaaatattaacattgagtagaaaaaaaatgttacccttattaaatgggagatggttgatagtagacgagggtgattcaggataaaacatgcatgaagaaaattgaatgtggatgattaattaaaaaaaatactcaagtacgttcagatacgtaggctcaaataaatacttttttcaaggacagataaattaaaagctaggctcaaacaattaatcgaccaagcaaaaggtttaaacaccaaaattaagcaaaagggccattagacaataagacaaagcatttaattgttgatttagaattatgaagcaaccaccaagcgtaaaactcctgacagaactgatctacatgcatgcatgacccgtatacgtagtacgcaccaaccacgacgacgagatcacggaaacgcttcgttttcgctcggattcggttcgatttgatcttgatcgagtcaaaatttaaaatctgccgtactggtgatggtactttggatcgctttacctgcgtttttctcgaaggctgtcttttcgtgtgtacggacggcacgatcgatcgtacagataagtgtcatctggtctagggttattgttgttattaaggattagtagctgggatcgtcaatggtagatgagtttcgattcaaagcttccaattgacaaaaatcggggtcgtcaatgccagtttttttttagataatgaaataaataaatatcccggcatttactcaaaagagctacagccaattattacatagaagcgtttgacgaacatagggtagatctaattgaatagaacacaccgcaaggaacaataaagaatccagtctaatataaggagattacaattattgaagtctatttgtaaatctccaaccataattggcaaaaaattacataaccgtagtctccaacttccgacatgcaactttcagaaactcttcatcatctccacacctttggtcgtcaatgccagtaaccgtacgcttgcttgcagtcgcgtcagtcagatggatgcttcagtttagagacttttacggttcatggtactacgtactcccctcggtcccagaaaggcccattcctaaatcctaaagaaagattagtgaagagtaaaaatgactaaaatacccctcattgttagaaaaagtagtaattttaatcagaaagcttatacaacggtatctcattggaacgggatacccttctatgagatagtacctggtacctaatacaatgggatacccttatacgaggatacctgatacctgttgtggtaccaggctaccagttgcatggtacccaatacctgtgatacctgttacctctgttgtggtaccaggctaccagctgcatggtacctaatacctgtaatacctgttatctggtatctgtgatactcgtgcaagagaatagttaatatatctatcccgttgcaactagatctcgttttgtagcggtcctcattttaataggtagataaaggatatttaaaggagaaaacttctcgttttatgtgctgaggttaggtaagatggtaaaagttaatttttttttggacaaaatttaaacttcagaatgagtttttttaggacaggagactaagagggtaagggagagattaccatattattttaagtagtaaatcatattaggtagtatttctttttagaaacacaatacaaacatagatgctcacacaccctatctttataaacacacatcctatccctacctttaaaaaattggatcggcatatcttgatattgataaagtcattatgggcacatcgctgttgataggtacatcgtctaccaatttaaacctaaggaactggtttcacaacaatcagtgctttctcgcagagtttctcccgttcttgttatgctctaaactattattatgtttttaagcttcattcgaataaaagctttttccattgaacaaagtagtagtgtagtaccacaaattccctcctcgcttacatgtgcgtgcacgattcctggcgggtaaataagggtagctaatgacgccattacatcatgattcataaaagaaacggtgctgattaattaaatataagggtgaacgagtcatcttggtcccaatcactgttcttcctttttctcctacagtttctacggctagtccatctcttgactcacctccatactgtaccatgcatgaacaacaaggttcgatgtttataatttaattttcactggtgacgtgtctgacaacgaagaggaaaaaaggggcagagtaaatgtttgtcttttgttgtgtccgctagggaaaactttccggtggaatggggacatcgcttgaaaagttgtgcaccaactgctcttttgttactgttgcctcgtcttgttaatgtgatgctgcattgaccggcctgaacgagtgaatggccaagtcgttccttcaggttattctttctggattttggaagagttgtgacccggtcagagatagatgaagaagcggatcaattaatttagttttaattattttaatcttaaaaataaatatatatttgatattttagcaacttctataaaatttcacatgaaacacactttttagtggttttaaaaactttctaacgaaaattgagatagaatgtgtatcttaaacataaacgaacaggattatatcacggaattgttcaaggctcctcagagtaaaccagatggttggtgatcactcgattaagatggttgtcaagcctctccgagtctttccttgggttagtctgatcggttggcttacaactgataaaatgtaaaacaacatacaaacaactaaaaaaaatttatagacaaaacttttctactatattatttgcgatttaaaaaccaatactaaacaataaactatgataaaaactcacaaaattaactcttaaaattaaattttaaaattaaaattttggcacggccttataacctaaaaatataaattgatgggaagagagtttaggac

SEQ ID NO: 32990 - DNA, 18424 bp, Oryza sativa
ctatagttgtgattaaaagattatggccagcttgtttgcaaccaattttatgattataattagggtttttccgttgttttaagttacttggtacttttctaatgctaagaatagacgtgcaagtatcaacataaattattttctattgcatcggttacatatcttcagcttataaagccatagcttaaaaagatagcttccattcagccttgcatcaacatcgaaaagacataatctctctctcccagaatataagaagttttagggttggacacggttattaagaaagtaggtagaaatgggtggtgaagggttatgattggatgagtagtggaagtaggtgggaaaagtgaatggtggagggttataattggttgggaagagaatgatggtggagaagttgttatattttgggacaaatcctgggaagtagtaaaatactttgtggcatgtgtttactgggtactccctccatctcaaaaaaaaaactcaacctaagcggcgatgtgacaacaatttagataagtggcgatgtgataacgaatttgtttagattcgttatattgggagctcttataggttgagtctttttagagggaggaaatacattattgctgatcggtgaaactcttgtggattcgacaaactaaaggaaacaatccccaaaattgtggtagccttgcaccttcttgcaccttattgcgtcctaggctcctactcctacactaccactctactacttgtactagagaaatggaattggtataacagaagcaggggcagtacagggtgcaggtaagccaatttattgaagcagatgctacctacctcttgttggatttggcccaaggtgcatggagggagggtagtagctcagcagcatctcatctcattcattgacacacctttattattacaccaccattgctgctgctgctgcctgctgcctgctgcatctcttctcttccctttccttctcttggcttcccttcccttcctaggaatgccccatgagtacaccaggtctacatccacagctccatacacctgtgtgacaatagacaatagttaagttgctgaaatttcaaaaagtaatataattctagcaatgtttcacttcaaaaaaaatatataattctagcaatgtgacatcttgcaaacaccaaattaatagcatagaaaagaacaacattttgcctaccgtttggcctccgactgttagatccatggtgtgacactctgcgactgttgaacaattgcacttagattgatacaagggacccggccacccgcaattcagagacattagccaaggaggcaataacacagcctatttagtgcaagtactggcaccaactacatgttactatcttcattttgcaatgttgttccatagactaaaaatatatacaagaaaaaataatgagaaaagacaatgtataccacctacagaaacatactccgtataatataatcgccaacctcttacaaagcatttggttacgggtaaagagcaaaataaattgcaacaataatatattggcattggtcttctcagtagacaaatattgagatggataatccaataccataaacaacaaatattgtgaaacaggagagcagtaacatctgatgttgtagtgcatgaggaccgggtccatgcacagttccatggagggaaaagagggtgccattactgatgaggaggtcctgcctcctactagtactcaactgtggtggcctggtgtttgtagggggctggctggtctggtgactcgcgaattaatccaggtcacagaatgggttttattaatagtctacgtctaatatttataattattatccaaacatccgatgtgatagggactaaaaagttttagtcccatttaaacagagttaattaggcttaaaaaatttgtcacgcaaattaactcttatttatgtaattagttttataagtagtctatgtttaatactctaaattcatccgatatgatgcaaattagcactggaattggattggattggatggtgtaggaggaggagagcatgagtggttgttgatgggtgcatttaagacttcctggccttgacaaagataccagatctctgtactatggggactggccactcagctgcctgcacccaacaaggaggagaaaactaacctaacctctgggagttatttccaccaatcaattccctagctacccacttttccatgctccacatgcaaagccgaaggccaggagcctcagggcacccgtaatagtaaagtaaggtgttttttataaaatatgtatatctcagcaatagactagattaatagtaaaccaactcaatagtatgtctgcatgggtatctatagttctctaatccattgcctcgtttttctctatagactatctctaagttagtagatagctttgctctctctctctcttcatttaatctattccaaatagtaaaatatgctgacatggatctcttgtagagagcctatagataatcattacgggtgccctcacctcctctccaatctccatcaatttgccttgcctcctcttcttctcatcagtagatctgcatcatgttttggagcatttcttatctgcaccacaaatgaagaaacatggctgaatgtgacacatatatagtatagggtgacgtgtttacatcaacgcataagcagttttcatgctaaatagctaaatccttgcatgccagagcaaatgacagaaactctgaaagcacctgctatgaaaacaatctttcaggattgttattgtctcaattgatcgctttggataccatgcttgtagtactagttctctttttgatggagcagataagcacttttaactgtagtagatctggtggtattatctttggactcatgcaacagaaagaatgcaaagagtgaggtttcatggcaccaaaaggggggcagctgactggaccggagtaccacgaaaaatattctttagcactgtaatcaatgtcaccaccaaaccccgaatgagtttacaattcttaaggatacatcgttggagattaaaccattaaaatatttcttttgtttgaacatgaacagctgagcttactctactaggattacctgtattttgtcctctcaagactcaagactccaggatgtcctcatggaaatggaaacagtccaaccttcctctatattcgggttttttttttaaaaaaaaggaaccttcctctttagaattcaaatattgcagcaagactagttcgaacagtcctgccaccatcatgaccatttcactatacaaacttaaccaaacaacaaacaaaatagccataaaattgacgtaatacactcgtgatgatactgttgtcgcaacagctggatgtgtgaattccgatgcagcaagcatgagtacatggaatactcggcctaccctaaccttacaacatgtacaccaaccaagaataaagtaacgggttaaacaagtgcacaacttcctccatatcaagagggaggggaattaggagcgggaaggaaggagggggtagctcaccaaattgatcagattctcccctttcttgcttcaccctttccctttctttgctttctttcttgcacaatcacacacacaaagacatgctgctgggttttctagaatctcagaaaggagggggagctagcgtggggtgctagaaaaatgtcggtgggtgagcctgaaaaaaagaggaaagattacgggattgtagtagtagaaattaaaaataagatgagaagcaacgtagtctgagtcagagtgagggaataaacactttctatacccattaagcatcgccatgtgctgctgatgtgtgccccaaaaaatctactaacgtggaagtgggtgttgagccattgaagtttgtttccaactcagactttttcttccatcaagcaacagcaatcccttggaccaattgaaaaccttgggctagctcgtgtcccctcctgtccaatagaaggcatgcatgatagaatcaggtttaactcattgaataacaaaggaacgaaaacatagtacatgttgtatattatataaagtacatatagacgaacaacacactaaaaataaacaatactgatcgatttatgtgaacggcatgcatgcatcatcatcgtcctactagcaaaactaacaaataccttattcatatatcaatacacaattatacaacaccgtagatgctgtaataaaaaactttttttttgctgttaccacatacgtatttcagaaagatgtaccatcaaggacacccaccaaatcggaggcgaagaaaaacccctacctatgcgcgcccaactcacgcatctggtacactcaccgggtacaaccaacaatcccatttccaaaaacaaatcgaactgaaaaaaaaataaaagatgaaacaataaacaaaaccagacacagaaaaaaggaaagggaataggacgaggagcactgggagtgaagtatacctacctaccaaatccagccccgtgggggggagggcctttgcaaatggcagccactcaaccaacctccgctcctcctctcgtctcatcgcaccaactcggtcaaatggcccagagggatccgggtcaatggggccctcccctcctctccctctccctcgtataaaaccaaccaaccaccaccctcctctctctccttgctcacgaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagcatggggaggtccccatgctgcgagaaggcgcacacgaacaagggagcctggacgaaggaggaggaccagcggctcatcgcctacatcaaggccaacggcgagggatgctggaggtcgctccccaaggccgcaggtatatacaacgtcgtacaaaatcatgctactccggccatggcgtgcatggcggcggcgatcatggtcagaggtcgacggtgactgactgagtgttacctgtgtgtagggttgctgcggtgcgggaaaagctgccggctgcgatggatcaactacctgagaccggacctcaagcgaggtaatttcaccgaggaggaggacgagttcatcatcaagctccatgagcttctaggcaacaagtaagcctccatgccggccatcctgcaaagaagataaatattgtattagctatataagagatagaatcatgatccgatcatgacaacatggcgatggatgaatcgacaagcatattactgatcactgatcgatcgatgtgtgtataataacatatatctatatggtgtatatgcaggtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcggcggcgccccctccatgcaggccagcacacacatgtttagattcatcacgccgctaggaggaagccaccacaacagtagtagcacaacaatgacataattaattaagttgagggaggagatatatatacactacttaattcgcaattaaaacccagccacacatgcttagctctttgtaatattcatcaggaaatgtgatctctttctcttttttttttatttcccctcatttgcagcctcggccagagtgatcatcatgcttcatcgatcatcattcatcagggtgacatggttcatgagttagttttagttgttatttctttcttgtcttcctctagtttcttttaacccatatagatagttttttttagggcaagacatgggttgttgatgatctaccattagatctaaacatgcccttttggagacctcataagaatgcatcactcaacacatagctttccaaacactttatttccctcatgcatgctagtagcccttttgcaacttgtttttatgtctccttttatatggagatgctcttgattggccaaagatgagggaggtaaggagtgagtggtacatactgatgaaagtgaaggagggtgcatgctgtggttgtggtgctgctggtggttatgggaagttaggtttcttgatgaatgtttgcaatcacatgagcagccagtgagaaaaggaggcacagtttttaaagaaaaaaaataaagaaaaggtttgtcttgtagatagagaggagggagatcagggggccaggggggagagaatggagagcatgtgagatgctctctcttttttgggggggttaggttggtaggttggtagaagggatgggagaggtgttaatgaaggggataaagtgccatctaggagggggcatggattgaggagcttttggttagttaatgacttaatagtcggagcttggctcgtggtttgtccttagtccttgggtggatgctggtaacaggtggaggtaattagtattttaatcatggatcagtgctatagttagcacttaactaagctagcttcaggcttttctgaagaggagtgggggcccaggaaggatgatcttcagagttaagaggattaagcacaagcagaatgtcagtggtctccctcactgatcactctagtctcatcctacctatgtacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcaaatgctgtcaggacctgtcaggcccccccgggatctttagtcccggttggtagcaccaaccgggactaaagatcttaactttagtcccggttggactaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaaattcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttaacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttgagagatgagcagtggccatagcacttggcccgttacgatgtgtatctacaacctccccccctggctatgcatgaagaggaagtatataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacaattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccatgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcaattgatgcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaatacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtccaagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaactttgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgtgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatcaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctgttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcaaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagagcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatataaaccatgcagcaacagaggcatgcaaaaaaaaaaaggtcagctctatctttagtcccgggtgaaataaccgggagtaaagatagcgatctttagtcccggattggtactcccggtttggaaaccgggactaaaggggggttacgaaccgggactacaaagggtttctccaccagtggtatcttccatattgctagatttgacgcttgcatattcctccatgggcgcataattccttgagcaacttttgttttagctatattcaggagcaatctgaaactatacatgggagcatgcatacgttttaacctagaatataacaaagcccagtccttaatattgtccaacagtcagctgtataaaccagaggcaatagctaggtaggatgtgctttctacactttgacaacaatcaggtaccacagggagaagctcaaagttgacaaagatggtcatgatatagggtgtgtttagtttctgaaaaaaattgaaagtttgaagaaagttggaagtttatgtgtgtaggaaagtttttgatgtaaaatgatgtgatggaaagttgggaatagagggaaactaaacacggccatagaagagaactagaaaccatttcaacacatatagttgatatatgtgtccgccaaagtaaatacgcactgattgatacatagaagatgtaaccaccggaggaatgttcatttagaactatgttcagaaatttcatactttttttccggtttcgcgagaaaaatgctatgaaacaagctaaaacaactgttctacaggtgctacttcttaaccaccgtatagcagctttctcaaaatattttttaacacaagattgtcggttaattttcatttatgaaaagggtttgctgcataagcgtagtgtaaaagagtgcctcgttttgttggagagcaaggcataatattggtagtccttttataaaaggagttgaaatgtgatagtgcatcgttctaatcaatcatgataaaatcgtaatagtaaagattttattcttaagccccatattttggggcaaaaggtagattaacgttattcctaaattgcatatgctatctaaaagtaacaatgcatggaattgccaagatccaatatttttcctttatatattccgtaatgcttcacttaaaacaaaagcaaagcacctaataaaatgctgttagttattcatttgtttccatatgtcatgatgtcctagccatatttaataggattcatcctttttccctagttttggtttgcattcaaaatgtgtgatgaaaatatgagcagctacaaactttatataccataatatagaatctacctgttgtaaagactagtcagatatcagaaggctgtacttcagatcttcgattgtgttcactattagtaacaactcgcactaacccagatcattagctagatctaataaaagtcggatatacactagtatataatactaagctgaggttgttagatagcctacctcatttgtttccaggtgtagtgtaagcctctctatgcagacgtaagatgatagaggaactgagctgaaaaagaaaagtcaatataaaaacaataagtcgtcatctcgaactaaatagaaattatgtagaagtcagtatcaacggcaaacacatctcatcagatctttgcaaagcatgcatgtgacacctgcacttataggaaaggaccaacacctcaccctacgctgtagttccttaggtaaaaaatgtttatactcgagatctcaacaatttttgccctggaaatttaatcacgtgaggtagaaaatattcccaagatcctatcaatcggatctaagatgtctatagaaaactaatataaaatagggatgcttaatcgactagttcttgctgcaacacagatttgctttttttttctcgtaaacaaaaagaaaatataaagacatgctcatttcaaagaactgccaaagctaaacgtttgcttaaccaaagaacgtcagtggaaagagtaggtttgtcttgtttagtctaagcgtgtgcgcttatggcccacaagagctggcccaacagcaacctgcggcaataataattaagaaatctaattgtcaaaaaagggatcacctatacatttatcgacaaattttctactaaaaatttgacagatgtaattatagtacaattgtagtgtaattacactgtaacttatatataattacactgtaacttctatgtaactacagtttaacttgtatgtaagttcacg

SEQ ID NO: 32991 - DNA, 1402 bp, Oryza sativa
acaaaagtgatcttatccttctgcctaacaattgtaacatcacagtcgcatgcccatgatgatcatccccttaagatcttgtccccttgcccatgtatctaagtgggtgtattgtgtacagacctggttatgtaggagtgttggagtcttcagaaaatgtacgaagcatggtgcatgcctgggggtatggaaaggaagtatcaccacatgcgtgcaagcatatataacctacaaaaaaacatatgcaatacatgtgtaagaatactctgcaagttactgtgccattgtccagtctgcctcagctctttttcaaggtgacttacaggatgattatttgagaaaaaagtatctaccttgcaggagcatctgaaggtgctcgtccaagtaccataaactttccaaagtcatggtctttgacaaatctattgattaccattcctttaattttgatgtaccttgaaaaaggaaaccacagggactacaagacgcgcaaacaccaggtcatagtaacctgcatatcaaggcacgtccaaaaaaatgctaagattgagacatcaatacatcataaaaatcttttgttctatttccccccaagtcaaataaaggaagaactatgtgaacttaattagtttgttgagtaatgaaaacagcaattgcttgcatggttactagaaaccccatcctaatctatcagcatggatccaatatcattactgtcaaaacttttttgttctgggagtactaaatcatcgatccattgcatccttagtgttaaaccttttcgtgaatttagtgttaaaccttttgagttgggagttcataagatcaggatatataacacacgtcaaaattttaaattgtgcaaatggtatatggtatgtaactatgtatatgtaatgtatgcaaagtttgaccactaataagacttgtctggtttagtttctgtcaaatcaagcttgtgtactgctaagtatccaaaggggccaccgccagacatacaagaagtaacattcacaggaaacaccttacactatgggaaagtacagcaatacatacgctaatcaacaatttcattgttccacattccaagcccaacagatacagcgagcaactttttttttcaaaaacattgagacggtagttactattaagtagtagcaaaatatggcaagaacaaaataatcctttttttaagagacgaagcaagaacaggatagcacattagacatatatgtacaagaaaaaaagattagagtattctgaaggcatgcatgtgtactccattatagagcactagaacaactgatgagattctccctaccaacaaggcgaaatgcccagctggtttgactgcatgccaaattgctctcactcttttccaacatgctgcatacatgacatg

SEQ ID NO: 32992 - DNA, 10706 bp, Oryza sativa
  unsure (1)..(10706): unsure at all n locations
taactcctattttcagcagactgtcaaaaaaataacaagtagaaaatcttaattgttacattactgttgttccactttcaagcaatagcaactaattaatatagtgattcatgtccctctcatgataggcaagagcaatgtaaatattatcaatatgtacgaaatgatatgacctgcacaaaggtgactaagcttgtatggcattattaaaaggaaatgtctatccaaaggttcaggttaggccttttagacaagttatttaaaggagtttccatggtagagcaaaattgtctatgaaataaatgtttgttgcagcagaagcctatttagatgtggttgactttaaatgcataaagcaaaagtgatcagctgctgaaaaatgtaccttgctaggacaatatttctcaaatatttgatgaagataaatactgtacagcagaagcaggaaactcagattctgggagaggttgtgttttctaaagaggtgtgtccaaaagatgctaactgctcaggtcatcctacaaacagacatgagatgataaacctcagagacagaatacccatgacacaagctaaaaatattttgctgcacatggttgaacagttggagcaattgaccagatgttcaaaataagaacttctggatgggctggccaattcatgaaaagaacatagacatggggtccaattcttgttcaagcatttagaagaaagcaagaattaacaaggccagtcatgggccttgggcctgaattccagaccatcatttaagtcacactacaaaaattatgccctccaagaaaatcatgccctagttttcaaggaagacagacaagatggaggaaaagatattgtgatttacagatttccatatttacaccgcttcttgaatctttgtcgttgcatcaccagcttgaggattattacttcacaaatatgattagttccttacttcctttggatgttgttgataatgaccgtgctttgatgctcaaatcatgggttggaaacttatgctttttcctttgaagtatttgggagcccaccttcattttaaatagacttagaaaaaaaagataaccagcctaatgttgataaagttgtgaagagtggctggctggagggtcagaattctatcctatggtgggcaattggttctgattaaatttcttgtttatctacttttctgttcttaaattcattgtttggtctgtgaaggctataatagatttctgatcagaatgggtctgggtaaatgaaaacactcagatgatggttcttgttgattctgctctgaaaatgaatctgtaccaaaaaaaaaatactgcaatgttgctaaaatcctttggacagagatgtcgaacatgttatctcgccaggccggcagaagccggccgaagtttattaagggaagtcagacatgctatctgttttggtaatagtttaaactttgaatgtgttgctataagtggaaacaagatttaacatccttgtggaatatgagaaatgacctactttttttttctgtgttacattgaagaagtatgaagattgtgcagcacaggatgatgctgacattgaggaactggagtctggggaatgttgtgcctagacagctattatggctgatggaccagaatatgtaaagagtgaagaaggggctggtacagaagagattgaagattgagctgtggagcaaggggcagagcttgaagtggaggaactctaccctatgtatgagaagtaatcagaaagcatgtcaggttgtttagatttgtgtgccaaaagcatgcgttgctgtctacaaatctttgtactctgggttagtgtgccgtgaagtcatccatgtgtggaattttgggcctgtactgcttcttcagcttggaactctgtaaatatgttggtctcgttctaatgaagtccagaactgatgcttagccctttggttctaagaattattaggattatccttgtttccttagtgacttacctccctgtattcccttattaacagcatcatgccattgggccaggtatgttttagtatgctcctgagctccataaaaaaaccttaaagttctagtcaaggtcaagtacaatggaaacaagaacagtatcatatccactgggcaatcatctgatctgtgcatgaccatagataaaccactccattatttaagatcgaagtttcaatgcaagcagaaaatttaatggagtgtgccaagaaatagaagattagcatgtaagcttattttcttcttgtgttttatatagactaggcatatccgcatatatcaggattgtcaacatacctgaaccagagtgccttaccactatcgtatcacacagatgcatttgctccagccaacagtaatctcttttatatatgtacttctaatctatctgtggtacgcattgatgcttcatttgagcagtgctgatgtatatccctgcagaactgaaaagcccactgaaaaaaaggaaattttctgcataattagtatttgtattggacaaactaaaatgcataaccattcccttaatcctgaactcaagatacagtgcaactttctagtgacagagcatcagaccataaaatgtgggaagattgtaataatattggtcgttagttatgaactgctaaagtgctaagacaaaccactacctgggtataaatataaatagctattttgttcaagacaaaccactacctgcgtataaatataaatagctattttattcttttcttttacaataaatagccattgtgttgattgttgaccactataaaagacatggcggaaaacttgtattgtcaactaagtatttacaggataaagcaaggatcaacattcacatttcaattggtgaacatcgaccaaatgctcaaccgtgcgaaaccgtatcagcttactatggttgagaccaatatgcaagtcatgttgtctgctacgcaacaatttaggtctgtacctgaggtcatgctatgctctaggcagaaatttacagattcctataataagaacctgaaagccaatttttcagtcacactgaccacccaattgcaaccattgatttcaaattggcaaattggttgcaattgggtggtcagtgtgtgtttgataaattattttactaaaattcatcgaataaatatttcaagtaatatcggtcacatgaagcagaactgtatgatacgtgggcccaaaattatcaaataataaacatgtctaaatatatccaatattggacttgttctgttgcgtattccgaataaaaaaatagtggtgcaaacagatttcaaatttgatgcacagtctaaagttttgaggtattcaaaataaaaagagattgactagtactacgtgtaaattacatttgatctgttggtggcaactacattaaaggtgggacccactgtcattagtagagataatttcctgattatctccagacttcagtaccacgtcgatgggttagctcatctctgcgctctggcttggcttatcacggagattaacgcgtggcgctgaaagtgcattaatccccctagtgggttttggtgattaatgacaaatgtggttaagggactaatgagttcattaagtgactttcaggtgcattagtccaaagtgtggaagatggatgcttggagaccccaaaaagtacaaaatcaaagcggaccggaactcgagaagtgcataggatagtttatcttttgaaatcgagtttttaggaaaaaccgtactattaaaaggggttccaggtgatgctctgagatatatcaagtgctcttagtgtgaaccaagtgtcaagtttccctaggagtcatttttgcaaatactccatttgtccaaaaatgcaagtccggaacttactgtcttccaggtccggaagttccggtcttgtgaaaaagattttcctaagtgtagtccggaagttccggtcttccaggtccggaacttcctgtctagtttccagttcaaatttgtgagtaacggctagatgacgtcacctagccgttatacatatacagctcgtttccagctcgttccttggccattccactttcatttttcaaacctagagctattgctagcctctcccaagtgtttctggccttctccactcaatctagagcctaattcttgtgagaaagagagattgagagggagagaagaagatttggagatgtgtgaagactagatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatttcctctcctccgaaagggaacgaggtaagttagtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggattttctctggggtttttgcacaagtgaggcaaggggttaatcgagacccagctctttggagctcctcaacggagagtaggatcgcaagatccgaacttcgggaaaaaatcgctcttgtctctttctgtgatgtttctgtggatgattctgtgatatatcctctgcttagaatacctgtgcaccatcttgtgaagattagcttagtctcttgtttcgaaatttgaatttcatctctgttctgttacccggaagttcctgtcttagaacaccggaagttccgggcctgggaggccggaagttccggagttccttaccaggaagctccgggtctgtttgaattttaccgcttcgatttgtttttaagttttcagggacagcctattcaccccccccccctctatgcttcatcaacgcgttcaggcgctagaaattcggaggcaatttccattgcctctgcctatataagacgtgaaccactaggtgtcgcgggagaggggaggagaccggagaaaattagaaggagaagaagagaagcagggagaggcgcacaaaaacaactcacattgatctatttgctggtggtgttccgaggagattagaaacttctcggtgactcgcctgcagttcgtgagcaagcgcgccacagtgagattaaatatctctcatcgtcgagccgatgtcgcaagtggagatgatggtggtagatggtaagtatgataaataatcctctccaaccctgttggtaaaccagtcgttctaatggattatcggagtacctccttctcatcaattggagcgctttggaaatcaaatcgcctccattttcttgaagcataaacttggatttgtctaatctgcggattggattatcctcgtattttttataatcaacactcttatttttatggtgcgcatgccgggagcgagccctaaattataaacaaaggaggagtggagataaaaaaaaaaagatatatgctatgttcatgaccgacgaggccaagcaatgcattggctaaagctgaaaaatgctatggctgttatatatgtctatttataggcgaaaccatggccgagtgctgacaaggccaggtcactatactattaacacgtctagtctaaaatgaacgggagccggatacaccgttgctgggcactgacgaggcaaaagcaaccacaaaaaatccatgtttgatgaaggccgagatacatgactgggcaccgatgaggcaaaagtcacccgcttcaccaaatttcctctacacgccgacgtgatggtagtgtactgtgaccgggttttggtgaaacaaagccacccgttacacattcactatattcaccgtaaaatctgcaccaacctcaaccttcagcgagcaaataatttttgagacggcgatcacaaagcgcagcttaatcggaggtattccataggctcgtcctgtggatgtaattaactggtagcctcattgctaggcgccgggaatcagcgaactgcacgcaatctccagtcagcataccttttcattaagcatttctcgcgaaggcaaaaggcgaactcctgcgggagccctcatgtatttgtaaatattcattaaatacagggtttccctattttctgtgtgttcattgttttgttttcatcaaacagtgtgaatcgctgcagctgatcaaaatcccaaaggactaacactgaaaccaccccttcttggtgaatattacatttttgctgttgtcgccgtgcaaatgctcccccccccccccccccacacagacaagagacgatgcaattgtggctgcggcgtatgccaaactgccaagacggtgctgatcaccgatcagccaaaccaccgagcaggtcgcgggcgtggggaggcaggcaaccaacaacccaacgtaccagagctgacacgacgagaatcaacgacgccgccaatggcgaaccaaaatcgcaatcccggcgccgaatctcctctactctgtggaatgacgcgaacagcagagcagagacaacacccgatggaaactaccacatcatctgcaacggattgctcccccccccccccttcccccatccgcttaaccccacggattgctcccccgatcccgcggcaaaacccctcaaacctcacatcacacgcagcaacaagcaaacaaaccctagatggagtagaaaagctggagagaactaactgtagatgcgttcgcgggagctcaccgattgcggccggcgacggctggtcccgaggaatcctccggtggcacgggtcgctcccgcggtggcggcggtgagctccattgccccccgagagattttgaaatgggagtaaaaatcaagagatcaaatcaaaatgtcctcgaaatttcgaattcttttttttttttttgttgagagatggtgttgtgcacttgtgcgttagcgggaatgcggcggacgacggcgttttggcgctgtgacactggtgcgtggggcccacttgggaagctttcgcatttgcaagggatcgtctcttctttgctaggcccaccactggttttatcgaaatcattaacaggtccttccaggacttggattgaaaaggcgtgaagataagcttgtgatttttaactcttacatatgggttttgcgcttgtgtaattgtgttgcctctagcacctggccacctgctacgagaaaatggccctgctccttttataatttttctcaagatttttaccacggattatttgctcctcacttcttaaaaaatatgatttcttaaaaaaaaaaactttctctccactacagtgattagacaacctattctaaactatttttaagtttagtcttcaaaatattaatcattatattaatcaaataaacaatccgtgacaataatccaagcaaatgtatatgcatctcatgttggtgtcatgattggggatgcgtcacttagatttgtgttgtgttgatagcatgttttagattgttgggttagtagtatattagatcgccaaaagcttggatgtgacataagagttattgcctgtataaactatgcatattagcatgctcataattttggatttcctctcttgtatgtctagcaataagttgttcccttttatttttagtgccccattgctaccaaaagattagttacgctaggtttaattaaaaaaacataaccaatttactaatgaaaggtcattgagatttaaggtaagtgttatatttgctgtgataattcaagtcttgtcctaattttatcaaatggaatcacagtttcacatgcaaattaaaacatgaaagatttgatgaagtcaaaatagcttgtcatgttccgctatagacaaatacatgttttatacttgtcaaaggaaggtcattgacccctttgacaatgacagatgcggcttcatcagagaaaaggcacaaaaagtgacagaaactactgaacgtggaggccactagaggtgacgtggaccattggaagtataaaagaccaccagcggatagtaaagacctttgagagagtttataccacttagatccaacagagtaggcttgtcctatgaggccaagccccacaacaaggcccgtaggacctagaagttggaggcttgcaaaaagacatgtatgcccttgtacatacctatttgtaaggggttgggatataaaattacctatgtaccataccctagccctatacaatactgggtttcaagggaaatgcaatgaacatattttttaagaattaagaagattagggtttgagcgtacatcacatcaagggcattggaacttctctaaggctgtatttggaaccctaagttcccaacccctctacctcgtattccacgtgcacattcaaactgctaaatggtgcatttttttgcaaaaggtttctaaatgaaagttgcttaaaaaaatcattttgatccattttttttaaaaaaactaatacttaattaatcacacaccaatggaccactccgttttccgtgcacactgtgcgtgttgggaacatatgcttccgaatacagcctaagttcttgccctaacaaattgttgcctttgataacactacctttttatttgttatacataggatgatataaattcgtcaatcatacagtaattagcatttacttccccctctcaaatatatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcggcgagactgagacgagacgcgagaccaaaccctcccctccccgaccgcgccccgcccagatctcgccgccgacgagatgcatcgccgcggcggccaccacctccacctcctcctcgccgccgccgtcgtcctcctcctcaccgtcgcggggctgcccctcgcttccgcctccgagtccgaccacaaggtgcgttgtcgcccgctcccccaccccctctctctctctctctctctctctctctctctctctcttccttccttcctttcttccttcccttaaccctagatccgaacccccgacgtgttcctcacgctggatccgccgagtcgccgcgctggatctaggagcggcggcgcggtttcggtagctttgggttccgtggcctctttgctttgggcgagtgctgcgtggttcgaggtgcaaggttgatcttagcaatatgataggaagggctggacagctaggaatacggaagctatgggctggaggattggttcgaaggctgttctaaaggcttgctacttgatgatcttgtttgccatgagagtgaagaaaaaaatcattagtggaaacacatttggtagaaaaaacgtttttggtgctgtagtgcttcgattagcttgttatttgagcagacaagccactgcaattgtattgctgttcaaataatctgtatcatgctaggcctttgaataagattatgacagcagacttttcctgccttagcttcacatcatcaaaattttgaccttttggtggcgcatcaaaatgctgagatgcgaagcatttcatgcttgggatacatgaagcgcacactgttgtgggcttgttacagttgatttattatcctttggcgccttgacggggcagttatccttgtccttgctgcgtcttgaatgttttcattaattcttttttcctattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32993 - DNA, 856 bp, Oryza sativa
acagcaagcatcctacggttccaatcatacggaggtatccacggcaatcgaatcattcagattggacagctatatatatcaaaggggtcaacgatcatggggctcactctcaagatcttggatgatgtcccagggagcttgtacttaaatttaagtatgtattagtggtatggaccactcaaattgagcgtaatccgcactggcaagaaatccaaatcttttgccagtgtagaagacaagaaccaacttaggagaagatgatgaagatggctgtagctagctgtggacggacagggagaggataagcagagggcttgggaatggatggctggatgcaaacactgggcggtggtagttggtggttggtagcccacatgacatcagcccaaaaagacagcagcccgtgtcttcttcttcttttcacaaattcctggcctgtgcttttggcaattgctctagtcccccaccgcatctcatctctcgcacctccctttcagacgtcattctcggctggctcgggtgagttttttatggcttttgggtgaagtgttggtttttttgtggtggggtcaccttctagaagcacaagtgatccaatgtcttccccacaaatggtcagtggatgcagcgtccgtttgcaactatccttgtcaatgatctactagcggctcaggcactgtttagatcctccaaaatagtaaaagttttatcattttaaagcactttttaccattttggatctaaacactagcaaaagttagcaatttgccatttgccatttgctagtccatagtagcaaattgtgccaaaaaaatgctttggatcactctctctctccaccaaaaagtgctagaat

SEQ ID NO: 32994 - DNA, 7576 bp, Oryza sativa
  unsure (1)..(7576): unsure at all n locations
agaaacatggtacaacaatagcatggctatgacaacaggtaaacaccccatagaaacattataaaacaatgcaatatttgaaagaaaacaatagagcatttgcaatataggatcaacatgttcaagtgacaagcatgacttgccttgctctgctgctggaggaacctcggcgactatttcgaaatacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggagctcggatgaattagttatgagttttagaagattcactgtgtttattactataaaagaaaaaccttaaatcatttattgtgcaataaatcccagggctgacgtcagcacggaggggggggcggcgccgacatgcggggcccaccggtcagcggctcgggagagggaggaaggggcgccggcacgcggggcccaccggtcagcggctcagggggggaggaaggggcggcggcgacccggctcggcttggctcaaggccgaccgaccggccgcggcgacggcgacggcacgcgcacacgcgaacgcgttaccggcgacggcaaccggcggacaggctttggggtgccctaaggaaggaagagagagagattagagagagggagatgaaccacggcgaccggtattcatggccgaaagcggcgatagcggttgaactcaccggagcgcgaggggatgcgaattccggcgacgaaactcgacggggaaggggcggccggggtagagcttatcctcgcgaacccgacggcggggacggcgcggtgcggcggcaaccctagcggcggctagcggcggctggagtagcggaaacggcggcggcgggtggttgcacggcgcgggagcgatggggagctcgggagagttcggcgaaatggggaaaaagcgagagggggcgacggggaagcctaaataggggaggagagccccggacgtggccggtaggggcgggatttcgccggccaacgtggggagtgggggaggagagagaggcgggattcgaaaatcgaatcccggccatctcgggcgcgggcgcgggcgggagagagaggggagtgggcgccggagatgcggcgcacgcgcggacgtggctgacgtggcccaaaaaaagcggaagcgtgggcgcggcggcggttgctggcgcgacagcgccagctggaggaaagggactggtccgacaggtggggcccacctgtcggcgtcccggggagagagggaggggcggcttggctgggcctcggcctgcggccggcccagcagggaggagggagagaaaaggagagaatgggccagtggcccattcgaaaaagggagggaaaaagaaaaagaaaaaggggaaaaggatttcctggaattaaaatattgcttgctcaattttaattggttaaaattatttctagggctctgaaaattccactaaaaatcctgttagtgaagttcgacatgtagaactcaagaaaaattccacatgccaattccgattattatttgcattgatttaaaagggtttactcttgctttgcactggtattttcttagggtcgcttataaattaaatttttggcttgggaggagaacttcggggtgtgacaaacctaccccccttaaacggaatctcgccccgagattcggaggagctggcgaagaggtgcggatgggcggctttcaactcatcctccctttcccaggttgcttcctcttctgaatgatgactccactgaactcggcaaaacctggtgaccttgtttctggttcctctttcgctggtatcaagtatacgaaccggcttctccacataggttaggtcctcctggatatcaatgtgttccgaatcagcttgttcttcaggtacccttaagcacttctttaattgggacacgtggaacacgtcatggatgccgatcatattggatggaagttctaactgataagcaacttctccccttcgttccaagattttgtagggtcccacgaagcgtggtgccaacttgcctttcgtctgaaaacggtgtactccccagagcggagtgacacgaagatacacgtaatctcctgcctcaaaagtgagctcccttcggcggttatccgcgtagctcttctgtcgagactgggcaatcctcaacctttccctgatgattctgactttctcttccgcttctgttaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagtttttgtcccaagctccaccaaaatcaagagcgcaagctctcaacatatcttccaggatttgattgactcgctcggtctgaccatcagtttgcgggtgataggccgtgctaaaatttaaacgggtccccaattcttcctgcagcttctgccagaattttgaggtgaactgactccctcgatcagatacaatctttttgggtactccatgtagacatatgattctcgagaggtaaagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtagacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcatggaaatcccgggcttttccgactctcatgttctttttcagctctgctatttcagaatcatttacttgagctgctctgacttgatccacgagcgtaggccgtgcctccagagcagctacgaacctgtgttcaacaattcccacgttgagatgctcaaactcctaccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagtcggataattcccttcgtgtggacgcaactgccgcgaggcatacgcaaccactctgccctcttgcattaggacacacccaagtccgtggcgggatgcatcgcaatagacttggaagtctttcatctggtcgggcagaatcaaaactggtgcggatactaacttctttttgagctcctcaaaactcttatcgcactcagctgtccatttaaacttctcatctttcttaagcaaccgagtcatgggtcgggcgatcctggagaagttttcgatgaatcggcggtaatatcccgcaagtccaagaaaacttcgaatctgtgacacggtcttcggtggggtccatttggtaactgactctacgttcgatgggtcaactgccacaccctgagctgtaatgacatgtcctagaaatttgacttccgtcaaccagaagtcacacttgctgaacttggcgtatagctggtgctccttcaacttctcgagtaccagacggagatgttgctcatgttcttcttcggtctttgaatagataagaatgtcgtcgatgaataccacaacaaacttgtccagaaattccatgaacactttattcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcggtaatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtatggtctcttgtaaattggagcgattcccggtgccaagtcaatccggaattcaatctctctcttgggtggcatggtagtaaggtcttcggggaacacttctggatactcgcagactatgggtatatcttccaatttcctcaacttcttctccacggtgtccactgggatttccgcctcaatctgattcaaagagaccccttgctttggtgagtctggtgatttgtacactactgtttctcccttctcgttggtcaaggtgactgtgcgattcgcacaatcgatgactcccttaaacttggtcagccaatccatcccaagaatgacatctaggtctttggattcgagaagaataaggttggctagaaatggtgatctttgaatttctattgttatagaagggctgaattgaaccgaagtggagctattccctggggtatgaacccgcatcagtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgtgccctgaactgagcggccttcctcttcctgtccatcttgttgcgttgatcctcctgacggattgccttgtcaaccagcctctcaaagtcgacgtagtccccagatattagttggttggtcagctcgtcatccagacctgccatgaacttttcctgcttctcggcgtcggtgcggacatcctctggtgcatatcgcgtgaggcgattgaactcatggagatactccgtcacagtcctgttgccctgatggagtgcccgaaattccctcttcttttgtgccacgaccccgtctggcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagctttttctctatggcatggagccagtcattcgcctccatagggttggtggtgttggagaaggtgggtggcctgacacgtagaaactctggcaacttggactgagggggagggggaccaaactgctgatgctgctgttcggcgtgctgcagcatccgctggtgcatctgctggtgctgctgctgcatctgctgcatcatggatgccatcatctgagtctgatgtgccatcacttggggtagcgtcggattctcgggaagtggtggcggaccattgccggaatcgctgtggggatgcaccccattagtgcgctcttcgccgttgctgccctcgcctgttgcgcggctaccattcttggtgtaaaccatctggagggaaaatcagacgggggaaaagaaggaaaacagatgctcaggaactaagctttattatataggaatttaaactgcaattgttcggatctgaattaaaacacttaaaaagcaagcaaaaatccttattaagacagccatatcataggcgcatgatatcgaccgtcgactgaccccaagcaagcaacctaaacacacaaactaacaagcagaaactagacagtcgataaactaatggaaagcgagcctaatgctcggaacggctcctgcggtcggtggagtcgaaggcgtcctcctgctcgtcaccaggtccctctgagcgactcctggagcctggcagataagtctcgccgccgcccggctctgagccactggagctactgctgctgagatcgcggctgccactgggagtagcagacaaccaacctccgttgccactggctggacccctggcggctgatgctggagcgaaggagagagcggacgcgggagctgacacgtgaacgggagctggagctggtactggagctgcaggaactaccggagctgcgggcggaactggaggtgctgcgggagctgctgatggaggtgggttcctgggcgcaagctggatgcgcacgggtgcagtcgtcgtcttgcggggcgtagtgcggatccggactcctcctggcgcgggaagaccctttaactgagcattctccttcttcaggcgcgctatctcgtccttcagagcgacgatcctcatgagcttcccatcattcaaggccttggacgccttgtgcaggtccgagtgcatcctatccaatcccctcatcatagcacacatgtgaccaaaggtggtgtcgttctcgccggctgtcgaacggaaagtactgacatcatcaccgctggctcgacaagggtgaaatcggtacgccgtgtcgtggaagataaagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32995 - DNA, 752 bp, Oryza sativa
ggctccgcgtctccccggccggtcggggagcgcgcgggccgtcggatcgggatcggcaggctcggggttcgcacgcgagcctcgggtggtgcgcctcgcgttcgccccgtccgtcctgctggcttcttggggctgggcgatcgagtgtttttcgccgctgctttttggggggtttgcgggatgcgtggatccgcacattgggacgcgctgcgcgtggaatggatggatggatggagggaaccttgtgtgggggccactttgctgcggttgcgggtggctgcggctgggtagtcggtgcggtgcggagcgatggatggacggggcgcggaaattcaccgtgccaccgtatcagcttgctggtatgtgtaacgtacgtaagcatctcggctttcgtgtttacaagtctactacgcgaggtaaggtttgtaaatgaagagcttacccgacatgcaatctgcggtcaatactcatttcacaggaaacccacgtagtcttcttattactccctccgggttgataatattaggcgttttggaaaacctggtcttcaaaaagtaactttgacaactaatttctattataaaatatatagaaatttcaacaaatatatgattttattgaagtactttctaagactaatctacacattggttttcatatttttaagataaatattttagaaattattcgtagtcaaagattttaaagtttgactttacccttgttcaaaacgactaatattatcagcctgg

SEQ ID NO: 32996 - DNA, 136 bp, Oryza sativa
cggattgcctcaccgtatcataacggacaacggctcccagtttatcagtgccgatttccaggatcactgcattaggctgggagtcaagatctgcttccctcggtttctcaccctcagagcaatggacaggtcgaga

SEQ ID NO: 32997 - DNA, 567 bp, Oryza sativa
cgtgcgcgtcgcgcctctcggtggccattcaggtgatcgcggagatcgccggtgccacgaggtgaaggggtggctcgatgaggcgattcccgctgttcagggttttcgccatcagcaccgccagttggtggccattccgggtgcgctgcagcagcggcctcttcgaacgcgttgctgaggttagtcactgattcccgtagccgttctgtccaccgtgcgagatcgtcattctgaacgggatcgtagggggtttccctcagtattgcgttgacggccctgatgtgctgggccggtgtagtcacttgattttccgcttccgcgttagcgcgcgctgacgtgccggtcccatcgatagccaatacctcgcgtggcgtacttgtcgagatgagccatagtcttcgagcaggtgcaggactgacggttcgtggggatcgatgtcgattacccccaacgaatcgatctgatatcagcgttgctccttgttccttgtcctcatccctgagggggatacgtgactgctggaccttaggaggtgacgtcttcatggcactgagaaagaccttgcag

SEQ ID NO: 32998 - DNA, 1981 bp, Oryza sativa
aacgacgcccaaagcatcgccattgtctgccacaagactgggctagacttttgccttccacccaccccggttgttctacagctactgctcaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccggggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataatttatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgccatatatagccactcataccccgtgtccccgtatcgtcaatatctttacttgctcctcatcaagctgtaatgtccatcttctaccttcaatctttcagcttgatgtcggaactcaacctatatcttccaacatgtgttgtcataaatcaccaaaataatcaccacactcttagggtaatagatcttccaatctcctcttacaaaggcaattctagggaatagatctttcaggctgcaccccctcctctatagccgcatcttgccgcctcgcctccatatggaccaagccgagtcacgacgcatccaagctctcgttgttatgttgtagtttgctctcctcaacctctgtggaatccactatcggggtgtcagatctagccacattgatatcggatatggcaacctactattgttgtcattgtcggccaccttgcgccacct

SEQ ID NO: 32999 - DNA, 895 bp, Oryza sativa
tttaaataaaacgaatgatcaaacgttggtcgaaaagtcaacggtgtcatacattaaaatacggaggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagacatgagccccacatgtaagtggtgagtgaaagaaatatgaaaattatggggtccacattgccacatgttagcactcaacacccactcattctttcttcgctgtttcgcacggacaggtgcaagaactacagtaggcaagccggcgcaggtccgctcaacactgcttccactgaggaagcggttttgtagttgagggataaaaaaataaaaatcatatccaacctatatttttgagggtgttaaattagactttattcggtatgcaattgtttgcttcaaatgggcctcactttgaaccttgtttgattttaatggcccatgattggcactgcttatgggctcagaatctgcccaatcaaaaattcataaggcttattcctgatgcattccctgagcaatacagcaaaaactagcaacaaaacaaactggatccttcgttggcagtaggaccgtaggacggtaggagtagtagaagtagttggcagttggta

SEQ ID NO: 33000 - DNA, 595 bp, Oryza sativa
cctgctgtcttgagggagcttggcatactgaaatatggctccaacttatcttgctcaattgattcgagcagtgagattgtgcctggaagtgaagaggaagtggagattcgtgcttgttctgtatatgccgtggaaaaaatgagagagctcatcaacaagaagtttggaaagcaggtaggcacatctgaatcactatcacctaatactttcataccatttcttggtagatacaaagagggggtgttgggtccatggccacactttgccacaccacattttttgtctgccgcagtttgttaggcatgtgtttggtttactgccacagttgtggtttgccacactttttaatacatatgccccacatgtcagagactaacaatttgtccaccacacttttgtggctatcacaatttgcctaacgttagttgtggtaaagtgtggccagcaacaaacacacccctagtcactgcacgctccgctacattgatgagcaatcagaaaaggttatattatatttactcttaagtattgaaaaagagcaaaattgaccattctgctttagtttacggtcaaaacattcatctagtaagagttt

SEQ ID NO: 33001 - DNA, 1082 bp, Oryza sativa
tgtttctagcgaaatgtacgttctcttgaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaaaaatcggtttgctatgaagttaatgaatttcatgcaaactctactagcatgattctaaacttggataggcggttaccgttatcgcacctcattgataagcctggttaccgcggtaactgatgttaagggagaccttgatttaaactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaagggaaaaaaaatctgaccatttcttgatttcttcttctcccttctctctctccatcactccatggaccaagagaagcatcaagccatggccggcgctgccgacgccgccgccggcggtggctctgttgcgaaggacacgggcgacgattttgagttctgtgtactgtcgtccggtgggctcgt

SEQ ID NO: 33002 - DNA, 1189 bp, Oryza sativa
gttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctagcgggaaaattatctcttaaaaaccctaattgcgaaatttatttctttgcttgttgtctagtgtccatgccatctcaagatctcaaatccccgatctatcgtcgagttcaatt

SEQ ID NO: 33003 - DNA, 642 bp, Oryza sativa
gtggttcgatccgccgctcgccgctgtcgtcaacagtccgttccggccggcgtagtagtttacctcccgccggcccgagtggcagctacgtaggcgccacgtcggcgccagttcggccaagaccgggtcgagccgaccccggtcagtccctccccgtgcgcgtgttccaccgcgagccgtgaggatgcgcgtgggcccgccgcatccgtgtccaccgcgaacagcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcctcccctcccgcgcgcgcacgcttgggccgccttgggccggccggcccatttagctcggccggaacgctccgtttctctcgggccgcgccctagccgcccgaggaaaagtctatttcccctccctcttttctttcttttcttttatttttcaaaaaggatttaattcaatccttttcctttagaccaaaaatccaataatcttagaaattcaatatcttcccaaccgcaaatccgtttgactccgttcaacttccaaaattcctcaaatctcgagatctatct

SEQ ID NO: 33004 - DNA, 589 bp, Oryza sativa
ctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactacgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctagagaaactcggcggggttgacgctcccgtcatatttttcggcgatggtgggccggaaccttgggggccaacggacatttcgaaggctcgccacaaa

SEQ ID NO: 33005 - DNA, 594 bp, Oryza sativa
ccttggagagaatgccacgcggctctggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcatcgcgagctgcctcggaagtcgccatcgcctcgtcctagcgaaatccggcctcctcccgagcggcttccccggcctggcgggcccgggcggcctcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacaggatctcgctgaaacgaaagaaaaaaccagaagacgaacaagatgggtgagtgaaaactcgcgttgagagaatgaatac

SEQ ID NO: 33006 - DNA, 715 bp, Oryza sativa
tttaattaccagctcctcctcttgacgacagcagcaaaggtgtggccgaggcggcgaggcacatagataggggcgggcaagcttggcttggatcgatcttgagtggatagatcaactggaagggcgtagcggcaacggcgttgggcgggacctaagatctgacatgtgtacgtggcgaagggcaaaagtacacggcattggaatggatgacatattatcaaatttctcgcaaatgatcgagcaacctaagagacaaagtcaatcgaattgaaatggtccgcgtatagtggaagtgggattgcactatactcgtattaggtagatgcacggacggacgtaatacaaacgctagttgacagttccaattaatcgttcatgcgacccaattgatttagttctaaactttcgctccatactacaaccttctcatttttctattatcacgttttcttaaccgctaaacggtggattttatataaaagaaaaagaaatactccatcattttacgttataagatatttttgactttggtcaaagtcaaattgtttcaattttaaccaagtttatagaaaaaaatagtaatattttcgacccaaaataaatttattataaaaatacatttaattattaatttaataaaattaatttggtaatataaatattattataattgtttataaacttagctaaatttaaaatagtttgactttgacca

SEQ ID NO: 33007 - DNA, 1175 bp, Oryza sativa
cactggtactaaaatttgatcagtctatagtaggttttaggcttgtgaaataattgtaaaattagctttatgcaaaagaacctgaagccattccttgaaataccctctatcatatgcattgttgttgtggtggcttcctgagtacggttggtactcacccttgctattcatatatcttttaggagagtgttgaagagaagcccttgtcggtacgcttgcgtatctaacaagatgatcggagtgcggtcttgttctaggtctcgttccccagtcgactgcctgtggcatgttaaccgggcccttatattattttgtcttccgctgttgttctctgatagttttggcctacctggccctaatgtaagtatttaactcttttagcctaaattcattcgtgatatgttgtgatccaactatgaatgtgtgtaccaactactgatccagggattgatacggataaacacagaaaatttccgattcccaaaattgggggtctacactacgttaacggcgcggttagtcaacgtgcttgacaccgacgtcgtctaagctatccaccctaacatcctatgtgccgttcctatcctaaccacctcgttaaaaaccagttgtggaccctcagatcttcgacatttcaccgaaacaaccgctgcttcgtggcctatggtaagtggtttctagaaaaatctttggggttccacctttcccaattcagtctctctagggtgaggcccgtgattctgcagccgtaaaaaaaaacctagctcgattccatgcccggaaggcaaagttatcaaggtcttaaattcgcccagaaatctccatcggcagtccacggtgtcgcgcccgccagcctaccttaacggcgcggttagtcgacgtgcttgacaccgacgttgtctaagctatccaccctaacatcctatgtgccgttcctatcctaaccacctcgttgaaaaccagttgtggaccctcagatcttcgacattccgccgaaacaaccgctgcttcgtggcatatggtaagtggtttttagaaaaatctctgggtccacctttcccaattcagtctctataaggtgaggccggtgattctgcagctgaaaaaaaactacctcgattccatgcccggaaggcaaaattatcatggtcttaaattcgccaaaaaatctctat

SEQ ID NO: 33008 - DNA, 956 bp, Oryza sativa
gtggaccctcagatcttcgacattccgccgaaacaaccgctgtttcgtggcctatggtaagtggtttctagaaaaatttctaggcgtccacctttaccaatccagtctctctagggtgaggcccgtgattctgtagccgtaaaaaaaccctagcacgattccatgcccggaaggcaaagttaccaaggtcttaaattcgcccaaaaatctccatcgacaagccacggtgtcgccccgccagcctaccttaacggtgcggttagtcgacgtgcttgacaccgaggtcgtctaagctatccaccctaacattctatgtgcagttcctatcctaaccacctcgttgaaaaccagttgtggacccttagatcttcgacattccgccggaacaaccgctgcttcgtggctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctctttttttgtggggacttacccccccttttcataaatggacggagatttgtatagtgccgtccgagtcaccttctgatgagacggcccacaactacctccactttcgccgggagcaggtgcgacgtggaatcgtgctgtctgctgacgacatgaccggtatcagaccagtcacgtcggtcattcttgtccaccacgtgtcagcttaccaatctacatg

SEQ ID NO: 33009 - DNA, 504 bp, Oryza sativa
ccccctctgcagcgatccagaccgcgcctccatcctgaccattatgatggcggtcggggcctcagaggagcgagctccaaagggtcacgacggcgcaggcgggagccgcaggggggacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttctttcgtttca

SEQ ID NO: 33010 - DNA, 716 bp, Oryza sativa
tgcaccccgatggggagtgggcgggtcttgaggaagccgagaggataggcgcggcggaccatggtggcgaggccggcgtcctgaacgagggtgaccggcgcgcggtcgcgacccacctccgctcgtggcattcggggtccgggctgctgagcagcgccaccgcacacacctcctcggcgccgcggttgtccaccagctcgatgcggtagtgccccgccgcgtccgtcgtcccctccgccgatctctccaccgccccgctcgcgctcatgaagtgccggcactccagccgcacccgcgcgccctggatcgccgtcgtcgcgttcgtctggaaccccgcgcggcacgtgtcgcagtacacgtcgccctccacgaagaaatccgggtcacggctcccctgcaccgccatcgccatcgccgtcgccaccaccatcaccatcaccacaccgccggccataaccatacatcaatcaatcaatctcgataaattaataaccgatcctgcttatatatatatagcagctatatatatatcgaatagttgaagcgatcgatcggctgggaatggaacgacggcccaattaatcaggtgatccatacattaatttgcattgcatgttatatatgactctattgttagttagttaagttgcttgcgttgttgaccaatcgaaagtactcctaatgaacttcccctacaataattaaataataataat

SEQ ID NO: 33011 - DNA, 802 bp, Oryza sativa
cggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacagaaagaaggagttagggcgcaagcagcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcaacgttaccatatcttcagacgaaacgaatcgccatgtccagattcgtatgctactcaagtaatgtggcagtcttgaagagaccgctcattgttgacagccgagttaccattgccgatgtgcgtggtttgtgaccgttgggtttctgcccaattgtggagatcggtcccacctgtcaccaggtctcaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtcccc

SEQ ID NO: 33012 - DNA, 427 bp, Oryza sativa
gaacaaaccaaaataaaattttccacgaaaattcattgtgccacgaccacaccgaccgttggaatccaacggccgaaagtggggccggttgggcccactaggggttcggccaaacaccttggttcggcaacggttccctgccacttttggcagggtaacggctagtgggtcctacatgtcatttctgaccgttgtgggtaccctataagagccagccgaccgagagagggaattccaccccatttcaacacattttctttccctctccaaagtttgctctcaaattcattcaagccttgatagtttccctcaaattcaaacacttagctgcatatacatatatatatatatatatatatatatatatatatatatatatatatatatatatatatatatatatatatatatatatatatatatatat

SEQ ID NO: 33013 - DNA, 657 bp, Oryza sativa
ccaaaataccactagcatatgtttaaaccctaaccacagatctaacaaccctatcacaaatcgattctctagtgcccacatgctatcccttatcagcagtgggtatggctgctaaacaatctccaattgcgggagcgttgacggtaagatttccgcataaaggatggcgggtgcggcagctaccatgggcgttctgatggtatccacatgctccacatggatcgtgacggcgaaacctgccattgctaccaatggaggggatgggcaccagcatgactggaacgttcattcatcgtgtatatgatccgtcatcaccagctccatccgctactgaggatgcgctcggcgaagacagatccagtggcacagagggagaacatttgcagggtggcaccgatcaccaatgctaagtactgtggctgccggaggtcatgaacaacaaccacaatgttccatcggcctttttattatgccctacattcgttcttaatatggatggatatttgaatacacaaagtgcaatcattacgaacacaagtaatgcataacaatttgatactttagatgtgaaatgttgattaaagctaaagcatcaaattgtgaagttgatatgagaaaagtcatgttgttgcccaaagcttgatatgtgaagggcat

SEQ ID NO: 33014 - DNA, 13035 bp, Oryza sativa
  unsure (1)..(13035): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgattaactccctctgttttctgcttgcgtgcgtggttgagtcaatcgtggtcaaagtgaacggcaaacgacagaaaagtgacgaaagtgttaaaagaggaatgaagggaactttcggtgctattaaagtgaaccggtaactttcggtgctagagaaccaaaaacgtgaactttcgatgctttgaaaccaatttttcctagttttggccacatcagaagtgattgatcagaccattttattacatgcatgacaaaaacagaaccatatagtctggctctatagcatccagtccacatgctcaatcttggtagcgtcttatgggttttgctctattggtaattggcctatcagtttaaagcaagtaaacttttgaccacccagctgttggagcaaatgctttaaattgtttgttattcttccatttttttaatggataaagtgcctattcccacagattaatcttattatacaatcagttaacaaggcctgcttttattgtaatttttactcaggatatggagctgccctcacaaaagtcacaacgaacaaggaaatcccatttgggttacgtcagatatccttaaaccatttaatgaagttattttatgcccaaaatttgtagcgcataccctttctctgttagatttggctttcacacattctacttccaattgttgtttgttcgtccttcactcctcagtaccttgctgctgtcttgctaaagcagttcatcaaacagcattggcaggaagacgaagagaatttcatgcctcctgttgtttctgcctcggaaaaggtaccatcatgcactttcaatcctctggataacactaattagactcagtccgtaacaggcccatggtgccattcttttcttttctcccttggattgtcaatacaaattgtaattcatgtgcgtggtgttatcttctcgcagcaagcactattttcatgcttgaaaacttctcatgtcagaagattgtgagtaatgattaatgagacaagaggtccacattattacaacaaatattccacatgcatagcttgaattgctcatattttttgatgcatggtatcccttactgttctaatcaatgaaaaaaaatttaaaaaatggtataaattgcaaggaccatggtgtcatggcaatagggtgtcgcatgtcatggtacagccagcctgcatgtcaggcccagcagcttgtggacagggaagctcctacttgctatttgtttagtttgtttcttaggccttaagccatttctggatacgatcagttatttgattaattaagcataatactgtttggtagggccattccatctctatttcaggttgctgacagatcattgtatgacaaacaagaattaaccaaagacacattaatctaattctaatagttcactgcaatctaattctagcatgtgacactgacacatgggcttactatgtaaattattgttttctaatatgatatattcttatcgcattattttgcttctccttatttatcattaggtgattatacggcaactcctccttacatcgttggatgattctcacgggaagattcgtactgctattggcatggctgtagcagctattgggcagcaagattggcctgaagactggcctgagttacttccctatctcttaaagttaatttctgatcaaagcaatggttgtggaggtatagagaattcttttgcttcccaatatttttgaaaccagggtgtgcagctattttagaggcctttttagagtcattgagcttaaacttagagctgctggattccttccagcatagctcttccaaataagctgtttttgtcacaatttcctggacaagctgtaggccctggctgagatttcagcaggtttaatttctttaaatagctagcttctaagagaaactggtggagaggtgtaagattccttaagaaactgccccttttgtgagggttttgtcttgctatgtctttcatctgaagcttaagcaataggaaacaaccacaaacttatttgtctaaagaagttcaaatggcatccattaaagcgaactattctatgttgcatggtacaaacatgggtatggtacgcaacaggctactacatatatgtaggattgataatagtatgagaattcttgtttctggattgacttatataaatggtgttctattcaacactatcaggaaaagttgtaattttttaacagttttgtccctccaccaaaaactacaggtgtttataataaaatgaaaattgcactcgtctacttttgttgttgttgttatagtgttccttcctttgaaaagaatggttacgaattgaacaaaaagatccacttctggcatcttctttaagctctcctgttttatgcttcgccatgttggtggctgtgtcagtgtctgacactagtacctagcttacactactagaattctagttttagtgctacatagtctaaataagaaaaaaaacatcttaggatgctcatatggccctaacactgactactaagatgatgaaaatattctaattttggaatttgtacattctttttctctctgaaatcagttacatgaatttagtaattacctattacaactttcaacttactgtctgtagttcgtggagcattaagatgtctagctcttttatcggatgatttggatgatacatgcattccaaaattggtgccagaacttttcccttcattgtacagtataatatcatctcctcatgtaagtctcatactgtttaatgtctgttaaatttcttttatctaactgctatggaggcatttatttgtttatccaattttgaaaagcagctgtacgaaaattctcttcgtgcgaaggcccttgcaatagtccattcatgtatttccatgcttggatcaatgactggtgtatataaggtggattgtcttgtttattactctttgtgctgtttctacatattagtaggaaacaaactaaggtgatctgttggtgcagagagaaacagtcagtttgataagttcaatgcttgatccactcatggagcaattctctgcaattttgaattcaccggtgcagtcccataatcctgatgactggaacatgcagatggaggtatacatcatataatctgtgttgtgaggttgtaagcatgcattgttaatagtcgctgaagctttttgcttgtcttgtgaccaggtgcttaaatgtttacttcagcttgtccagaactttcctgggttgcctgaagccaaaatttctggcaagtgcaaatgacttgttatgatttgttaccccctctccctttttttatgacgaatgggcaattttttgcagctgttcttgcccctttatggcagacctttgtctcatccttcaaggtctatcaattgtcaatgattcaagcctcggaagatgtggattctgttgggtatgattctgatggtagtgaaagaagtctggagtcttttgggattcaggtaatatcttgcatttccgttttgttgaaacttccttttcctgttgttacatttttagataatggataatccagcctttacttcaaaagaagctacaaccacttattacaatgttcataactgaagcaaaagcaaatgtgcatactaataatgaaatgtgacaagaagacaatcctgttattacttatcactgaatttcagactctagatttctttcactgccaccattcctgttattttagggaatacgcaaaagacttgcacacctttgtattaagatagaaaaaaaaagccagatgcgatggtcgatcttacggaggatcgacccaccaaatagttattacagactattcatcacggcaacaatgacataattccctttattgtactccattgtttcatttgctttcatatctcaatatgttcttgtccttttcagttatttgagctatggatatcaattgtggggaattcacggttagcaaaggtatgacatttcaatgaatattatgttcatttttataaaaaaaacaaatactgcctctgtcccaaaatataaggagttttagggttggacacgggtattaagaaagtaggtgaaattaaatgtgtgaaggttgtgattggttgagaagagaaggtaggtaagaaaattaagaggtggaaggatgtgattggttgagaagagaataagttgttattttgtgggacaaacgttgaaggctaaaagttatatttttggatggagggagtactaactattttttgtgctgttctactagatcattgctgggaacattaaagagctagcatattatactatagcgtatcaacagataactgaagaacaggtatgagctggctgaatcatcattaattcatcttacttttggcaaattgtgtttttggttgtttttgcttgcaaacgcttacgtgttctctattctttttgtttctagttgcaaaactggtcacgtgatgctaaccaatatgttgctgatgaggacgatgtgacttatagctgtcgcgtatctggtatgaactttaacattgtttaatttttcttaacttggttggatggattttaacagtgcgatgtgccgaccggtattttgctgtgtaaagtctaaaggaacataagattcataaacagaacaggttaaactaagcaaataacaaaatagagtactgttactgtagtactgcatatattccctcagacccaaaataagttcattttcacctatctcacacataccaatacaaaccaaaaagactagaatacctttattaaacccaatgcaattattctccattttatctactcccaatgccattattccctattttttacaaactccgatgcaatgattacttaaaaatgaacttattttggaacaaatgggaggagccaaaaatgaacttattatgagatggagggagtattaagctatatgctctgagcctccgattaggtactcgggaaatattctcttgatgtatttgcaagactcgcattcttctttacagtttactcttcgacagatatttttttcgaaatgtaacatgttttcctcgtcttggttttcaggatctcttttgctggaagagatagttactgcttacgatgaatacggaatagagtcagttttggaggcttcacagatgcgttttcatgaatcacgtgaactaaagaaagcgggttctactgactggtggagagtaagtttttgattttttaaattactaagaaatcaaaactttggacttgctgcttataaacaatgttactctgcttatcatgttcctcggtacttttaccttctgggttatgtgccttgattttagattattgcactttcaaaaaacagaagaagcaccttcaatgattcttctttgattatttcttgtttggcaatcggccatatttgaatttatttcctaacaaatattaaatcccaagtatgttcatagtgtccttaattgacttatctgatttacccctttttttttgttccagctgcatgaagcatcattttttgctctaggttcactttccgaacagctctgtgaagcacaggttggtttttaattttataataatcagcaatttcattgactccttttcttttggcaaatgtgccctataattttctctagtttgcatatataaagaattgtgccatttggaccaggcatcacattcctacttgttatctaagagcttaacatatcgtaattcagctattccatcagtttgactactgtaggtatgatttggattttggagtgttccaatgtggtatgatggtattgtttgcactagagctgaaaaaaaaagagggggcagacatcctgaatctgagggaaatactaacaaatcacttgattcagttcagtatatactgccaactttaaatatcctatcgcattgtcatgctaactaacatcaagccaaagttaatacatggtagacaacctcagatctgactgtatttacgaaagcaacttgtgctcatggcagatagttgatagggttggaggacgaagagaaactattcaccatatgtccatgctcctttagttcacgcgagtgggttgttttctatatgattatctttttgatggaatcgttaggattgacgcactgactttagaattaagcaacaataatgaattaatataggccctccaaatgttcaacctccaagcctgccgtcttgcaggattactattcgtgcacttttcacccgtgcagacagtacccacacattactgtaagctgaaacttaggtttcttgttttagagataagggaagaatggattgtaatttatttacttgttttgaggatcaagttatacatctatataaggatccatggtatttctcctgagatgcctccatttccaccatgtagcttgggttcttggccctaccccttgtcccccttgtcatgaactatctttataacaaacattacaggaagtggctaatggggactgggactttggatcatggaatgctttatgttgaccattctcttaacataagtcaatgtatgttttactacctcatatggcagtccaagctgatgtatttaacaagcagccatgatttcctaacttaaaacaagattccccttgcaacatacttacatattgagaaaacacattgataggatttatggcattttattattcaccatttgaattctgattgtttaggattctggttacaacgtgcgagatttacttgagcagatggtaactgacactgtgggaacaggtatctttctttagtctgaaatgaagaattgtttgttcatgtgctattactaatattatgacttttagaggtgcaccagtacccgtttcttcatgcacgtgcattctccattctgtctaagttctcttcagtggtaagtttccttttttttatgtatttattttcctatatgtccagcaagctgatttgggaaaacgtatcagataagtaaggaaatctgcgaacagtatctatgcagtgctgctcatgcaattgcctcagatgtgtaaggccatgaatttattcgtcttatatttcttgactcaagggcgaatgatatttgtctgacatatttgtttggcagacctcccccagttaaagttggtgcttgtagggcactggcgcaacttctgccagaatctaaccagagcttgaatgtgcccaacattatgggcatactctcatctcttgttgatcttctggggaaggtaaattttaatttaaaattgaaaacattacctgccttgagttttttgaaatgaagacatgctattttgtggcaggcatctgatgaaacgctgcatcttgttctagaaaccctccaatcaaccatcaaatcttgtatgtcagcatgtgttccaatgtatcttgtggcaaactatgttttgtgttgcacattttgcctttttcttggttgataattatctgcttggtatgtaggtggtgaacagtcaacattaattgagccagtcatctctcctatcatcctagatgtttgggcccaacatattgctgatccattcatcagcatcgatgctgttgaagtgctagaggtaggttatcgtcagacttgggcagtacaacacatgacttttcttgaatgcaggaatcgatgcttttagttcatgttgaaattttacaccattttacttcattttctgaacacatgataactgatgtacaacagaaaacatttagatttttatttctgtgtatcaatataggtctggcatatatttgttttttccagaggtatgcaagattgcgaaagatgatgaaaataatattttattggatgaatgaatgtttctttaaagcaaccaaaaataattttagggtaggctgagtttgaaacagattattgagtggattgttctgcggattatttacttgattttaggggtaaattaaatatttttaccttttgacagccgaagtttggatttggaacttttttgttaatgttcttgattaccttaaaagttacaacccactaaacaggattctagtttttaggccatcaagaatgctcctggatgtttagaaccacttgtatcacggattctgccaacaattgggtccattttagaaaaggtaagacacttaattccagtttcacattattattaccttccttccttcatttaccagtgttatgcgaatctaatttatggctcatatcctagcccaagatccagcagaacggtcttgctgcaggctcactggacctgttgacgatgatactgaaagtatgtcgacacattattaagttccataaagttcaagaccaaatatttcttataagcagtgcctgaagcttctaatcggcatcttgcaattcatatttcagaatgctccaactactgtggttaaggcgatctttgatacatgttttacatctattattcaaatcgttcttgaaagtgatgaccatggagagatgcaggtaaatgcttacatgtggttcaatcattgaagtcataattgatggtacttttgtggacatatacctttaatatggcaattttttgtcaatttagaatgcgacagaatgtttggcagcatttatatcgggtgggcggcaagagttgcttctctggggtggtggacaaggacgtacactgaagatgctactcgatgcagcttcaaggtaacgtcaagactatagatatttgattcatttctgtcatcaaatttagcattatagagtacataagaatcaaatggcttcaatctgtacatcctgacaaacttcaccatctgtcaaaaggaatgcataaaaaattaacaacatggcatcaatctttgtccagagctaggagctcatatatgcttctctctgaaatttgatctgcatgttaacagccaagcataatttcaagctgaatcaaaacgtgccattaggcgaatgcaaacaattaagcgcttcctacactaaaatgtagttccccagtaaacgtacctgcatctttgtggacttgacaaagatgtactaaaaagagcagcaatcaggatttttcatgtgccttgtttggatacattgcttccttttgatgaaccaatcaaccccttttgttgaatatttccatgctatccctataataggaggtgcaacaccatctctctatcatacacacagagaaagaagaagggggtaaatagttggagtacacccctgctttatgccttaaaatttgttttggtacttggaaggcataaccatacaaacacctcttcaatgtctttgcaggcttttagatcctgtgttggaaagttcagtatcactatttgtcgggagttatattttacaacttattatacatctgccttcacacctatctccccactttcctgagcttattgctgctattgtgagacgtatgcaatccagcagcattactggattgaagagctctcttgttgttatagtagcaagacttgtgagttgcatctctctctctctctcccctggttaagttgtttggatttcttactacccatggtggattataattcgatatattcacttttcactttagactaagtttgaattagtgttttggttatcttagtatcttacatggttattattttagttattatttgttttagtcctgggtctcttttctacccaaccgcagtaggattatgttcctatcatcattacctaataactgtcaccctatgttttctagtaaagtgcattaccagtcccttaacttgtcccatgtgtcatcttggcccctaaactctgataattcagttccagaccacctgaacttgttatatgtttcacaaaatgtctaaacctcccagtcaatatcccctctcacccatgtggcacgtttgactgtgcttctgtggtcatctaactaacatctccaggcccgatcccgtgttgcacctccttgtaattgacctggtacaaatctgaatgtgtaatgggtatgagtgaactgctaagtctaatactgtggctctaggacctgcagtcgtcgcctccttggtgctgtgccagtggtgggtccttgagcttaggacagtcgtgctatgctgaactcctagagctcaatgtgcttgggcaaaactgatgtgtgcaaaacatcctagagaggtcaacgatggtcagtttttagttgcacagagatggtggagatggtgcatggaggaagcggtggcagtggggtttgggagataggagagcgggtggtcagagatgttatagtgaaagactcgggcaaacatgtattgggtatgccacatcagcatctgaagctatttttatttggattctggtgaattacttaccaaatttggggtcattagaatatgcatcttcggagttcatggacataatgacgccgtgggacaagtttttaaggattgctagtgaaatttactcttgtattttgagcgaaggggagggaggtggtgcttcaggaaattctaacatttatcacctgctacaggtacatctgagtgcaccaaatgttgatcagtttatcaacctcttacttgcaattcctgctcagggttataacaattcacttgcttatatcatgtctgaatggtcacagttacaaagtaagagctcataaaacagaatatcattgaatcaaacaaatgtgacctttttattttgttcgtatagtaagagcttttcaacatcctgtgtaggtgaaattcaaggagcctatcagataaaggttacaaccactgcattagctcttctcatatctactcgtcatcctgagttatctaggattgaagtccaagggcatattattaaggtaataccataaaagttttgtttgcaacagttcctacctgcttattagcagtccatgggtgtcttacacacaaaaattcagactagcgcaggtataactacacggtcaaaagctagggtggctcctgatcactggaccaagattccactcccagctaaggtaaacaattattatttgccataataattcctccaaagtccaaaattcaattcttaaagagctttcaaagcaattttcaattccagaaggagatgaatctgcacaaatatcgttttaatatattttgtttgtacataatgtctactgttgagtcagacctcaattttcttttcgcatggtactgtagcattggctagagtccattagttagtttagagacaaggtaagatttagttgttcctttatttttggtataaactactcaagggtcaagtcattgccatctatcgagcaagaatgaaaatatttacctaagcatacctgaacatggattatgcagatcttctcactgttagcagataccttagctgaaattcaggaacaagttgttggtgatgaagacgattgtgaagaggttgctatacttctcttgacactgaaaattttaaactggactgttttttttttgttaacattggttgtcaatacaggatagtgactgggaagagattcagaatggtgattctagtattccacatgatatgatatactcagcatcagttccttcaaatgctaagccatcagttgagcatctaaatgcaatggcgaaagtttttgatgaggtaagtcagtggcttgtcatgctactttgtaatgttttgttgtattaattcctttatatttacccctaattacatacaataggatgacgacggaagttatgatgatgacctggcaaaagctgactctcttaatgaggtttgccttcgcagcaaagtccatctaatataaataaagataatacacatacaatcaagtaaaggaattctttttttccccttacaggtgaagctgtcggactttctaacaaacatctttgtcaaattgtgggagagtgatcggctgctttttgaatatctttgccaggtaacactcctttgctgttttctttcattatctttgaaaactaatgttaaatggctgttttatttccattatcaatgaaaacataacatttcatgggtgtattaattttcttcttttgctttgctgaatgctaattgctataaatcccatatatgaatactacatcaatgttgtactgtattatcctttgcaggccctaacagattcacagaggactgctgtggacaaagttttgaggaaataaagcgcatacatgattgagatatctacatttggtcctattccacattagccattgggtgagctttgatgcttagtgtaggtttattgattaagagttctgtgtacaatgtgaggcgagtcctcgaaggcaggagttggtggtgtgtggttttgttagtgtaggtttatttatccaaatttgtctagatccgaaagtgaaccaacttagaaaatacaagcaaaaatttgccatttgtgtgttcatgtgacgtgttggatggtgtattgtttgtatccatatgtttggttcgtgaaagaaggcaaggaaattttttcatagcggtccacccgttcagtgctttcaggtcaatcggagttctgtttcatgaaatttataaaccttgtgttttggttttgatgagctgctcccaagatccagtcgacatgagtgcaagtcatttgttttgcatgagagcttaatcgatagagtaaattgtttcacttcgtaccgggtttagtatatactccctccgtattttaatgtatgacgccgttgactttttaacaaacgtttgaccttttgtcttatttaaaaaaatttatgtaattatcatttattttattgtgacttgatttatcatcaaatgttctttaagtatgacat

SEQ ID NO: 33015 - DNA, 4278 bp, Oryza sativa
ctagattgtgtcatataactgaagggatttttttttttgagaataactgaagggaaatccttttaggctgcgttccttcccattcctaactccccctccttttttccgtgcgcatgcttttcaaactgttaaactgtgtgttttttgcaaaaagtttttatacaaaagttgttttaaaaaacatattaattcatttttgaaaaaaaagttaaaacttaattaatcacacgctaaacgctgcttcattttgcttgccggggaatgctcccgaacacagcctaatcatgagtcgaacttctgatttttttttttttgaatttagatcatgtttcacaaagttttatccatattttatcaaatttaatgaaatatttataggtttgacaatgtaaatcatggtgtatgtaacttatttgaaggcaacctggtgtaaactgaaaaaaaaatgtgttaaacctagggcatctttggattgaagccaattcttaccttaccaattatttgatagttttgagtagcacttgttagctatttggattgaggccaaatcttaccgattcaatagggttagaaacgaacaaaaccctatcaaaatattggtagtgccaaaacttgcccaagatttggcattaccaaaattttggtagggcttcaaaccaaaacaacccctaatgtaaagtgtaatttactcatttgataaatgaccatgcaagactagatcccgagctcatcacggatgggtgctcaggaaagtgaagataacccaaacttaatcgatattaagattgccaagaatcttaagaaataagcacatcacaactcacaaggaacacatcatgctatatcctatgctcgtaacattagttaggaaattaggaaccaatcaatgacataggtagcaaccagctacagaaagtccatggtttcatctggaaaacacgccatccatctggtgatcagcaaacgaagaagcaagcgcatgaatctaaacaaacctattatgatcattgctctgcgcagtacagtacaatatccacagagaagttcacagtaaaacatgcaacaacatctataagagagattctcaactgctaccacaaatctcagatgcataaaagtgccctgctaagatcttacagcatgtaatttgtcagtgatgaatggctggactgtcgatacggaaatcaaatctggaatggcatgctaccatttcaactgcttctgtttctttcattcggcagagctacccgcaggcttcgattcttcgtcctttggcttagttggggtaataccttcagtgcccatctcaaccttgaggtcattgatgctctgctccaactcatcaattcttgcgcccatttcatctagtgagcactagttaaggactatgtacaaaagcaggtagatatgttgatagtacgatcttgtttatgtcaggaattcaacgaaaaaggcaaaagcctcaggaactcccaaacccagcaatttcttttcccagttatatgtatttaaactgtttcagatactcgatcagaactgttccagtgtactgattgaaggcacaaatatcatactttttaaggatttcaagttactaccaaaatcaggaactttttggacttgtccctcttttgtgtagtgactaatggacagatgtcacacatcaataatcttaaatgcccaagagtattcttacacactcagaactaaaggttcaccatgttaatattcttccttttaaatgaatatattcttcctcttaaatgaatgtatttaaagaagtaaagtgcacaagagaactggtttagaaggatattctttgaaatgatgttctctgacatagattggaacctggtttgctgcaagaaagttacaattcagtaaaagtgaagtgattgcatgaaattcgcatcgccccgccatgtgaacaaagttactcaccatctgcatcagaagattttgcacctgcaaaataaatagtgggcaaaacaaaaataaataagttgtcaagaaatgcactagtaagtacagcagcagcaacaacaaacaactcaatttatatagctcaaagaaaatgtgaactcagagcaagatcttaatgctcacgaaagcggtcatatcagcagtgctctgcgccgagccatccgagtcctgatcagcctgcattagaagagggaatgggatgaaatgagcaaactcggcaagcctaaccacaatcgtcagcccaagtatgccaccatacgcatcacaattcacaattataccatcccacgaaacaacacaaacaaacagctgatccatccatcccctagtccttcacggattacagctacgcactatgtatacagatgcaatctgctttgcgcgtgcaccaaatcttcggtagccaagaatcgccagcacgaggaaacctaaaactgcccacgccgcattcgccaaatgcagaaactgcccacagcccgagcagctgccacacgatgcggaggaggaattaatcccgcaacccgcagaggcaggcgggcaggtcgtaattcaagcaagaaccagccggcgggtgtgatgcgcagccccatttccaagaaattttggcgaaaatcgtcttcctcgagcgctcggcgacggcaacgggcggggaggagggtggcagcggggagggagaggtgtaccttgatggggatgccgccggagccggagccgggagccgccataggcttgccgccggcgagggggggagagcgcaggcgcagatccgctcgtggcgagatggaagtgggaactgcgcgatatgggttgggggttttcgaaagtgggcctgcggcacatgggccaagaaggcgcgttgcaacggatattataagagataaaagcaaaagcaaaatcttataagtttatcgcatagttagttgattaggcatataatgctatgctcaaagcaaaagcattcaacttgtggtattggaggtagtctcggacaccaccactagcatcatttaaagtagtatagataactgtgaatttattcttaaaaatacaatataatcatagtgtaattgtattgtaatttatatgtaacctgaatgtagctttcacataattttgaaccatatatttgttttaagattcgtaacattgttacagcacgtatatatgtaagaggattcggtttcacgacactacaaaagttgtacccatgccttgctatacatctaatacgtgttttgaatcttttttttgtctactgtatttttatatggaccaaaatacccctagcatatcttttaaccctagccccaaatctaacaaccctatcccaaatcgatcccctaatcgccccatgctagcgcctagcagcaatggcgatggctgctaagcaagctccaattgcggcagtggtgacggtaagatttcggcatagaggacggcgtgtccggcagctacgatgtgcggtccgatggtagcgacaagctccacattgctcgtgtcggtggaagctgccgatgctagcaatggaggggatgggcagcagttgactggaacgggcagtcatcgtgtatgatgatccctcctcaccagctccatccgctactgtggatgcgctcggcgatgacagatcgagtggcacagagggagcagatttggagggtggcaccgatgagcaatgctgagtacggtggctgccggtggtcatgaacaacaacccgactcttccatcgccctttttttttcccctacatttgttcttctttttcatgtatatttttttacacgaagttcaatcattttgtacacaagttttgtataacaatttcatactttagatttgaaattttgattagatctaaagcatcaaattgtgaagttgataggaggaaggtcatgttgttgttcaatgcttgatttgtaaggggcatatgtattttggtccatatggaaatacggtaacaacaaaacgatttagtttcagatgtataaattgacatatatatgattttggatgttacattggcatgattccaatttactctatttgaataaattttttaaaatcagcaaatttataataatgtcacttaaccatttcttttggatacaagcgaagcatattcctccgtcttctccccgcccgggtgtcgctctcctcctcgtcgccgtcgccggtcgtcgccggtcgcgggtggcgcgcaacccggagtctctgccggctgcttactcgccgcgggcttcagcttcctcctcgatctccggcgcgcctccaagctgcagatcggccgacccccc

SEQ ID NO: 33016 - DNA, 13973 bp, Oryza sativa
ccgccgccgacgagcgccactgccaaagccctagatcgaagcgaagcagagggccttgcctcgccctctccactcaggatttgtaccgctcgcattcgcatcgcgcgctcatgacctggagttcatgttgtggaagtagacgcatcgtagcaagcaccacccacgcgttggcttgcccccgtatctgcggttgattgattcctgttgggttcggttggtgtttgctcagattcgaggtgacaacgtaccagcagtgaagaaaaaacattgcgaagaagtgatcctcgttgcaccaagagtgtaaataatcttttgatcagctcctagaacaaacaataatcacatgtgttggtcccatgggcagaactagaaaatcaatccaaccaagatgagttcatgattgctcattctttcgtgcgtcagataaatcaagctgcatacttgggtaaaagaagatcatgtgctcaacatcttattgttctgctagcagttgtgttgaatcttcctatgattggccgaaacgtattatgaagctcctgatgcttctgctctcccagttgttggtaaagaaagtgatgctgttggtttggctagctgtctagttccttccagtttcttttgttcctagcatgggcaacagtagtcagcaatcatatcaaaattagatgaaatgcttgttacttgttgagacattgagatataatggattatggagatattactccatatgacataaatacatattaattatggacatctatttccagttttctctaatacttttttgtttttctgcagtgtgttgaagcctgcccttgacacttagcaactgcagagtcctgctggagagagatggggttcatcggcgacacgatagagtcaatccgctcgatgcaggtccgccaggtgctggcgcaaatcatcagcttaggtgcaaccttgcctcttttgcctcagtgattattttgctcacagataagtggattgggtccactacttcttgatttaggcttgggtatttaccttgtgattccaggagagtttctttgggagtggtctattcttagttctgttgggtttgatttcgctggtaacgctggggtagggaagtcttttgggattcttgatctagttctatgagctctattaactattccctctgatccatattataagacttttgggtttgtcccaagtcaaactactttaagtttgactaaacttttataaaaacatagcaacatttataacaccaaattagtttaattaaatccactattgaattgtagtatatttgatttgtgttggaaatgctgctatacttttctatgaagttggtaaaacttaaagaagtttgtcttaggacaaacccaaaacatcttataatatggaatggagggagtagatttttctaaggaatcatacggatctgggtaacaaaaatggattcgggaaacaactcttgtttaatgttaactgtaaaaatatgcatgttttatagaggaatcttttcacatatgagtgggttttaaccttagaaacttcttattccttttttttaaagctagggcatcagggcccccatttccattaccagaaatgagatagtgctacaagttcttgctgagttacttaagcctagaaaacaaaaagcgaaaggaagataaagaaggaaaaacaaaagggtctagggttacagtttaagatctgaaggatctcccggcatgacagcaaaatattcagcaaaacacacaactattcctattcagcagtgcacaccacaggacccatctttcacttgatgtctttagccctctagtcttatgatccccgtcccccaaccgaatttggagttgaaaatgtcacttgccacttgccttattaatctggcccccagcagaagtttttctcgatttgcctccaatgtctgcaacacagcccaggtttaaatccagtgacaagtcagaaaaactacctcagtagggtcttttgggagtttattctcaaaacaagcattgctcctaaatttccaaatggcccaaataactgcagccacccctacaaccactgagtgtttcatgttcttctcaaaaccattcaaccattgcggcattgcccaaacaggtgttgtatactcacaccaagtttcagattgagtgcattaattactacattccaaatcaatttggccattggacagttaaagaacaagtgttgaattgattcttcctcattacaaaactgacaaaagatcgagttacaaaatgtgatattaggcaaaaggagcacatagaatttactcactctgtcccacaaagcttcaccttttgccttcttcatttgccccacaaagacttcatctttgaagcagtcagtgcattttggagtttgagaaaaaaagagggacatatgcattgaagtttgacaaagtgcggaacgaatacattagagttctgagaaagtgaagggtattatggtctttttggttttatattggtatgtgtgagataggctaaaaatgaattctttttgggacggaggtagtactgcttagtatgtttttatcagttaggttagacttctgctgctcttatgttatatatatttattgttgatgcaacagcatatatgatagcttcaaatgtttctcttggcaggtatgattgttacctctgcattgatcatatggaagggtttaatagttgtaacaggtagtgaatctccagtggtggtggttctttctggtagcatggaacctggatttaaaagagtaagttgcttccttagacaatataagagccatattatacttatatttgtgcattcgcaatctttggtctttacatacggggatttacagtaatatttgttttttgtgcatacgctgaatttctcagttataagggacaaatctaaatttcagaagttccatctgcaacaaataaaaaagggaatttcctttttttaataagataggacgatatatggtttcctgtaatttatattggtttgcaaatggtgaacaaatgccttgttgccttattttacattccttaaaacttcgggttcattcatttcccaaaattttctttaaacagcaatttattcccatctgtgttcaactttcaccaagaagtcactttttaccctttaatgcactgtatgcatttagcattgttcatgaatgaattgttatctgctttcagggtgacatcctgtttttgcacatgagcaaagaccctatccgcactggagaaatagttgtttttaatgttgatgtaagtcttactgaaacattgtacattgtacatcatgaatttactgtatttctatatctcattgtattgtatttggctgttttctgctttctatgtagggccgtgaaattccaattgttcaccgtgtgatcaaggtaataaatttcaagtcattatattatcccatttgtttcagatgtcttttatgatctttcccctatacaatggagcttatcattctcttggtataggttcatgaacgccaggagagtgcagaagttgacatcctcacaaaaggtatccatcattttctatttgaacaccataagtttctcaccagtggttatagtggtgactggtaaagcattggcagtagtaatcacctgctaacaatgtataacataccgtggatacagcaatgtttgtttgtaactgatgagctgcctttcaggtgataacaattttggggatgaccgacttctgtatgcacatgggcagctttggcttcagcaacatcatattatggggcgagctgttgggtgagtgtcctcgactttgacaacacttatgtgccttcacacttaatgaaatatattttgcctgatcttatgttttgttatgcgagaacagttttctgccatatgttggatgggttacaattatcatgactgagaagccaattattaaggtatgctcatcctttctcagtatactgattgaccttgagattaaacaatgaatgcctgttcataggcgacaatttgttccgtcatataactcttcgctccttctctctatcaatgatagcacaaaaattaagcagtaccattgcagctcgataggtctcttaaaacttgggaagcatttctgactgactgatatacgatttctcttgctgcagtaccttctgatcggcgcgctgggcctactggttataacatcaaaggagtaataaagatgcggcttttcagtagagtagtggcctctctagtcgcatggaagaagctggtatttgtttcaccatgtttccaatggaagatgcgaggggtttatttttaggataactgtgcgacaattggcattgtattttccagcggtttatcatgtggcatccatctttcagtggtttacagttaattgcgcaagaaaatttaacgtgacttttggttcggcaactggttattggatgctgactttgatacaatataagatgaattcataaagcaatcctttgaggcaagtagaatcgaacctggctaagcctttttccatggatttgttggagtcttgactcttgagtgctaaatccctttcttggttaccaactgctattcagcggcagttcttttcactattgtatctgtcttctcaatccaaactatgctgaagtctgatcactgaatagcagcgcggctgtgatggttcattgaatactttgttgaatgctagtagctcatgtgccataaagccctaacagaatactggtgagatctcaacatgcacatatatgcttgtacttgtgtgagattgaggcaaatatttctgtgtatagtaagtatatgtgaaaaggagaactcgagccatattatagatctccagcccattaaatcgtatccagaatattgatatggtgttgtctttttggataaaagaagttcgtttggacgtggtctcttttgacaaatttgtttacttctgatgagtgaaatggtttacattttgactgttgtctgggtgagcttaaagcgtaagaatgatttgaccggctggctttaaaccatggcctttcacttcttgttcttggtccgcagttcttgagtgactttgaatgtcaaaatttcaggttgtcgttcaaacaatgcgatgcttttggcgtcaaaacaaccaactgagacgccaactgagcttagagtcttgtgataaaactccagatttaagatctagactcggcaagaaacttgtatttaccttgagatttaacatgaggacgtatttagtggtcaaagtgtgcagtgtgctagtgctatatggggttgagcctttaatttttttttgaagggatggcaaaagctttacgtctttgcctcgtatatcgatagagtagaagaaaattataaaaagttatgtatagggtctgtcaagacgacatacctggaaaaagagaattcttagaagatatctcccaaaattccgaactcttagagtctagatgctcttgcttcctccttgatcttggctaggattgaggttgacgttgatgctttgtggcataatattcttgcattacgttcgcaccacacttccgaagataccagaatcaccagagttctaagtggttggtgagggttattgggggactcgagcacaagattccactattgtttgactgagtgacaatcattccacttgttcattgtaggtacgtgctagtccatctctggatctctgcccatattctctttgtggccctacattttgctggtaggtgaactgcatatttgtcgacagtacaacacaatgggtagatcttttgatttttccaccctcttcgctccaacccgtccgctgtccacactctattttggacaatgagctaggagaagaacttgcacttcgaaggggcccatgatttctagatcgattggttgaaagcagttctcgtggccccgaggaaccgaagtctgtaagccaaatttgccgaaatttgacgagtattgtctatttgccgtgaggttccaccgaatgccattccgttcgtaatttagaggggtcattatcctgacgctagatcaaagtcgcacgaattgttgcaaatgttccttctctgtgaatcacaggatgtcaatgtctcgaatccaattgctttcttttttttttttgaggctgcgaaaatagcaggtgcaatcctccgtggggtttgattttctagccacttcgagctctaaaagcacactgtttgccatccccaactgttatggttgctgttgccgcaaatagttcctcgtcgagatgattgcacgggaccgcagtccctgcccatggcttctcaggtgccacccactctttccaatctaagccattgtgccgaagcaaaacgatcataaactgaaaaaaatctatactcagatcaatatatctaagcatctgattccgcaactcaacgaggcaaagacaaaaaaaaaaaaaaaaaaaaaggcaaatccaagggaaattttcatctacattgctccatatttgtctgtgctttgctgagtgtcacgtcaggtagcgttgtcatgaggatgcgattatctgaagcagcaggtcgttccacacgtcgatcgctccgggcaagcaccagtgcaggcagtcgatctcgaatccgtcgtgctcgccgccgccatgcccgtgccggtccgggtgcccgtccggccggagcagcatcatccgcgtcacgtccatcagcctcagccgcgcccgcttgccgccgttcctcgccgccgccgccgccgccgccgggagaactcctcgacctgcgcccggtagaactccgcctccgtcgcgccatctccggcgccgccccgtcctcgctctcgctggccggccgcgtcgcggtgcactccccgccgtcgaaccacccgccgttctcgtagtgcgtcggcgccaccgtgcgcaggatcgccgtgccgttgaacccgtccagccgcgccagcgccccgagcacggcgcggaacgccgcccgctgcgcgtgctctggctgcttgacaatggccgtggcggtggcgttgctgtcgccgcagtcgtggcagccgacgacgcggccgtgctggtagtacacggcggggcgcgcgaaccagtgcgacgcggagaggacgacgtagtcgtggctcttggcggcggacgtccaccgctcgtcgggctcgtcgaggtggaagtcgctcgggccggcgaacacctcgccctgccgttccggaccgccgccctccggcgggccgcgcgtcaggcgccaccggacctggaacggcgtccagaagtaggcgacggcgaaaccgtgcgccgggaagcgccagtgctcgaaccccgccgccgcgtcgcgcgacctcgccggcgcctccacctgcgacagcgcgcacacgagggacgtcacgtggctgctcgccagcgagtcgccgacgaacagcatcgacctcccgcgcacgagccggaagaaccgcgccgcgtcgaacggcccgagcggctcgcacccctcgccgccgtcaccgggacgccaccgccaccgcaagaactccatgctgggcctcccgtgcttcatgcagttctggtagttctggatgaacccgcacgtcgcgttggtgtagtacggcgccgcgccggcgtcgcgcatccactcgccccgcccccgcgccagcgcggcgtcgcaggcagccgcaccgccatcatcggcggcgccaggccaacggaaggagccgagggagaagaccgagaaggtggcggcggcgaagaagaagaggagcgcgacgagagccgggacggacgtggtggccttggcggcaacggcgtggcgggtccggcgagccccggcgaggaggccgcggatggagaggcgcttcatgacggttaccgacgaggcctcgccggtggcgtcgccatgtcgccgtgtaagtagtgggaggtcgccgatcgatcgagctccactgacacagatgtgaaagtcaacggcgggggaaagtggaggagacgtggttgatggatccggacgtggcgagcatgtgagcgcgcgtgcgtacattctctcgaagtgccccggtcaatccaacattttttgtacaagtatacggggctatctcgtgcatacgcaccagcaactgagatggcgcccccacccggcagacaagttttcttctctttttttttttacgatttttctcctattttggcacccccttccgtcggagcgtttttttctgttttttttttaatcttcagcgtacgtgttttttaaggaggtgtttggttgcccaccacacattgccacaatttctttggaaagtgtttggttgactactaaagctatgctcgtcacaagccaaacctcctcccaccacaatattttccagcagaagtgtggcgggctttttccccaccacaaccatccgtagcgcgccatatcggcgaaaaaaatcaccaactaccgcgataaattcacccccttgccttgttcaacacaacaaaccctatcttaccacatctctctccttccgccatgctccatggctgccattccacaccgccgtgctcgttgagctcacgggcagaggtactgccttctcccaaaggcagtcttcctttggccttctgccttccgatctcctgtcaccaccaatagatggcacctgttgatctctggttttcgttgtatgtgtgtgcatatctgagtagtttctaagccctatagaagcaacggaggcagtggaggcaaagggacaccaggtacatctaaattggtaactcctatttccaataaactataggtgtcatgttcatttatcattttttaaaataattctctattttcatagggatgcataggagcactatagtactgtactattctcaccactatagtattgaggtatttctatcattctgtaagaggaatccaaacagctaccacaacttcttgccatacattcgtggcaacgatccaaaacaacagccacattgattttgccacaccttagtcataaatcaaacagtctaattttgccacaaactctggctagccttgtacttaagcttaagcatggcaatgtgtggcctagaaccaaacacaccctaaatctttaagttgaaagttttcaaatcttgacttaaaaatcttctaatttaaattggaagtttcaaatatggagttgaaagtttttaaattttgagttgaaagttttaaaatttgagtttaaagttttcaaatatcagttaaactttttcaaaattgagatgaaaagttttgaaaatttgacttaaaaatttaaatttcgagttgagagttacaaaatttgacctcgaagtttaaatattgagttgaaagttttcaaagtttaacatgaaagttcataatttgacttgaaaattttcaaaatttgggtttatagtttgaaattttaagttgaatgttttaaattttttgtatgacttttagtttttaataaaaagttttagattttatttgaatgtttctttcacgtatagatttctttcaatctgttactcctagtaaaaaaaaccttcaaagaaagaaaatattaccttaattatcgttatatccaaaactaatatgattagttacgataagatttagcgcctccgggaaaagataaggttgttgccgactgaaaaaagaaaagtcaaaaacaaaatgtgtggctatgctggtccttatgagcctgaaacgcacgtcaccaattagctttgtcgcaagtatactcctactgaccctctaaaaaaagtatactcctattgatagttcataaggactcaggacactgactccatcatttcggagtttactctccctatcccataaaaaaatattcctactatgtcagatgaaattagtgaagaataaaaataaacaaaatacatcttattattgagaaaagtaataatagtgatatgtaggtaaaggatattgaatggagaaaacttctcgttttatgtactaaggataagtataatggcaaaagttggttttttatgtgacaagatttaaactttagaagttgagttttttttaaaaaaaaattggaacggaggtagtatagattttgatttggaaagatcaaactggatatggcttttctgacgttaggaactttaggaaaattggaggattcagttcctataggatttaagtactattcactcattcagtttggaggaatcgggtatgaaaatattggaggatttttttcccttcacctatgattttatatgaattccataggaaactgaacattcacgatgacctctttttcattttcctttgagaacttcaagacaaatcaatgcatatgacctcaaaatgagcctattccaacacttgtcaagcgaaaaaaaagagttacatatcataatcttgatacaatggttgtgcaactttttgtcaactttggatggaagtttataaatatggattcaataattgaacactctttatattgtgttgacaggtttttatttttaagtttgtttgtgctttaatggctacattagcctttataagtttcattggtctgcattcgtgttgagtgtttcattgtaataattggctgtaaatctcggagtaaaggccgggatggttttattctattctattattaaagaaaaactatttgttatactcaaatagcgaaagtcttatgttttgctctactcctgtgttctgaacaatgtgtgtgcattttttctatgttttttaattctatgtttttcatatacaattctatccgatttatgcattttttttctatttttatgattttgtattcctacattacaaataagcccctaaaccggaactaggatccatcatccaatccttgcgtctccgtgggtcgcggcgcgcgagagcaccccgcgccgtgccagtccaactaaagcgcccgacacgtccacgaggaagtcggggaagtactccgcgtttcacggctagccgaggccactgggcaagtgggcacgaagtctaaggccccaaagccagtgattgttggacgtgacaaggaagtaaacaggtttttggtgcactgtttctctgttcctacagaaaaaaagatgattctggtagagaggtagtagtattactccatccatcctagtacttaagtacaaccatgagttttatgttgaattttaatcgtctattatatttaaaaaatatttaaaaaataagttatgtataaagtactattcacgttttaccatctaataacaacaaaaaatgctaatcataaaaatttttaaataagacggatgatcaaagttagacatgtaaacttatgactgcttttaaaatggagctcatggttgttcgcacgccatggggagttgtgttgctattcaggttggttcgcagttcgtacaccaggccaggcctactggactatcattgggaggtgctcgatgagggcgttcatagtgcagtgaggtggcattctgttctaaccatccacgtcagatattcctccctagatgcatgcgtagcgttcccaatccaagcccgtggagccaaattaagtcacccgttcttcgtcagaacttgtaggcaggccatggccccatgcgacgcccccgcatcccgtatgaggcggcggcagttgccggcgaggccaccacgttgtcctctgttggcgaaaaaatcgaacacaccggcctgggagatctgcttagctccagtgcaggtccaaatcttgatgagatgcgggcgtgccagtcagtttgatcctacaactgacaatatatgcaaatagtagatcaaaacagccgatcggctgacaagccgatggagtagttccagccgatagccgataatagccaatgccgataccagccgatagcgatagggtttaagcaatcctatatgtccaatgtagataatgatatagtggcaatcagctaatgattatataataaaataacaatataatccaatatataccaatcggctagcaatgatatgataaataagcatcgatccgaaggttaaagcacacatcggctggaggtccgatgtcatgaaatcctcaagattagatagatcaatgaaacctttattgtcatcggctaaatccaactcatatgtatatgcaatccttatgagccgatgcaatattcagataactcaccggttgaaaccccgatgaaacccttattggcaatcaaaaagtaggctagagattatggttctaagcacaacttagtagatcaaacttaactgatgcagtactaagtatgaaaagaaacacaatatctagacaatcaagccgttgactgagttttcagggtggtagatgtctaagctaatctaatctagcaacgcgatttagccgataccggtagaaaccctaaaacgagaagcagccgatagagctaaattgatatgctaagactagattaacagagacatatgataaataggtaggcaaatatatcatccaaaccagagcaatccaagaggtcgaatgtactgatgcagccttgaacgacgccgatgtaaacgatacaattgcttgggccggcggaacattggactttccccttagccagagatcgaacaccgatgtagccccgcgtcaggtgctaagtcccgccggacgataaaataaaagtagaagtaaaaagggtggcgatgcgccgaattatattgatcgtagtgatagattacatagaccccgggtgtacatatttatacccatgggttgatacaagtctttgtcggacaagaaagaaactttcctaaagataaaaggaaaagataaagtccttataggccaccaaacacactttcctaaagataaaaggaaactaacaaactattcctaattaatatataacttgccatgccgtattttctttgaactcggtctcttctgaataagcttcctttgatagatcaatttccttaaccgaatatagcaagaatccgacgactgacgacttgacaactctcatcagctaatctcaggacttcaaagccgatgctgactctaagccgatgactactccaggcttgccaaaattcactgttaacatcctcaaagcggtgccgtgtcggatttggtgagctcgacggggtggtgacggcactagccaaggggggaggggggggggggggaaggaagatggcggcggcgatggcctgggaggaaagggaagatggcggcgacaatctaggagaagggaatatggtgactgcggcggaagtgagcttgggccaaaatgtgtgacgcactgctgctgccctggtactccaggtgatactagtcagcgctggcatatgacaaaactggtgccatccattcagttggcatccactgcaaaccggacgcgcgccggcgcacgccatccatccatgcgtgcgtgcattccgttcgttgctcatcctctcccgtcctgttccgcctttgcacgatacgacggaactgccgggtttcactcgtcggtagccatccgatcgtaccgtgcattcctttccgagaaacaacatttccagaaaaaaagacccaccccatcctagaaaaagagttgctcccactcaaaactcacggatagaaaaaagcaagtacaagtactaaattcctagtgcaccggcagggcacttgtctgtgaatattggagggtacttctatgtcatagttaaacaccatatatagaatttgaggggttaaataaacttatttctatatgaaaattttgagagagaaaaattacaaagatgaaccagaaaactcttcacgattgatgacgcagcagcatctggagcagcatctcgttccacacatcgacgggtccagggaggcaccagtgcacgcagtcgttgtacagcgtcacgttctcgtgcgcccagtgcccgtaccggctcgggtgcccgtccgcccgcgccaccatcgccgccgtcgcgtccatcagcagcatcctcaccgcgctcccgctcgccgccgccgccgcctccgccctcctgaa

SEQ ID NO: 33017 - DNA, 2303 bp, Oryza sativa
tattctttcagtaaaaaaatctaatgggtgtgtgaagtcatgtatccaccacacttacttgtgctttcccacaaaacatcacatttttacgcggattaatcccgtaatttgtgccaacaaatgtgtcaaaatgttttggttaccttggagaggaggcacaggagagactgcatatggttcctggagagcgagtcgccgacgaacgccatggacttgcccctgacgaggtccaggaacgccgccgcgtcgaaccgcgggagctcgcagcgctccgggcgccaccgccaccggaggaagccgaggtcggggcggccgtacttcatgcagttctggtgctcctggatctccccgcaggtggcgttcgtgtagtacggcgccgcgccgtcgtcggcggcggtggcgggcacccactcgccgcggaagatgtcgcagtccgccggcgcggcgcgccgggcggccctcggcagcgacgcgatgctgggctcgaacctccggaggaacgaagggcggcttgccgacgccgtgagcagcacgacgacggcgagcgccgtgagcgacgccgctgccgtggggttgacgcgctgaagcagcttcatcggcgacaaccagcaatgtgcaagcaagcaagcagctcagagcagctccagcagcagagacgccgctccgccgccgccgacgctcgcgccgccggccgcgggagagagaaggggatcgggggattttctttctttgttttttttttggggtttgtttcgaccgacgcagttgaatttaaaggggacagaggcgagcagaatcagtttgtcaattgttaaatgtatcagattctgctcattcgaaaacatttgatttatataatatatggtcattttcatagcaggtttggtaagaattttaatctcactacataacatacaatataaggccctctgaatcgcatgattaaaaaaaatatagaaataggaaaaacgtaagattttgataggaatttaggtgtaaaacagaggattgtaaaacgcaggaaaacacgggaatgaccgtttgattgaactgcaggaaaaacgtaggaattggatgagagagatagactcaaaggaaatttatcaagaggttgaagctcttactaaatttccttcaaaatctctataggattgtccattccatagaaatttcaaagtattggataggattcaatcctatatttcaaagggccttacaagaaattttcctataggattgaaatcctccaaaattactatatttttttcctccaattcaaaggggctctaaataaggctgtatttagtttacactaaaattggaagtttaattaaaattggaacaatgtaacggaaaagttagaagtttgtgtgtgtagaaaagttttgatgtgatggagaaattggaagtttgaagaattattttgaaataaacacggcgtaagtcaatgacatatcaagagatttatttaacaaaaaatggacttcaatgaaacgtgagatataaatgggcttgttcggatgcaagtaacagccggttgactatatgtcagcgttgtactaggcagcggaacgaagccattgaaaagaacaatgaaataaaactttgtatcagcggaataaaatttcccattaaaaatgcgctaaatgttacaatcaaaaataataatgagcagataaaatttaagagatatagaaagatataacttatttaatacttcttcatttatgggccaacaataaataaggacagtccaaaccctccacctcaactaatttccatagcattaattatactgtcacataaaaaagctgaggtggaaaagagtttttaatgagaagagagaacatttctcatggaaaaaatagctctacacataaaccaagaacaagaataaaaataagagaatagctggatgaaagaagagtgaatagagataattgaatgaaaatttattatgaagaaaccacccattagatatatagttatctgacatgatgtctatatatatatatacatgttgagcatggaaactatttgatactccatccgtcccattttaagtatggttgtggggtttctatgtccaacgtttgtacatccgttttatttgaaaaatttacaaaaaataaaaagaagtcacgcatgaagtaatattcatgtttgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggg

SEQ ID NO: 33018 - DNA, 8368 bp, Oryza sativa
cgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggagttgattctttcccagataatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatttttccacatacagagagagtgagagcttgagatttcaccctaagccctcggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtcagccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcactccgacatggacgtgaagatcagccctccgtgcccccggccggtggtgttggctgtagagcctttgtggcgagtcttcggaacgtccgttggcccccaaggttccggcccaccatcaccgagaagtacgatgggagcgtcaaccccaccgagtttctccaggtctatacgaccgggattgaggccgctgggggtgacgacagggtcatggcaaacttctttcccatggccctaaaaggacaggcgcggggttggctaatgaacctgccacccgcgtcggtccactcctgggaagatttgtgccaacagttcaccatgaacttccaaggtacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctggggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggtttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaatcccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaaggggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgctaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcgacccgaccccttaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcccaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggtgtcgccttcctcgtcggagctgggggcgaacgcaagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggtgcgaggccttccagattggtggggggcaccgtcgtctggcctccccagagcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttagcagcccgctgctccagcgcggctctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggtggcctcgcggtccatcaagcccctctccacggcgccggcatgttcttccagcgccatggcacgggcctcaagggcctcct

SEQ ID NO: 33019 - DNA, 8539 bp, Oryza sativa
ggcgtccaccgagcgccgcccctcctcgacacgcgcccatgcggcctcgagctccgctcgttccgctcgcaaggcctccacctgggcgctaaatccatctagcaccgcggtgtttgcggcggccaaggcctgcataatgggctcggcgctcactggggcgacgagagaagaggagaaagccgccttggagaaaaggcgacgcggctcggccccccggaggatgcgctgggctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcttcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcgacctcggactggccggacttggggcggcgggaggaatgcgacgggacatcgctgaagcagaagaaaaaaaccaaaagacgaacaaaatgagtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttccttccagcttcctcttccccggggcgtcggcagggcggctgctccccgagcccccgacgcggggcccagaagcacgaccccctcctggggcagattttttccccgggcggctctcacccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctgccggcgcccgccagctggagacctgcgccgggggctggcttggaaggcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaagtccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgaggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacgcacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggggttgattctttcccagataatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatttttccacatacagagagagtgagagcttgagatttcaccctaagccctcggccgaactggcaaaggggggcctgcgcggtctcccggtgaggagccacgagctccgtcaatgttttatcatctaataacaataacaatactaatcataaaagaacttcaaataaaatgaatgatcaaatgttggatatagaaactcatactactacgtcggcgtcgggggattttgtttccatgcggttcgtaagtggaaccgcacgggaaaatagggggaccggtgccggattatcgcccgcacgggaaaatacattttcctatgcgggcgtcttaatccgattcattatcccgtgcggttgatttaagaggaccgcacagaaaaatcgattttcgcgtgcgggctttttaagtggaccgcacaggaaaatatttttcctccctcctttccctcccacccacttaaaatttttacatatcctctctcctcctttttttccctttattctacctcaaccactcctctctctctaccttatctctattctccccctcctccctacacgctcgcgcaaggcggctgggagcggcgccgccctccccatgcccggatccagcggcggcagctgccccccacccggatccagcggcggtggcggtggggtgcccggaactagggttagggtttccattttgaaattttattttttttttggatttttattttcccgtgcgtgcaacataagcacccacacgtgaaaattggattttcgcgtgcggcccgcacaagaaaattgcgattttcccagacaatctgttctagacgggcgaatctaccgcactcaaaaatcaaaacaaccgtgcgcaaaaataattattgtagtagtgtcataaatacagttaaaatgggaaggagagagtagtttttttggttgggttgtcctagtgggcaataaattaattttcagataattttttaatgttttaagacaactcatctttcagataaaggtagtagcgtagagttcaaagaatgacttttttcataacaaaatgaatatgtatactatttttgaactttaaaagttacaaacatagtggtaattggaaagtttctacgtacctttaatgacccataataagaacgatgagtaataaatctacacacactagcactacaatgttgatatcgtaaataatgaagtatgtggacttttgttcctctccaaaccgaagccatcaaataatgaaaaaataaaatcataatgaggtacaagataatgacaaatataacatggaaattttataacgagaatgatttttttttattttttgaggctttaaagtgtatggtggggattaacttttttttaattcccattgcaatgtgcatgtattcagctgatattactagtatgataatagcatcagatgtaggggtggcaattttcccagtggggctgggaaacaggggcggggatgggtgctgatttcgactcgcggggagtcggggtcgggggcccggccatgggcggggacgggggcggggtaggatagccacctacgagtgacccgtggagccctgagggtgtatattagactattaatactaccatattgcaagcccaaaaaacctacgtagcctaccatgtataaaccaaaccctaatttccccatcttctaccctatccttttctcacccacccagccgtcactctccaccaccacttgcgcttcctccggcggtggccaggctacggcgtcggcggccaaggagcgagcgatgctgtcagtggccaagtcgcgggcggcggcggcgaccaaggtgcgggtgacggcggtgacgacgaccatggtgcaggcgacagcttcggcgaccaaggtgtgggcggctacgacggcgaaggagcttgtagtgatggcatcgtcaacggctaggggcatggccaaccgcgtcggcgtcgacatgcggttcatacgcagcggcggcggcgccatttccggcatttctcctcatctcgtggccacctcgtcgctgtttgccgtcggtggtgcggggccccgctcacccacgggtcccctatggggactaggacgggtgatgtttcccacctgaccacctctatggggccggagctagggccggagtgagaaatcggggagcgggggcaggggcattctagctcaacccgcccctgacccgccctgttgccattcctaatcagatggatagtttatcagtgtatgaagtaaattatggagagggaatttttttaatgccccttcacatggaggagctagctccttttcttttaagaccaaagatacataggtctaaaggctatgtttggcggtccctcttcctatcttctatccagtttagctaaacacactttgtaattttatgaaacataattaagagaggattagggataggactagtaggactacccgccacgcatgagacatgatatagagtcggtctaacgaaaagtattaactttattagacagtatttgggtcggaccagatcttttttatacttgggtgcaccgcgcaagtgcaggacctttacctggctgatactccaaaacagagtgtggacatcagatagactagcaaccagaggctggcccaatggatccacatgccctttatgtcgccagactcaagagacagctctctacctgctagcattctagcataatgtagatacacaaggagaatctggaatgaaattacgcagtggacattcaatgaccacctaagaccttctagctggtaaataattttaacggtacatgagtggtgggaggccaccgtaagcatacgggaagcatctaagaagacactacgcacgttaaccttacttgttaactgggagatatggaacgaaaggaaccagatgactttccaacataaggaattatcgacgccaactctgctagccaaaataaaggaggaagcaaaaatatggtggctggcaggcgcaaaaaatctcactgcctggttgacaatataattgcctgtagttagggccgtggccctggttttgttttttttttacattctcatttttgtacagtttcatctcctctattcaatgaaattggtggcctcgttgattcgatcgaaagaaaatatgcgccggcccttacttgaatgcaacttaaatgttacgaaaaaaggggaaaagagactattttacatatatcggtgctgttcgtttccactacaagaagtgaataaagttttggatttttgtggcacgcttttcaaactgttaaacgatatgtttcgtgcgaaaactttctatatgaaagttgttctagaataccagattaatctattttttaagtttatataataattaaaacttaattaatcacatgttattaccacctcgttttacatgaaacacttgatcttcatcttcaggagattcaaacaccagcatcatgtgatataatctggatacaaacaatattagactcgatctacgtgtatactgtatgttctaaaaataacgtttatattgtgttattaaaaaatcgttctacaattggagaaaccataatgaaagaaaaaataaagcaacgaattgaattgtgcccgcacaacatgaatatatatatttttctccagtttaaacgtgcatgtttgtttgtgtagtaacttatcggtccaatcactaaatatatttttggtgtcagcgctcttaaaaaacttatcggttggattgtttcactatagctaattatacataaaccgtaacacacttattagcaatacaaaataatttataaataataataaataattaacggatactatacactggtggagaaaccatttttggtcggtccaccaaattccactatagtctcggttgcaataaaaaccgggactaaagatcatttttagtcccggttcaaaaaatggtaggtgatgtcagacccctctaatatctttagtcctggttggtgttaccaaccgggaaaaagatgggcatgcacagagagatcgaggcgtgcgcgtgaatcggatcgagatacatgtctcatcctccctcccggttctatctcctcctctcctcacaccctatctcttcttctcctcccccttctcctctcctccccattctcctctcctccgagatccccttctcctcgccatcttacgcgcggaggatcctctccgcctccccctcccctcctcctccccgatctgcaggcggcggcgcacgacggccggtggaaggtggcggccgggcggtaggtggaagaggcggcttgcgcggcggcgggcgacgcgccagatttgttttgttttgtttttgtttttgagaatttgtgatccggatctgagatgtatttgatttgtgtgtggtgtgaatatgtgatgaattttgtagaagttgtgatgtaattttttttaagattttatgatgtatttggggatgatcgatttgaggatttggaggtgttagttgatttgagattttgggaatggggatggagtgaaatcaatatattaaaaacaatgaagaaaataatagaataaagaagcaactgggtatcagtctggctctatctttagtcatggttggtaacaccaaccgggactaaaaagtctctatctatagtcccggactaaaaatagatttttactcccggttatttcacctgggactaaagataacgatctttagtcccggatttgtagtcccgtttggaaaaccgggactaaagggggttacgaaccgggagtaaaaactacttctccaccagtgaaatatattaatatatgcatttcacttgtggagaaatcatttttggtcggtcaaacagatttcataatagtcccagttgtattaaaaaccgggactaaaaacatctttaatcccagtttaaaacatctttagtaccggttggtgttaccaaccgagactaaagatcccga

SEQ ID NO: 33020 - DNA, 3159 bp, Oryza sativa
agggcttgcgcgcgggcggctgctacgagggcgtgaggcggccacgcgcggagcttcgacgcggcggcaagggcgtgcacggcggcggccgcagcgagggcgagggcgagcgcgagcgcgcggcggcggcggcggctgcgagggcgggcaggctcctcactggccctggcagcggctactgttgttgctcccgtggccgctggcttccacgctgactcgccgaggcgtcgtcgtcgtccgcctccgcttccacgcaggagttcaagctctccccgacctctgccctctcccctgccgcgagtacgccgccatcgagaggtccgtacggccacttccccacaccgcgcctcctcgtactacgcagccggcgacgaccccatcctgctcgacatcgatggcgacgacaacgcgtgcttgtgtccacttggttgcaacatttatgtcctccatctgcaccatgactcactttgtatttctcatgattgttaaatgctgatgctcaagttataactgatgaactgatgaactctgtttttcgtaactgatgagcttcttcgtcatgaaattcttcagtagcaactttccggacctatcgaaattttgttcaaattttggtcaaattttgtacttggctagtatttgttatttttttgttgaaaaacatcacaagggatgctcatatttgaattatttataacaatcatacaaactgaaatcacacggtagggacaaaaataaaaatgcaataaccaccaagaatataaatgtccttttgctctacaactaacaccgttaaaccgactattagaagtgggggtagccagcagtttcagattcaaaaagtgagggtaaaattgcaaaccctaaaaagtgagggtaaaacaacaattgggtttgaaagtgggggcatagatgcaattgtcactatattaaaacaatgaagaaaagaaaagaataaggaagcaaccatatcttgcctctgggactaaaaaggctctatctttagtacggttggtgttatcaaccggaactaaaaatggatttttactcccggttacttcacctggattcgtagtcccagttgaaaaactggaactatagggggttactatccgggagtaaaaaccatttctccaccagtgtttttagtgactgaataaccaatataaaaataaagtataataaaattattataagatattagaatcaaaatttaaaatttaatcatcgtagtcattcttatgaaattttgctatttttttctccaactattggttggatcgcgtgcatatgcgcaggtgcatatacgcaccttggtgtaaaaaatgccttggcgtttggatcctgtgtccactgtccacagatgagtactgtagatcggccacgtgaaggcaaggggatcgatgatggtgtcagactatcagtacaagtctagtactattagtattttgattagcgcctttggggaacattatcttgaattgagagctactagtaagcaaagtactatatattagggcaaataggcaaataatgcacatggcataatgcaaaagaaaattttgtccctttgatcgaaggggaaaaaatagtatggttatttaagcaagcttaatactgtagtcaaccactacctacaaatcatatataaccaatctaataacatatttattaatagttatttataaatgtatactataccactaatatttggtctaccttttacgcacacaatgtcttagaacatgtgttatagttggctataaattctcttcctcttatatttttatatgtgtttatagcgggtttatagtttgctattctatttgctctcaatgaactaaactggtagtacaactacctattcccaccagtattaaattagtaaagcaggaaaaaaacaatttaaatggtctcatctcacaacagtagcaccactgcaccaatacctcgacaccaagcgcgtaccggaaagaacctcaaacagtggacctagaagttagtaacaccattggtgcacccagaacaccaaaagcacctaattaactacttaacaaaagaaaaaagaattccatcgcactagctacagttcaattttatgtcaactccgtttaaactttgtctcctttactatcttctctctccctaaaccgtcttaaaaaagtctctctctccctgtgtcacccctcgcgcgggtgacttggggcaaaccctaaccgtcgccgccgcctgcactcccaccccctctatgccttgctgccgccggagaaccgtgcgaggagctgagatggcagtagggccaaaacgcggcgctgcactatctccgacacgagggagacagaacgacgtgcagcgagccggtagccacaggggacgctcgccggcaaggaagggcggggatctacatcgctgtggccggatcagggccgtaaggcgcgacaggcggcgacgcaaagagctgcggcgcgggcgagcggtgtgtcccaccggcagggcagagggtgagcagtggcgggcggtggcgcagagggctgtggcgcgagcggtggagtccaagtggcggggcagagggtgtgcggtagcaggaggcggcggggagggctgctacacgggcgacggcgcggcgagtgcaggtggcggggcacttggcgcgtggagtgtgtgaagcagccgaaggtcacggatccggcgtccctgcccgccacggagaagagccggcaacaacgggcgcccggtgcgactgtgcgagggatgacgccgcactcgtaatgtgtccagtgcagtgcatggtggagggtatcaataggtattagctagtaccaactggcaccgatggggtaccagatctggtactgacgagcgttagacctggtatgaatatgtatcaggattgatatcttctcttcatcccaaataaattaaatcgtgtacaaaagttggtatttttgatagaggaagtgtatattacattcgtatctcgtagggtaggtataagatcggacaccaatgtgtatcatattctgtgaactccaccatataccattgatacagataatgtttggttgctacttctatttgctaacagttcgaagagctaaaaatatgaaaattacactatctgtttccattctttaatttcagcagcagcatatgtactca

SEQ ID NO: 33021 - DNA, 3977 bp, Oryza sativa
tcgcgacgacggtgggctcgtaccttcggaggaaagaagggcggcgcgagcgcgacgacgccgtgagtagcacgacgacggcgacggcgagcgccgccgtgagggacaaggcggcgcggctagcgaacaggagcatcttcattatcggcgatggccagcaacgtggtacagattacagaagcaaaaccaagcagctttaagctagcagcagcagcagcagcagcattgcagcaatggcgtctgcgccgcgggtgagcaaagggggtgaaactgagactcgtgctgcggagctagctgagagttgagtgggagtaaaagatacttccgtagagatggatggagcaggtcatgtcgttgctgcatcttcactcttgtcgcattgtggccattggttcctgggggcagttgagttgggtgcatgtgagtgtactgggcgtgtttcacggctacactgtgacggtaaagctttcatggtaaaaagttagatcggaaatgactcaaagtcatgattagattgatggtcaagtgagtattatagtagagtaaattgtatttgttaggtgagtgtaatttagtgcataaacttgtaaaatactcgttttagtgtatgaaattgtatggtgcatgtggaggaaggcggaaaggacactacatggctaatcttattgatttagaagcagattaggatactatgtaaacatatatctgagaagattgctattagacatacacctctttagtaaaaatagaatataatatagtgatagtagaaaaagattaaaaaatccgagcaatgatgtaagggttagaaatatatgaaattcatcatttccacgatgaaggataaagtagagaccaaatttataaatattgcatttcttatgcataatcactacacgtacacacgtcacatcctaatcaacatcagctttgtaaaattaacattactaagttattttggtcttcgttcgtacgaactagacaagttcgtgtactgaaacgagcattttacaagtttatatactaaattacacctatctaacaagtttgtgtaccgccaatacaatttactcagtatagtacctccgttttctaatacacgatgtcgttaacttttgagcatatgtctgaccattcgacttattccaaaaaattatgtaaatgtataagatataagtatgcttattataattacataattctttttaatatgacaaatggtaaaacgtgtgacaaattcaatggcattatctattaaaaaaaggagatagtataggctttcatcgtttccttttttttctttccgaaaacattagggaattacctccatttcattaaaaagaaaagaaaagaaaatcgaaagtagggaaagtactacctctgtcccataataattgtatttttgtaggattcaaatttgtctcaaaataattttcacaatagagtactaattgttctatcaatcacttttcattcaaatttcttcctattatatcctcaaaaaccctcctacttttatctatacaccgattaatgatggacatcatagtctcacttttcaaaccttaatatattccgaaattataattattttgggacgggtagtactgaacgtcatctaacaaacatgggtcgttcgatttcgattccggatgatgcaaaccatccgatccttcaactgatgaaaccttctcgtgatccttcacgaaacttcttttttcaaggaagtccttccacgtccctgctaggggaaaaaaaatcgcattttgtcgttcacggtgttgctagctaggctgcgacccctcctctccttgcaggcgccacgccgcctttccatcccgggcgccactgcaccgccgtctccacatccctggagccccgccaccgtatcctctccaaccccatcccctcatcctcctccacccctgccacagcctcctcctccccatccccactgtcgtttcctcgccatccccatcgatgtcttctcttccccatcttcagtggcactaccatgacctcctcctatccatctccgacagaagctgcagatctggtgtccttccatcttctttgctccctattcctcgcaatggggaaggtcaacacctctgcctcctttcgtgctggtgactccaatgcttctacctgtctccatccctaattcgccactaggaggcacggtgaagcaaagacaaaagggagacgcggaggggaatatggcggcagattgggaggggagatggtcatatggagatggaggcggaaagggcctcttcgtcacgtatagcaacttgtgcttccactccgcttccacttacggcctccgcctgaccgtgagtacattttatagaacttgtctagcctcatgttcaactttggtggataaccatattttgttcatctgaggtgcggcggccgccggcgttaggcccatgggggcgggagtggaggaggccacgcctctccacgtcgtccttatctgcgccggcgagaggagggagcagaggggagatatagagagaggggaagaagaggaagggattgagaatgacaggtggggcccacgttgaccccaccatttttttattattgtgtgtgaaactgacatgtgggtcccataagttttattattttttggatcgaattgccatgtaagcgccacgtcagatgaagaccgagtcaaattagccacacgtaggcgctacgtcagctaaaacctccatccagaccgccatgggacctatagtgcaccgggtttgacagttgagggacccattgtatctggtttttcggtggaaggatgaaaatcggattcgttgacaatttaagggacctcaaatgaacttattcctaactccttatcattgcaatcaatcattgattgatgcttatacaaaacatttcagtaaagggccatgttgaactggtgataattccataaattatacaaattgaataggctgccacatttccaaattaaatggtaatctaatttatttcctcggttaattaatttcaggtataccgtagcaacgatgttttagtgctgctgtaaagaatataacaatggacataactgtagttggtgcaactggaggatagaataaattaacatgaagtttcaactagagttgcagttagtaacataggagtattatgttaattgcctcattacttttggagaggttcataccaatttagtttgtttttatactatttctgaatcaatggtttgttctattaacatgttgtaacctcggaataattcctttcatggacggtcaccaccatagtctttgtctctattgtgctagtactgatttctacgaaagaacagtcaaggggcctgtttgggggagttagctgttgtagcttcttccagaatcagaagctccccccaaacagtcatcttttggtctaaattttgagaatctgtagttatagaatccataaaataaactagaagcctttctagattctcagaagctggctaccagtcagctgcttcttagaatcttaagctctcccaaacaggcccaaggtctcattcccagctgcttaattcgattgtgtcatgtctcttatcatccttccctgtctatggatttggattttagcctttcaaatatatatgcacattataaattctaacgtttgctaacttctcctttatttcataagcccaaaagaccaaaatgatttggctccatgattgcctagagagttactctaagttctttaccatctattagatgtacacaactcaacatttaagcttagaacatactatatgccttattctgcattggcatcggaaaagaaatgttgtactctttgtatcagcactacagatacaatttgttgagtttggatttgcaatgttggctgtgtttagttccctttaaactttaaactttcagtcacatcaaatgtttggacacaacatggagtattaaatatagatgaaaaaaacc

SEQ ID NO: 33022 - DNA, 2040 bp, Oryza sativa
ctatatagcaatctttgttttccaagtctacatgctatagttgttttagcttaatgttttacacctatatatttgtcctcaaaaaataaaaaatattatgttattagtgtaaaattggacttatccagatatgttatatttttatacatattttaaaaatgaaagctcacgttttatggtcagagttacagaaaatcacatgtgttatgaattgtaacacgtaaccacgggttttatagtctaaatgttttataaaaccaacacactctatgttttgtgaaacttttgaaccataatagatggggtcaggtggcactaatcgtaataccgggtttttatgcaattaaccacaaaacatcaggtattttgaaatttgctcaatatatttttaagacatccatggtcaaatttaatcttgaagacttttcaaaattaaatactctaataatccagatagaaaataaaattatacataactatacatacataacgcttggactatatttgcattagtcactagtggggtgtggtggtgagttatgcatggattaacctagtatatgtattgcactttccatagaaatttagtggctttagagatttactgttggtattcatctatatgagtatgtgttagatggtacatccatgtaatcggagaaaaaaaaattaagaaacgtatacgacgctgggttggggaatatcgtgtgatagggaaaaataagatttagacataaaggatgttggataacacgtgttaggggaaaatggatttagacataaaagatgctggatacagaagagaggagccaaatagccaatgtgcttgtctgcatgtgtgttgacagacgctttgtgtaatttggaaaaaaaaatatgtacacgacgacactgatctgactagataaaatcggtatcatttcgggttaggagggccgtaaatcggacgacaaccatgggtgtggctgatcggcgaccagccgcgcgggcctgcacccgcgcggtcagtcctgcctgtcagtccattagtacaacaactactgctacaatactactaatactaatactactatcactacattattatttctacctgtaatactagtactattataattgtttttatatgtatatatacacatatacaaagtttatatatgatgtatacaaaatttatatacatgtatacaaactttgtatacgtgtatttttggtttttttatatacgtgtatgtataaaaataaaaaaatacacacatatataaactttgtatacgtgtatacaaagtttgtatatattatatatgcatatacaaaagttttaggtttttatttacgtgtatgtataaaaataaaaaaaatatacatatataaactttgtatacacgtatacaaagtttgtatatacccgtatacaaactttatatagacgtatataaagtttgtataggtgtatacaaagtttgtaaacgtatgtataaaacaaaaataactgaaaaagatacgaaaagaaaaaaacagaaaaaacaaaaaaaaagaaagaaaaaaacagaaaaaagaaaaaagaaaccgtccaaaaaaaattgggccaattccctacatgcccatgtaatttcacccagtcccttctacgcccctgaaatttgtttgatctcttatatacccctgagtttttattccgatcccttatatacccattccgttagttgaccattaatttgaccgttagtaattgtagaaattaatttattgtccttggtatattgttaaaagctagaaatgttttatgtgtaaattatttgtgatgtgaaaatcaataaggaataaattactaaatatttgttatgaatttttaaaaataaaacattatttcattaaaataaaaaagatttattgtaaaaaaagttctgcataaaatttgaaaattacttttcaacaaatatttagtgaaaaaagattcgttgtgaaaaaacaaagggggtgtaattagtttatcacaaattagaaaacaaattaaaaaattttaaataaatttcagat

SEQ ID NO: 33023 - DNA, 1603 bp, Oryza sativa
acatcaaatcatcaacggcagagatccgactgttttcacaaaaaaacatgcgacacagatatagctcatccgaaaaaaagaaaagagcagcaaatccacgcatgaatcatgtcctttttttttaacagcaaaaacgcatgatgctcgtacttgacatgcggcttgcctttgttcccgcgcgttggttcgcacgctagaactgatatactctctctcaaaatactacacacacagagactttagatttgtttggtagacttttaatttctaaatttaactttagaagttaggtttaaagtggagttacaaaacagattaaacctagcttcatctctctagtttattttgtgagagctttccacacagctttatttttattttcggtggagctaaaactatttggttgggtttcagctgaagctaaaccggtgtgaaacatgctctttacaagtgcttcgaatcatcagggttgtgcggaggtgctcgattccgctttgcatgacacactgatgccatctccatccatggcctcctgcagaacgaaccgcacgcgcacggccggcaccctcatcttccggcccattttggcgtgttttccctttgcattctgagcgtttccttcgcctccccgtgcctctcaattcaaaacttcttttttatcgattgctcagattgattctgttccccaaagctagcgcttatcaaaatcgaatgggactgacaccatcatccacttgcccgtcacgtgaacgatctgaagtactactcatccatacacgctgatcgctaattaaacaggaccaaagcgagcactttttgccttaaaccccgtagaacacaccgccgtcacatgaacccaaccggacattgcctccaaacccctggaataataatacccgaccatacggctatcccgttctccacagtttagtttttgttaccacgttattcaaactgttaaacggtattgtcgatacgaaaacattttatatagaaacttttctaaatactaaatgaacttactttttaaatttaaaataaataaaacttaattaatcatgtgctaataactttttttttcattttaagtattactacgcacttaatttttgtccgctggattctcgaatgcggtcaaagtgcaacgacgacgtgaccacccgaggtcagatatttattagctgcagcgatcgaactcgccgtctcacctgcgacgcagtcaaatcgatcgccattgctgcagcttggcagcttctgtagatagatattacacgttgccaatgacgaagaagaagcttcaggtcgtcaggcccagagcggtgtcgccgctcccggcgctcgccgccgccgccgccgtcgccgtcgtcctcctcctcctcacggcggcgggacgcccttctttcctcggaagatacgaggctatcaccatcagcggcgtcgcgtcgctgccgttcggttactcctcggagagcgcgcggcgcgcaccaccggccgtcgccgtggcgcgggtgccgagcgactgcgacatcttccgcggcgagtgggtgcccgacgacggcggcggcgcggcgccgtactacacgaacgagagctgcccgttgat

SEQ ID NO: 33024 - DNA, 11590 bp, Oryza sativa
taaccaaaatattttggtactacatttttttttcttacatattttttcatcaggatcaatccgcgaaaagaaatgtaatcttttcgcacaaagtacaggattaattaatccgcgtaaattgtgatcttttgtatacaaagtacaggatgaatccgtgtacgaatggtgatattttgtacatagtacaggattaatgtgcgttaaaatttcgatccttttgcacaaagtacaggatgaatccgcttaaaattaaattgtgatgttttttttttttgaaggtggagtacccgaaggacgtgtcgaagacgacggatccggggttcaggacgatgcactacgggtcccacaacttcaccatcgccgtcttctggtcgccgtacctcgtgacggcgaaccagtcgtcggaccccgccgccggagggctgtgggacctctacctcgacgagccggacgccgcctgggcggtcgccgtggcgggcttcgactacgccgtcgtctccgcggcgaactggttcacccgcccgtccatgttccacgagcgcggccgcctcgtcggctgccactactgcctcgtcccgggcgtccccgacctcacgctccgctactccctccgcgccgcgttccgcaccgcgctgcgcgcgctcgccgccggcgccggcggcgccggcgtgttcaacggcacggcgatcgttcgcacgctgtcgccgacgtcgcacttcgagggcggggagtggaacaagggcggcgactgccggcgcacgcggccgtccacggcgaacgagacgcggatgtccgggctggacctcgacttccacacggcgcaggtggaggagttcaggagggcggccatggcgagcgggcggagcgcggcgaggctgctgctgatggacacgacggcggcgatggtgctccggccggacgggcacccgagcagatacgggcactgggcgcacgagaaggtgacgctgtacaacgactgcgtgcactggtgcctccctggacccatcgacgtgtggaacgagatgctgctccagatgctgctgctccatcaaccaggagctgtttctgtttgatctttgtagtttgttcttgactactacttgttgattggattaaagaataggttcagttcaccatttcgaccatcaattttacaagtgctcgagtgcacaatgtgtagaattccactctgatcacttatgtgcctaatgacgtatcaacaattgcagttttcaagctttaacaatcgagtaattagccaatcatctcagcttcatactgccgccgggctggataggtaaggttcacatttttagttttagcacaagtggatcaagttgggatatgtgcgcaatccgggaagtgggtttcttgtgtcatcatcaaaattctctgcatacggctttaacggggaaactgttttaaaccttaagggtgtgtttggataatgagttacgagaggtgggattggaaaatggaaatgaatggaggaacatgatgaaatggagtgagaagaatggatagctaaaattgaaacttatcctttcaaggatgggaaatcatatcccaaacctattatccaaacatggctcccatcatttgtctgcaaaccatttaaatagttatgaaaatagaaaaaaatggcaacattcatatatcatatatagcactgtacaaaagtttaggtccaaacttaactcatgcaatgagatataaaaaagataaattcggataggaatagtagtggtagtattcatatcctaatatgtcatttttgtttctcaatgtgtatatcaaatttgttaacttgatttttggtgcagtgctatatgttactatactctacattatcaaattttttataactatttacattgaatttggaagaaaagatacacgaggggacatcctcttgagggaccacccaaaaaaatactatcctaaatatcaattatctatgcagaagaaaatatatatccctccatgaaacataaaaggacaaattcgtcctacatacgcgtatacgaagatagcagaatagcaagtttaaccacgagtgaggatgcacttttttttttgtctgatctgttatttttatccctctacgtgtaaattaaatttggcgttttgtatttgtggagggacatgtaacacgacaagcaatattatcataaggttttcagaatttgttcgaactatttagaatgtttgcaacaacgagcacgcaagtttttcagaattttttttacttgaaatcatttcatgcatgaagatttaaaacattttttcttgaaaatggcctccccctaaccgaactggatagctacggagcacgccgataataacatttgggtttcatggcaagtggatgaaagtaggatatgatgcacaattcgcttcccagtcaccttccaaatactctggatattcatgacctaatgagcaattgtatgtgcagtgcaaggagctgagaactaactgcaacgcacaaatatatatacacctgaatggactctactattgcaagtgtttcacacacaattcttgagatagatatagattcttagtttcctcccagtgccaatgacgcctcttaataatctctgcaattttcgtgtcaagaagcagtactacaaccccaggtgcttgatccccgccgtctctctcctcctattcgtcgtcatcctcaccgtctctaatacatacttccccttcccgacaactaagtcgcgaacactgtcttactcttccttctcctcctcccccggtgggcagaaggccgccgacgaggcctgcaacatatttaggggagagtgggttccggatcctgatgcaccttactacaccaacaacacctgctcggtcatccacgagcactatgactgtatgaagtacggaaagccggaccttggcttcgtgcagtggcggtggcgtcccgacagttgtgatctcccccgtctcgacccggcgcgcttcctctcctccatgagggggaagaccttggccttcattggggattcccttgccaggaaccacatgaactccctcatctgtctactgaccagggtaaaaaagtgaaaaacgtgccggatttgctacagtactagcttcgatctgacccgtcgatcgcttgatcggacggtcagaaatgggccagcagcaacaagggtgtgacgttttgttggccggcctgcaggtcgccgagccgacgacgagctggccgagcagcgagcacacggtgtaccactacggcggcggctacaacttcaccgtcctcagcttctgggcgccgttcctggtccagaacgagctcgtcgacgccgacgggccggcgcacacgggcctgtggaacctctacctcgacgagcccgacgcagtgtgggcgccgcacgtcccggcgttcgactacgccgtcgtgtcggcgtcgagctggttctaccggccgtcgatgctgtacgaggccggccggctcgtgggctgccaccactgcctcctccccaacgtcaccgacctcacgctgcggtacgcgctccgcatggccacccgcgccgcgctccgcgccgtggtgggcggcggcggcggcggcggcgtgaccgccgtgcttcggaccgtgtcgccgtcgcagtacgagggcggggagtggaacaaggacgggaactgcgtccggacgcggccgtaccggcgcggcgagaagacgctgcagggcgtcgagctcgacttccacacgctgcaggttaatttcttgatttttctccattgatctagtgatcaattatcttgttctttctagggaacgtgtgttctgagcttcgtaggtggaggagttcgaggcggcgaagagggcggcgagcggcggtggggcgaggatgatgctgatggacacgacggaggcgatgatactgcgggcggacgcgcacccgagcaggtacaggggatggacgcgtcgcaagggatggatgaaggagtacttcaccatctccaacgactgcgtgcactggtgcgtccccggcgccgtcgacgcctggaacgacatgctctcacacatgttgctcacatcgcaaagctagttagttaggttattgatcaaacgaacgtagcagccgaaaaaaacagagaaaaatacattcactcctgaattcagtctagaatttcaaaaccaccgtccatgatccatgtgaatttctagcaaattgcacgagctgaactcaaacattttggtcctgtttgctgcattcgcaaagggttattgtgattccgtctgtatggacctaaatcgacctgaggcccaatattgcgaaaaatttcagaacaaacatcgtaatcgatttgagatactatattgatattttgtgacaaatctggaagaattaggaataatctagccgattcaaaagcagtggttgaactcaagttggctgatctcgacatgcagtcaaaagattatcagacagaaagggaaagctgctgctaggctagctcatacaggtggccagtgcccctggtctcaaaccaccacacctgtttagcacttcgattctttccatttcgccaagacctagtaataaacaggtggttatctcaaactacacgcgtggaatccaccatcccaagtgtacgctgaatgctaatttatcacgtaatctaatgaatattcgtgacaaaaactgcagaaaaaattcgatgtatatacagcaatctcatctcatttcatatccatgagctaagctaagctgtagtgtggacgttgaccaaccaggtcgatgatgaagtttcacgaggtgatcaagctgccatccattgctcattacggcctacgctatgtgcttcccgccgccgccgtcgccgcgtgcgttctggtgctcgccaccgtcagcctacccggccgcgtgccgctgccgctgctgctggcgccggaggtgatgacgaagacggcggatggcgtcggcggcgacacgtctggctgtgacatcttcaagggcgagtgggtgccggacatggccggcgagccgccgccgtacaccagcgagagctgtccggtgatccatggacactatgattgcatgcggtacggacggccggatcttgggtacgtccggtggcggtggcggccggacggcgggtgcgagctgctgcggttcgacgcggcgaggtttctcgccgcgatgaggggcaggtcggtggcgttcgtcggggactcgctggcgaggaaccagagcactcgctggtgtgcctcctgtcgcacgccgagcggccggcgccgtggacgaacggcagctacgcgtaccgcttcgagcggcacggcctcaccgtcacggcgttctggtcgccgttcctcgtccgcgccgtcgagacggaccccgacggcccgacggggagcggctccggcctgtggagcctccacctcgacgagcccgacgccgggtgggcggcgcacgtcggcgcgttcgactacgtcgtcgtctccgccgggagctggttctaccggccgtcgatgttctacgaccgccgcggccgcctcgtcgggtgcaacacctgcctgtccccgaacgtcaccgacctcaccctccgttactccctccggatggcgttccggagcgcgctccgggcggcggcgacgggctcgcaccgccacgccacgaggaggacggtgatcgtgcggacgatctcgccgtcgcactacgagaacgggacgtggaacggggacggggactgcctccggactcggccggcgcggcgcggcgagtgggagttgaacgccatggagaaggacatgcaccggatacaggtcgaggagttcgcggcggcggcggaggagacggcggggaagagggggaaagaggcggcgaggatgctgctgatggacgcgacggaggccatggcgcagcggccggacggccacccgagcaagtacaggctgtggcagccggacaagttcaaggtgtcgcgggactgcgtgcactggtgccttcccggcgccatggacgcctgcaacgacatgctgttccacatgctcatcgggtgatggctgatgcccgttcttctcattatggctcgtcgatttttttttctttaaaaaaatacatcagcattgtttagatagcttgggagcctgctattgatgggatgtctgatttttttcaaatcattggaaagtattgcaccgtgttattgatgttcacatgtttcacccttcgataaaaattgttgcaacaaaagtgttctagatgtttcacaataagagaaatgtttccgcactagagcatagttgtttcaactaaatacactactaaaacatatcgattgcaacaccaagaaatcaatgtatacaatattgaatcaaaacgaaataaaacaccttaatacaatcaagtaaaaaaaatacaaataaaccgtaacatcactttaattcacaataaaacccactcctctgacttctattccggccaccgaaaccaagcagctggcatgaggagacaagtgacatgatgcgtagacgaggatgagggcaagcaacgacttcaggtgagcgaccccaccagggctagctgcatcggcatccagtccagcgcctccttcttcgcatggcactgcttcgccacgggtagagggctagcacctcttccggtcctcgctttcgcctcagcatgccacgccaccgccagcgtggtcaccggcgccgtccttcctcttcgcatcgcgctgccccgtcgccacccgcgtggccaccggtgacctcctcccacttaatgtctcggtgggtgcggcgacgatggtgatgtcatcatgtgtttcctatgagcacaaaaacaatgaggagaaaatgagacgataaggttgtggtggattcaatcaactgcggtccccaccttatttgaccgtccgatgtttggtctcgcatcgaacgctctgggatcagcatttctggataacttgctctaaattatttgttagcttgaattcattcctataagcaagtgtctttactctgtccaatcatccatttcatacttgttgatggttagaaggtttgctgttagaaaatatcaatgcctacttctaatttaattgcaaataagttagcaattatgctttataacgatggcagatcgaaagatttatccttttagtggccgaggtgcatccttcgaaacaactagcgtacacctaagccctccctgaaaataggttttggttttgtaaggcattttctcccaactaatcggcgaccttgtcgagactaagaggcacttggcacttgagatccatcatcaaattgcagtaattattcccgcataaaaatgctatgttctgagcttggctaagcataaacctaaaatatctactaagcactagatatataactttcactagctgattttgtttacctagggttgtcaaggataaacatggatataaataataagaccataaatgtaggaatgactaataaaacagttaaatgcgtcgggaatttaattaagccgtgcaataatttaaaccatgacagttttcacatactgggatttaatattctcaaggaaagcagtatggtttgccttgctcaacaagaaggtatttctgatgtcttgatatgcactttcaggatcctttgaaactataggaactacacgagacacacaaaatgtggctaaaggtgtatccaagaagcaagattagtctataaaaatacaaatgggttcttcacgatttaaccaaaatattagtgacttgaacgggctgattcagagttcagataggtaacttgaactggatgtatattggttcctctcctttcatcattaattagcatatagtagatatgtacaaggaactattcatttatctgttttcttgattctttagggtagtgctatgggagaatgtagtaccttctagccggggcaggcgtgcaacctgatgtgcccatctcatttattcactgtctactattgctcttgttcagagtaccatacttcgagtttcctcactccaattgattatatatgaaaaatacaatggtagggttaaagatggtagcaaaatgaacatgccttgagtctcttgaataaataacttactattgatcaatgagtgacattcgtgcaactaaggctgtcaacgagctgagctcgagcgaatttggctacgtaggcttgagcttgacatgaactcgagccgagctcgagccaagcctggatactgatcgagcttgggagtgagctcgagttcgagctcgagcgagcttcgagcctactcgagcttgacagcttgtcttggtgaaactccaaaaaacttacacttgtataagagatattaatgcaaattatcggtagtcaaaattaatgggtgctacttatcttgaataaagcctctgcagcttttctcatgaattcatggctttaaaacgttgcaattaacaaaagctagctactacatctaataggaatagtagtactattactagcagccggataattgctttattgagaagcatcgatgaggtcttgagacttgagtaggtcaagcacgatgacaagtatacatggacccatcaagaatatcttcctacatgcaatacatcttatgctaatcaagccttgccgagctattcgagctcgagcttgctaggcttgcgagcctcagcctaggcttgagcttggcttgtctagtatttgagccgagctcgaatcaagcctgtaacgaatcaagctcgagcagcttgcgagcttcgagcttttttgatagccctacttgcaactattcgtgagacaacagacaatgtgttttatacagtttatgccccttagatgggtaatgactatatgtcctatttggccggagtcaagtgtttttcactatatcaattacatgagtacaaggtatgcaatggaaccctaatctagcctatgactatatcggcgagaatgatggtggtggtcggcaactagttgttgtcgagtttccattaatgtttactatggtggtggtggaattgccacacctactagttatgtgtagactagcgatatagtcagatcctagctataatgttgatgatagaaccaccacgtctactggtttatgtagacgatgaacatagtcgtaccctgaccactgttttgttgtttaggctgaaagttttatatgcatcccattgtttatccaacccttaaatcattatggaggtgtatcggtctatggtttgtttcaagcttttttttttctccaaaacatctttccaaccagactgcttgtaatgcacgtatatctctatgtttgttcaacggtatgcttggtattgtcgctatttgagatctctgcctatgtcatcatggtagatgttacaggcagtgcatcgggttctccgcttgatagcgaatcacctccttcgtccttgtcctgattcccgagtcgcttgaggccattcacaatgcgtcatgggccacgaacgaatttgtgatgccacataggaccaagctcctctaaagcaactcacctcacaatgcaactcccactcccacccacttttcatgggtcccactcccacacacttttcatctccccccctctctctctctccactatctcccccaccggcggaggatgggaggagcacccgaggctcacgtgctcgccgccgccgccgccgccgccgccgccgcgccccacctcttcgtccgccggtgcccctctccctccctccttccgcagagctcgcatgcgtggagcgggacggcacggagctcactagctccggcggtgcggagctcacggagctcaccggcgtggatctggcggagctcaccggggtggagcgggacggcgggagctcgtcctctccggcggcgcagagctcacggagctcaccggcgtggagctcggcggcgcggacggcgacgaggtcggcggcgtggagaggaggatggtgacgagcttggcggcgcggcgaggaggatggcgtcggcgccagcggagcggcggcggagcagcccagtccggcgctcgccgggtctagcctcgggcggcggctacggctcgtcgcatctcccctctcctcagctcgtcggcgctcgccgttaatggctacggctcgcagttttctgctctctcccctcttccctgtcactggcgccagctttttcaggcttttagtgggaagaatgggtgaccaaaacttgctacgcgttcctcgtgaggctccgagtgtaatcgacgaggcatagaatatgccgttcctcaagccgaggctgaacgccacggaggcgcattgtgaatgccctgatagccgccttcaccaatcgctgtgtcgcacaagggcccaaaacccacagggctagctgcagcctactcaggccagttaagcaagcataaattggtccgcatcttgcttgtgtaagctgtccttcggcccaatggacaagtaattagtaggattttttagcctcgtcttccaaaatttcatgttgatatggtgatttggactcgaatgataggagtgctggtatcacgggtaaataattgcgaccagggtcttgataatgctggctgctattgtgctcattttgtcacgagcgaggttaactagcttacgttattcttgatcccttcctaaattatctggcgatatattgtgcgcactgactgatcgatcatctctacacactaccacaaaaatacacaaaagtgatggagaaatactaaaaccggcacctacaaacccctgtccgcggcacgtgtctagtgcctacggggcgtcatccggtagaaccgacacctttaatacaatctggtacctatgacttctgtcagagagaaatgtgttgatttctattgaaaactagcacctttgagtacgtacgagtgccgatttttgaaaaaaaaccgatacttgattaaaccgaggcgacgggcgtggagcatgagaaagaaaacaaatttacgctcttatccccttgcgtgcctcatcttccttatcctcttgcatgcatcgctcttctcctctcgcaaaccgcgcctctcccctacgcagcggtgcggcggtgccagcggccagctcctctccctctccccctgcgtcggcgggaggttgacaccgtggcgacgaggaggtccggctcatccttccatctctcccgtcccgtatatacagcgatctcccgtatcaaatgaatattcgtgacaaaaaaactgcagaaaaaaattcgacgtatatacagcgatctcctgatcctccatgagcttagctatagtgtggacgtacgttgaccacccacatcgacgatgaagtttcacgaggcgatcaagctgccatccattgctcattacgccctacgctatgtgcttcccgccgccgccgtcgccgcgtgcgttctggtgctcgccgccgtcagcctacccggccgcgtgccgctgccgctgctgctgatgacgaacacggcggatggcgtgggcggcgacacgtctggttgtgacatcttcaagggcgagtgggtgccggacatggcccgcgagccgccgccgtacaccggcgagagctgtccggtgatccatgggcattatgattgcatgcggtacggacggccggatcttg

SEQ ID NO: 33025 - DNA, 10005 bp, Oryza sativa
tcgtgcggacgatctcgccgtcgcactacgagaacgggacgtggaacggggacggggactgcatccggaagcggccggcgcggcgcggcgaggggagctgaacgccatggagaaggacatgcaccggatacaggtggaggagttcgcggcggcggcggcggcggagggggagacggcgaggaagagggggaaagaggcggcgaggatgctgctgatggacgcgacggaggccatggcgcagcggccggacgcccacccgagcaagcacaggctgtggcagccggacaagttcaaggtgtcgcgcgattgcgtgcactggtgccttcccggcgccatggacgcctgcaacgacatgctgttccacatgctgatcgggtgatgggtgatgcccgttcttctcatcatggctggtcgatgattatgtgcggtttattcgcgccacgattttaaatgtacgattcgtttttttttttaaaaatacataagcattgtttagataacttgggagcctgctatggatcgaacatctgatttttttttcaaatcgtcggacggtgttgcaccgtgttattgaaaaatgtttcacccctcaataaaaattgtttcaataaaaatattccagatgtttcacaataagagaaaaatgttttcgtcgcttgagcataattgtttcaactaaatacaccattcaaacatatcgattgcaacatcaagaaatcaatgtatgcaacattgaatcaaaacagaatggaacatcttaacacaataaagtgcaacaaaaaatacaaataaattgcaacatcactaaaattcgcaacaaaacccacctctgacttcttctgttccgttcaccggaaccaagcgaccggcatggggagagaagcgagatgatggcacagacgaggatgagggcaagcaacgattttaggtgggtgaccccgccagggccagcggcatcgacatccagtctagtgcctccttctttgcgttgcattgctccgttgctggtagagggctagcacctcgaccagtcatccctttcgcctcggcatgccatgccgctgccagcgtggtcgttggcgtcctcctccctttttgcgtcgtgttgccctgtcgccacccgcgtggccgcccatggcctcctcccacttcacgtctcggtggacgcaacgacgatggcagtgccatcgtgtgttccctatgagcgcaaaaacgatgaggagaaaatgagagggtaaggttgtgggaaggatggattgaatcaactgtggaacccatcttatatgaccgtccgacgtttggtctgacatcgaacgctcggggatcagcctatttatggatatcttgctctaaattatttgttagctttaattcattcctataagcaagtgtctttactctgtccaatcatccatttcatacttgttgatagttagaagatttgatgttagaaaatatcaatgcctacttctaatttaattgcaaataagttaacggttatgcttcgtaacaaaggccgaaagatttatccttatagtggccaaggtgcatccttcgaaacaactagtcgtgcacctaagccctacctggaaataggttttggttttgtaaagcattttctccccaccaatcggtgaccctattgagactcgaaggcacttggcactttagatccatcatcagatttcagtaattattcccacataaaaatgctatgttctgagcatggctaagcataaacctaaaagttctactaagcacaagatatataatattcactagctgattttgtttacctagggttgtcaaggataaacatgatataataactaactagcatggtggcccgcgcagattacgcggctagcatgattatattttctctcatataatagtacatatgttttcttattatattattcaaatatattaaaacgacaacataattttaaattttacaataactttacaaaactactaatgtgtaatattcatattgtattttatatacgtgttagttattaattatttttaatatcaaattttagttatttgtaaattatatatattcctacatggactctagattcgtcttttaatatttctttttttaattccgaattttctgtaaattgtatttctatatagactctatgctcttcttccaatattatttatttttatttctgaatttttattatttctaattgtatttctatgtggactctaaactcatctttcaatattctttaatttttaatttcgaattttagttacttctaaattgtattcctatattgactttaaactcttctttccatgtttttcttaatttcaaattttagttatttgtaaattgtatttttatacggactctaaactgtacttttaattttattatgtttattctaaattttagttagttttaaattcctatatggactctatactctacttataatattccttattttttaattccgaatttctattttttattaattgtatttctatatggactctatactctacttctaatattccttatttttaattccaaatttctattatttcctaattgtatttctatatggactctatactctacttctaatattctttatttttaattccgaatttcagttattttctaattgtatttctatatagactctatactctacttctaatattccttatttttaatttcgaatttaagttatttcctaattgtatttctatatggactctatactctacttctaatattccttatttttaatttctatatggactctatactctacttctaatattccttatttttaattccgaatttcaattattttctaattgtatttctatatggactctagtctcctcttctaatatccttattttttaattccgaatttcaacaattgtatttctatatggactctgctttttctttttctccgattaatgtaagaatttctaggctatgagagcgaacgtggaggctcctttttttattcctttaataatataatagataaggccataaatatacgaatgactactaaaacagttatgtgcgtcagcattttgataaacctgtgcaataatttaaaccaagataattttcacatactaggattcaatattctcaaggaaagcggtatggtttgccttgctcaacaacaaggtcttccgatgacttgatctgcacttcaggatcctttgaaacgatagtaactacacgagacacacaaaatgaggctaaatttgtatttcaagaagcaagattagtatataaaaatacaaatgggttcttcacgatttaaccaaaatattagcgacttgaacgggtcgattcagagttaagatagataacttgaacttgatgtatattggctcctgtcctttcatccttaattgatatgtacaagaaactagagatttatctgttttcttgattctttaggatagtgctatgggacaatgtagtacctcttagccgtggcaggcgtgcaacgtgatttgcccatctcatttattcactgtctactattactcctcatctgagtacaatacttcaagtttcctcactccaattgattgtagatcaggaatgcaatggtagggttgaaggtggtagcaaagtgaacatgcccaaagagtatcttgaatagataacttattattgatcaatgagtgacattcatgcgactcttcacgagacaacattcaatgtgttttatacagtttaggccccttagatgggtaatgatcgtatgtcctgtctagttggaggccagtgtttttcactatatcaattacatgagtataaggtatgcgatagaaccctaatctagcctatgattatattggcgagagtgatggtggtggtcggcagctagttgttgtcatgtttccattaatgtcgacttgataagattggggatggattgtattggcgtgtggcagatttgcttggtgacaaattgtgtttccatgagttgagatctccactaggggatgttgtatttatacccttggatatcaccttgtctaagtagaactttggggtaagttaggatacgatctgagcagtcattgtccccatgtaggactatgtcttccttttatagtcggggctctttccttatctactaaagactttatctttatttgggggttttaatttcttataggaattagcatgtggtcctttgctgccgtgtatgtggcacatttgtagggtatcccatacttatttccttggtagtagaccctcaactctattgaaatgcaaatgttgacaattgagttcagctgttccgaggaaacgctgcatcagataagtaatcgaggtcaggcgatactgactatgttgtgcccgagttcgatgctctggtccgggtaactagtagtagtcagatgatggcatttggatcggataagaaatttgtctgtgtacatatgtgcgaaagatctcggtggggaaaccattttttgtttactcttacattggatttatgtagttaatcgatgtcccaagattttgattttttatgaagtcaactcctcggaaaaagtgttagataacaagcactagagggaatgctcgggagaaatatatataaataaactgaaattttgataagttttctagtctataagtagagtttatgtaatttccgtagccctcaactgttttatcataaacatagttaacgagtagatagtcttaatagaaaaaagatgtaaaaattattaatattttttactgtttgatgtcttctaccataatctcgatgacactagcagcagctcctttgtcccgagttcaattttgttgtggtaggaatgctacactcttgaaccccaatcacaattggcaaaatttgctatagggcatcgaaaaaacgtgtaattagctcgtggacaccgcaagaacgagaatttgctaacgggcattacaaaaaacgtgtaattagctcctggacactcggggccttattttattatttcccgtgaatttggagagagaaacactaaataaagacaagtttgcccttgggtctcgacctagatagcgacaaagcattggattggccggcggcggcgacagagccgaacacgtgcagcgcttgtgttctgtccctgtgacgggtccgagtggcggcgaccatcgtcgggatgctccgcgctgtggccggcgtgcgtgggctcgtcgccgccgatgacccctttagcgtggagctaacggacgtgttgactgacgacaccgacgccgacgacaatgcgcttgtgttctgtccctgtgatgggtccgagcggtggcggccatcgctgggatgctccgcgctgtggccggcgtgcgtgggctcgccgccgacgacccctttggcgtggagctaatgcacgtgttgattgacgacactgacatcgacgacaatgcccggcgaccggagaacacggtgcccggcgcgtgggcgacggtggagagttgtgatgtcgcggagctgctcctcgccagcctcgatgccggtgtcccgttctcctgtcgtgtcaatggcagctgcttcgcaattgcaagggagaggatcaaacaacaatttacatatagagatggagagatcacaaaaaaaaaaggaggggaaattttgatcgggagggagagagcacatgcacatactcgtgaattccctttcgcatatggcgctgagctagctctttccagctggtgggcggcgtgacggcgtggcggtgctcgtcgccagcgactagagtgcttctcggttcccgtcgacaagagcatgcctcctcctcggccgcggccacgggccggagcagctccacctgcatcagcccgcggcggccaccggcggagctcgtcggcttcacggacttccacgcgcggtcgatgcgcagcatcttgagctccacggcctcctccttcctgtcgtccttgtcgctgtcgtcttcctcgtcttccagcgcggcggcgcagatggggggaaggcagcggtgcgcgcgtgcgtcggtttccgccggcggcggcggcggcctgcgcaccattggctggcggcggtggcgcggatgtgcatgcgatgtcatgcgttggcggcctgcgtggtcgcggcagcgggcggcgcagagcgggctcgcctttctccccctctgcccaacgcgctcgtcgcgcccgccgccgcgcggaggaggtggcagcggtgctctggccggtgtgagggcaggggcaaaatcgtactctcaccagtgtttctctctccaagttcacaggaaatattaaaataaggccccgagtgtccaggagctaattacacgttttttgtgatgtccgatagcaaattctcgttcttgcggtgtccacgagctaattacacgttttttcgatgccctatagcaaattttgcatcacaattttgttgtggtggaatcgccatgtctactggtcccgcacaggatccaaccacaatgttgatggtagaattgttgtgtctatcaattatgcacacacctgtggtgtagtcagactccaaccactacggtggtggtggaattgccacacctattaactatgcatagttagatctgactataatattggtgatagaatcgtcacgtctactggttctgcgtagatcaacaacgtagtcgtactctgaccactatttgtccaacccttaagcattatggaggtctatcagtctatgatttgtttcaggcctttttttttcctccaaattataaaacatctttccaacaatccaactagactgcttgttttgcatatatatctatatggttgttcaatggtacgtttggtattgtcgttacttgaggcctctgcctatatcatcatggtagatgttagacaaaattgctataggacatctaaaatttgggtaattggttgtgggacaccgtaaaatcgtgtgactgctaaagcacaccacaaaaacagtgtaattggctacaggacaccgaacacattattttataattttcaagacaaagtgaagagaggaatttttaaaaagacaagtttaccccttcttactctttctcccctggctatgaggaggcggcggtggctttgacaatggcgagtggcagtgcaagcaggcagcggcccgctgtgattgatgggtggcccactcagggggacgtccgccacctgagcaacgccggcctggtgctgggcctatccctcggcagcggccgaggaggaagaacgaccaacgcgacggcacaccgaggtggctgctggtggccgtatcgctaccgctggagtcatcgctgatcctgatcatgctcggcgatgcggcggacgcagctgcgacggcgaccgtagccctacgcatatgttaggaaccctcttctcccaattagtaacaacaagcttgaatacaactctcacaagtattttgggggaaaagagagaagcaaactagctagctgatacaagtgtctagaagtttctggaaaggagagagagaagctggaggtagaagaggatgggaagagatcgccaagattccagcccggaaccaggacgccgccgccgccgtggccgaagccgccaatgcctgatctgtttcgatgcctcgccatggttgttgctgctctgtatttgtatcctccctgtccaagcttccatgggccacaattgaatattagtgcaacatcagcccaagagcccatcaaggttgagaccctaacaatcccttctccttaaaattcaacttgtcctcaagttgatgccaattaaacttttgaaaacgtaaaccacctgggtcccatggcacctgtagcactcggatgatcaatgtgatcaggtcatccctatcaccattgcttttccttgtacgcacaatctttcgctgcagcttagtctctttgccttctccatagtactcatggtgtcccacaagccttgcaataatgatttgatggctcgagtaaaagtgttcttctatgctgaaatgaaattcttgattgcacttttctttattcctttcattttccatcggccaagaccattcttcagtataatagaccaataatatgtagctgaagcacataatagcactgaattctagatcccactgtatctgtagcattgaaattgattcacctttcaagagccctagtgtgcttgtatgtccttgtgcagatattctagcggcagcaataagtaaacaaggtggagccccattaaagtccagatgcacctccattttagcaatcaatgtccaacccaacagagctagtatgtgcagatattggaacaattttaataacttggaatgctcttgtttaatgaaggagagctcaactaaaacatcatgaatctttatattagtgcaggaattcctttgtggctggataactagagcagtctgaaataaatcagcatgcacacatgctaattcccttgagattttaatgtggaaaccaaaggttgtaggctcagatgctagtccagcatacttgtgctgttcaatctgaacacatgactgcaattgcttcagttcaacccagctctcatcaagtaagggtgcattttctggactccatgcctcaagaaaagaaccacattttagtggagcaaggacaaagatcatagagacaggctccaaatgacaaatgacccaacaagtgttcaacctcaatttaaatgagcattttactcctggaaaccaaaccatatgaattccttgtccatcaatttgctcttgcatgacagaaattccaatgtcaaacccccttccatgtttcactaactccttcaaattcccagcaaataatcttactacagtaccaatgtcaagattatacctatcaacatcatcaatagtagtgaataggaatgaacctttctcaaaattctgtggacccaaacaagttggttgatctttagatggctccaggatgtagttccccttcccaattagtcgagcagatatatagcaatgtgaatacaattcacaccagaatctcatttcttcactatatgatacccccttgttctgatccacacatgcttccttcttagcaactgctatatagctgacccacacacacaactcttcaggaactccgacactgataacaagctcaatgttccagcaattatctcccaggtgaaagtattggcattgaagccaatcattcaacaaaatcttgtgtaggtgaactttgctatcaccaggatcccacactaatggcaccaacatgatatgtaagtgtttcagtggttcccctagtggaaaatgcttgtcaatcaggattccaaaccacctgctcgaatctgatgcgttaaagtttggaggtggccatggattgacatcaaagtgcttgtgcggaccatgccatttcactgaacatcttgcgggtgtcaatgtggccagcttgcggttggcattcatccttgatgagaagttgtccatagactggacatatgctggaactaccttggacgcagccgtcatggcctggaacatgacctcagcttggtcatggatgccacccttgacgtcgaggctcaatgtcaaacacttgatgtgtgtctccttgggacaaacaagggcgtcgatgtcggtggtgcatgtgatgtcctgacaaatggaggccagagaagtggacgtgcacgaaaccatcgcagccacggtgaggttaggggtggaacaattcatcgaacacttggcgggcatcaccttgggatggttgtgattgttggtgtaggttgcgccgatggcatcttcaacagctaccagctccatagaggtcgtgtcaggtgtggcgcgtgtaaccaccacaaccacagggggatcaggctcgacgtcggtgctagtgcatttcgtcaaacatgtggtgggcgtcaccttggattgcatgtccccaaccgaaatttgcaaatcttcagcagtcttctggatttcaagcatccacgattctaccgccgccttgagagactggaaatcagctctcctt

SEQ ID NO: 33026 - DNA, 2626 bp, Oryza sativa
ttgttaggaaccctcttctcccaattagtaacaacaagcttgaatacaactctcacaagtattttgggggaaaagagagaagcaaactagctagctgatacaagtgtctagaagtttctggaaaggagagagagaagctggaggtagaagaggatgggaagagatcgccaagattccagcccggaaccaggacgccgccgccgccgtggccgaagccgccaatgcctgatctgtttcgatgcctcgccatggttgttgctgctctgtatttgtatcctccctgtccaagcttccatgggccacaattgaatattagtgcaacatcagcccaagagcccatcaaggttaagaccctaacagcatagcatatcattgctgtccgtcgacgtggcggtgaagaaagagtgcgtggaggagatcgatcgacggtgagagggtgtcatcggcgggcggtcgggcgagcaggacgacaacgactgcggcagcatccgcaagaaagctcctgtattgatttgtatttgttcatcgatccgcacagcacggtcaacctggtacatgatcagtacatcacgtatgtctacatgttcttgttacattgtattgttttgtatttgttcatcttttgtcgattgaatacatgcgagtcactaaaccagcgctttgcttcttcgagcagaagcaaaaagtccctttagcaaaccaactgaagctcaggacgaggcaggggcaaactttttttttaaaaaaaattctctcttaacttttttcttgaaaattataaaataatatctctaatgtcctatagccaattacactctttttatagtgtctcggggcaatgacacaatcttatggtgtcccccagccaattacacaaaatttggatgttttatagcaaatttcgcctactccatccgtctcaaaatataagcatttttaacatagtatcaagtgaaatatttataactttgactattaatagcaaaaaaataaaaaaaacaatcatgtaaaattgatattactagatttatccttgaacaaactatcacaatatgtaactccttttatttaaaacattttacttttatagatatcattggtcaaggtagcatctcgatgactgtgtcagagtctaaaaatgcttatattttggaacggagggagtagatgttacaagcagtgtctcgggttctcctctttgtccttgtccttcaccaatgcctgtgccgcacaagggcccgaaacccacagggctagctgcagcctacgcaggccagttaaacagcataatttggtcggcatattgcttgtgtaagctgtcctttggcccaatggacaaataattgggacttttaagccttgtcctacaaaataggcaaattttgctacagaacatcgcaattgtgtgtatttagctcagggacactgtgaaagtgaacatttggaggaagacattccataatcgtggatatttacccatggacaccgcgtcgtctcctctccacttgacgtgctgacgtggcagatgggaggctgttttttggcccggtcggacacaaatacccctcagccttatctcctcatatccactcggtttggcaagcagtaccggcgaatctggcattgtagctggagggcggcggggatcgtcgttgtcggcgaggagctgaagtcggcgtggttcctatgccgtgattcaccgtgcagacgtggtgaggagggagctcgttggcggcgatgatatcttccgcttcttcattctcacgtgcttcttcctcttgggttcgccgtgattcacaggttagtgagttgcctcttgtgaaatgtcctttctgcaagggcgatttgacggtagtggagcggacatgcaagaaggaagagaacttcaaccgcaagttctatcgatgccttacagggcagtatgttagttgttctttgcaatccccaatttttctagggtttgagttgaattcgagtttgatttgataagctgtgtgttattgttgtaatttcagacaagtgcgcaatgcaagtttttcatgtggcaaggggattatgctgtttggttggtgaaggaaggtttccttcatggatggacagaatgcagtgcgcagaggacagaaggtgatgccccagaattagtgaatgcttcattgaaaggagtacatgatggaattgagatgttaagatgtgagattaaggaggcaatgagtagaatttgtatgtttgggattgtagttgtgactgcttttgttatgtatgttggcatgaatgtaatgaagtagaacaatgtgatgcagtaatgagatgaattgtgatgaatcaaaatttgtgcacttaaatatttgcaaggaaatatttgtgtttgcccaaaattgagatgaattgtaatgctggaaatatgtgtgtttgcccaaaattgagatgaattgcattgcaggaaatatttgtgttaacatttcagaatcatatggcatgaagtagcaatagaggaatggcatagataggacttgcattgcatttcagaaccatttcagcagtaggactttcatacatagaggaagtcttgtcttgcaacagaggaatagatacctaaagtcatggcttgcaaaatatacatcagtta

SEQ ID NO: 33027 - DNA, 2064 bp, Oryza sativa
aattcctgcagccccttggtactgagatatgcctacttcagctgaaatttcaacaaaataacctactctaatagaattggattacagcttccttgcaatcctggtgactatagccttccttttgttcgctttcaatggacttgcatgtgctagggatgcaacactcctgctccttgtaactggtccagggctgccatccacctgcattgcaacttgtgcaggggcttgatcaccagctgcagcaggggcttcatcaccagcagcagcaggggcttgatctatcacagcagtaggggcttgatcattagcagcagcagtaggaggcctatgaaagagatattgaacaaatcagaaaatgctaatggcaactgaaaacttgatgaaaacaggaaaaatacttacatagtgctgttaccaccagtaggcacatgttcaggcttggttttcttctttctaattcttttaggcttgggtggggcagggggaggggcatctggatcatacacatgtttattgcaagtcttggataggtggccaaagccattccacctctcgcatttccttctcttctttcttgaaccaccttcttcaactccaatgaacctccttgttctaggtcttccagctgatctcttcagtattggtggccatatcttgaatccagcgtctactttctcccataggctcttgtctggcattggaggcacaattgtggcataggcagccctaaacatggccactgaatagtaggggctgacatagtcttccagctccacttctcttagggatccaataaaagaaatggcatgcctacatgggaggcttgttagctgccattgcttgcagctacactcttgtttggtcaagtccgctgtgtgtctccatgttgtcaaatccctgtttgcaccactgacttcacctacaaatggcagactcttgtggtgattgtaattgagatttctatttttgtcatggagttgcttcattacatttcccgccttgaagcttgagagatagtttgtgccttgtacacatcctctccatgatcatctgcctaatcttgtctagtagctcaaccacaggtagtgacttctctagcctaatccagctgctaaatgtctctgcaatgttgtttgtcacatagtcacacttagatgaggtggagaagctagaccttgcccacaaatgctggtgattctcttcaatccattgcattgatcttggggaagcctccttcatgatattaaaatacctgtcaaaaacatctttcctatatgctctactagcaggccataggtttctttcaaatacatctctatggaaccttttctgaaaattcttgtacaaatgcctcatgcactctctatgctcaactccattattgagcacccttgtcactgcagcatctatacccttgcctgcatcagtagacagtagtaggccttctggagatccaattgccttattcagacaaaccatgaaccattcccagttttcctttgtttcagatccaaacacagcatatgccacagggaacatccaattgtggccatctataccaatagttgaagccaaatgtcctctccacttgcctgtcaacactgttgaatcaatgcctaaatatagcctgcacccatacaaaaatccatctatacaaggcttcaaagcaacaaacatcctactgaacctatgcttctcattaatcacatcatactctatctccactatactaccaggagatctcttctcaatctctgctttaaaattgtacactgcctcaaagctttgctcccagccaccaagtatcacatctaaagccatatgcctaccatcccatactacatagtatgacagcttgattaaatacttctctaaagtcttcttcagaagcagcagcccctatggttggatcttctcccagcttgttgataaccctgtccttaacccaagaattgctggccatgcaattattctccaatttgcctgtgctagcacaactatgctcatatggcatcttctttatctacaacaaaaaatggacaataaacatccaaaccattattc

SEQ ID NO: 33028 - DNA, 12714 bp, Oryza sativa
  unsure (1)..(12714): unsure at all n locations
tgacaccagctcattgtaattctccctctcatcactaactcctatatactcaacctcatcaaactcaccccatggatctggatttggcactaattgatcagtagctttgtccctggacttgctactttttttggttggaacctttttttaggtagcatctcaggtaggaacattctcagcctgacttgcttgtgtgggtaaaaccatactcagtgaaaccaccgtgtcaacttcatccacacaagacacaatttgggtacaaggaggctcactcactgtcacttgcaatgaaagcttcctaccatcccagtattggttaaatgcctctaataacatagcatcagaataaatttctacatccctacccactctcttgtcccagaaagtcacagtaagctcctgcgcactaccacggatgatttcatcatccaagtccttcatcaaatctatcaagcatacggtgtctttatctacaacccacttatgcgaagttgaaacatggtaatcttggctaccgttatccatatactcaacataagcaacaaccctaaccacaactttgcatgcagagttcggatccatcctacaatgcgatggcaaatgaggagaaaaatgggatccaaaattagatccaccaaaccatgcatcccaaaccaatcaaaaggggaaaaacaaatcaaagagtggcggaaaaattcttaccctttcggtaaccattttggcgtcggcggcgctgaagctagtgcagattccaccacctcctgcgacagtgaagccatctccgctcgtcaaacttgcatcccaccggcgagaatgcctgggcacagccagtatcgagggtggcggaatgagtgagtgctgtttcgatggagctagggttctatcgccggtactgcttgcgaatggagccaaaccgagtggatatgaggagataaggccgaggggtatttgcgtccgaccgggccagaaaacagcctcccgtctgccacgtcagcacgtcaagttgagaggagacggcgcggtgtccgtgggcaaatatccatgattatgggatgtcttcccccaaatgttcactttcgcggtgtccctgagctaaatacacacaattgcgatgtcctgtagcaaaatttgcctataaaatatcgatctggtgattttggactcaaaccgatacgagtgatggtatcacaaataaataattgcaaccagggtcttgataatgctggctgctattgtgctcattttgtaacaagcaagtgtgggcccccggttttgtacaccagaaaccccatgtattttacaatatcactccctagatcagtaggtggtacacacatgacacagtcgaatatcacaagctggcatcgttagtactatattaataatacaagggtagcctaaatgggacccaaatagaccaaacatggtcatgtacattacaaaataccaaatgaagtagaagagacagcggaggcgaagcagtggcggtccatcatactccacaagcaacgaatggtgaaccaaggtcccaattccactgtcttcgacacattctcaacaacatagcacgcatacagtcgactccaactcctttcttaaaaaattaaattaagtaagggtgagtacaaacgtactcagtaagtcaccactacaaaatgcatttagtgcacacaggggttcaaggatggcttggtttatttgcataaagctagttttcacaattcatatcacaaacctatgacttagcatttttaactgaaaaaccacgttaaattgaagttgtcatttatcgagggttcatccaccttcccaagtctcgcttggttcggtttaccctcacattccattttataccactaccaaaataacctccctgcacatcggcaaggttacgcatgcctttacatctcgtagtctaagcaatattaaaatctatgagtctagtcaagagtagtacaagttccgacgctcattaaccgcgagcatggctattcgaatagatcggtttactcatactgcagtggatgtacgctttttaatcctgcaatccgtgacttgtccaacacatgagcctagtcccaacacatgagacttgtcacggcccggtttttcagtcattctcgcattgcggcacccactccaaggactatgagcccccattacacccaagcacaccaaccctacctcgagtcggaagtgaggggagtcctggcgctctcgggattaggagttatttaacatatatacacttatagggtgtattttaggttttagtcggcattatccaaacatcaacactgcaacaacaacaacaacaacaataacatactcgtacagaacctaccatgattggggtgccgccccatgagaatttcctagttcatcgggtctatacccacttgagaaatgcaatcgtactcggttcgtttcttgtatagcttcctgactcggtccttaactgaccagggtcggcgactaacagtttccagaaccacccatattctattcttgccaccctagtcgaaattattttgttttattaagttttggttttcacaaaaggtttttgagtgatcacacatccatacccatataacataagtatggagtgtacgatcgtctaaaatagcaatgctaagcaatgccaataattgactgtgtataaataaatagactcatgcaacaatggatgaatgcataaacataatgataacaagatcaaggaggggtttcattcaagtgtaggtacacagttttataaatagcatgcaattttatttgaagacaacacatttataaatataggttcgatatgctcgaggaagggagcgtagtgacttgccttgttttcagaaacctatgtcttcgaggaatccgtttcagttagatacccggaatgcccacgttcaaagaataaccaatatccaaaacgtccgacaaacgaccacagaagaaccacacacaatcctaaatataaaataaaagtaatattcagtacaaactaatggtgccagtaaatagatcttgattttagagagattatggaagttgaatggagtcattcggaggtatggttcgtaagatatggatttccaaagtttggaaggatttgtaaaccgtggaggtagcactcctcgggtggggagatgattcagacttccagagagggttttgggttgtagagggacacaagatggattttagtgagcaaggaggctgatgatggtctcagcccgaaggttagatgaaggacattatacagacttctatagaggaattaatctctggaataagtacatctgaggtcccttaattttacatcgaatctgattatcgtccttaaccccaaaaccagatacaaccggtcctcaaactgtcaaaaccggtgcaaacgaggtcccttagcagttttgaaggcggttttggctgacgtggcgcctacgtgactggtttgaccaggtctccgtcccacgtggcgatgacgtggcaattatatctcgaaaaaataataaaaaccatgggcccacatgtcagccacacaaaaaaaatttaaaaacggtggggcccacacgtcagctaaaaagatatggtggggcccacgtgggccccacatgtcatctccctctccccactcggctctccctcttcttcctcatcacgccgcagcatgctgacgacgacgacggcagccgaagcatcggcggagtggcggctgcggcaggccgcggcgaaggggcccacgaggagcggaggggcgggcggagcggcggaggcagcagggcgcgggcggcggaggtggccggaggaggagggagaggaggaggtcgccgccgagtttcgctgcctagaggacggcaacgaggtcggcctcttcgccgtgttcgacggccactccgacaccgacatcgccaccttcatccggccccacaagtcatctccctctccccacatgtcctcttgtgcggccgccgtcctccgcctccgccggccttcgccccaggccatgctgccaactacgacgacgccgcctcctctcgccctcccatggcgtcaccctccccttgtcgaactcgaactccgcgccgccacggccggctgtcccttctatctccatggagatggaggaggcggcgaggttgaggaggtcgccgcggggccaggcgaaccacggcgcggaggaggcggccacgcggccgacgctcgatccagcgaggctgtggccgtggcggcggtatggccgatgaaggcggaggcgccggtgggggatggtggcgctggtggcgagccggccccggaaggatggcgcgacgacgacggccgatgcggcggcggcgccggcgagcgtgaggaggccgcggggtcggcgtccaagaggcggcgcttcacgtggcgtggcggcgtcccagcgccgatgaagacggtgacggcaacaacttcgagggacggcggcggcggcctcggtggcgctcccgctaggcggaagcagaggcgaccgtgagaaggggaggtcggcgtggcggtgcgggtacccagcggcttggccacgctctgccgggcgccggccgtgagcgaggcagaagcagctgcagccgattcggctgtgcgcggaggcggcgcccgtgcagcggggaggcatttttgcttggtgctgcaggtggcttctaggagaaggaaggggaggtagaggagatgacatgtggggcccacccaccatatttatttattttagctgctatgtgggccccactatttttaaattattatttttagctgacatgtgggcccacgatttttattattttattattttttcaatgtcacgtgggacggatacctaatcaaaccagccagtaggcgccacgtcagctaaaaccacctttaaaaccaccgagggatcttatttgcatcggttttaacagtttggggaccgattgtatctggttttggggttcaaaggacgaaaatcggattcggtgtaaaattaagtgacttgagatgaacttattccttaatctctcgggctcggccaaggatgtataggctgggtgatgtagacttttagagggagagagagcacagacgggtcccacttccttttattttgcttcctcttttcttctctctttctcggtctcatctcttcctgctctctctgtcacgcgtgcgttggccagggtgacgggcggtcggcgtgcgacggccgggcgcggcggcgcgacagcgcgtccgtgcgcacgggggagaggcggctcggctcgatgcggcggccaggcagcgcagagaggaggagccgggcgcagaggggagccggggcacggcgacgggcagaggaggtggccggtggcgatggacgtggaggctggcggcggaggaaggggagaggagctcggcggcggtaggagagaggaggctggagatccgacgcggtggggagctcgatgcgggcggcatgcgcgaggcggccggcgcgcgacgcgcggcttggcgcggcggcgtgaggaagaggaggcctacggtgtggaggaggatgccggcatgctgcgatggagaggaggacgacggcggggatggagaggagactggcggcggtgaagaaaggctgccgcggtgcgggcggcgcgcgacggcttggcgcggcggccgggaggcaacacagaggggaggaacagaggtgacggtggatgggaaagcagaggagggactacaaggcggcggccgcggaggtgaccgcacgtcagcgctcggcccgacgccatggcggcttgggtcgggcggagacggcggtggcagtggaagtggaggaagggcagaggcacggggaggaggagccgggcggcgaggttgggggtgtcgatggcgggccgcacacatggcgctgccactcggcggcgtcctggagcgaggccaagacgacagcggggagggcatggcgcaacgcggcggcgcgggcgacggccgaacacatcgcgcgcgcaagaggacggaggcggtgcggcgcagcggctaggccgtgcactgccaggaggcaatagaggaggagcgatgcgcgggcgccgcgcaaggaggatgcgacgatgcgcacgacggcggcatcgcgcggaggcaaagacaagagcaaaagaagaacagagaggagggaggaaaacacggaaaggaaggaggaaggaggagatgctcacgtcgcggcagccgggtagcggcacaccgtgcgtggtcgatgggcgtcgatgctcggctcgcggttcatcctcggctcgaacacagccacagaggttcgtttttcagttttagctcaagttttagttcgactacgtccacggtttgagttggattgcaagtttttggaggatgctatgggtcggacgtcgacacgaaactgcctcacgactgtgcgcatgcatgcagcctgctgcgtgatgaggcatgtgttgctgactaccctttgtttactgtatgcggtgcttgtctgcctgagctgttactttactttttctcttcccttcaatcatattgcatgtatctacttttccattaaattttaaataatattttcatcttaaaagacatatacaatgtacgattcaattataccattacattcattgtaattaaatgtttataacaagaacccacgaggttatatatatgtgagtatgaaaatcaaccattgtttcaccatttataaaaacatatttgaactcacctcatgaagtgtttcaaattcagagaaatgtaacataccgaaaaaaaatactaaatgcaacaatcacaaccactacatgaaacactaaataccatcgagtgaaacataaaaaggatcatattaaacatatgctatatttgcaaaatatacttagttatgtttaaatatttttaaatcacacatgatgcatagttgtaactgctgagacaatcaaaaggatacgttgttgacggtcgttatcgatcagtttcgaccgtcaatattgccaaaatagaggagaactagtgatgcttgcaatgcataattacgttagaataataatattccactagtattaggtatactaaccttttgcatagaatgacaataaagtgaaggagaatcgacatcaacacagacgataaatcaatcggacgatatcgacaatcagacttatgtatgaatgggctaagaactcagaattgacacgatgaattgggccaaaattcacaagtctgcagagtggagcaatagaggaggccaccagccgaaattgggctggattgggccagccccaggttcagccgaaccaatcctggcgccgtcggatctaggttttggtgtggacgtccaggattgcatcccaatgacggttggagggcacttcggacaattccccttccacaaccgtcataactacctctatataatgagctcactctcttcacttcaacacacacctcaagcaatagcttagtttagtagtatctagctggtggaataggaatagagtagaaatcaggagtccgaaagtcttcggaagagttcgggtatggctctagcagcttttctcttctcttttgtaagccttgtacttttattagaatactcttctaaatacatttatggtattgaaatactttccgagtatatgagtacctactttacattatgttcttgttatactgaatatacggctagcttatctgggagatgctttggtgcgggtataatgtttgcttatgcaattactctatgtcatgacgatgatattagagaagtatctggtagtttagatgtggtgtctagattacgggatattattatttggggttatatattgcggatgagaggtgggccgctgatggtgatagatcggtacgggtattcctccgcgcctatatataatcctaagttaatttcctggggagggtattcctccgtatttagccccggttgtatggtcatgacgggctgtcgtaaggaactcggcagtcaggggtggcttctcgaagtaccaggagggcatcggaaagagggtattagctagtatatcagtttactaagatgtatgtatactatgtatattagaagtataggaatagattatcttcctctttcctttccacttagcttagataatatattatgagaatgagtagttaatgcttgtgtgtcactctacccttggattatcttaacccctgcttagaatatgattattacaagcaacatataaattattagttaagtcctctctacatgatcttcccacgggataaaataaatacgatacatttcgaatactctcgggtgaaatgctacaatggtatatccgtgcgcttgcggatgaactctgtaaccataatataccagaattatttctacgccattgctgggaattatatttctagtaatgtcgttaagaaataccaaataagcatttctggcgtcgttgccggggaaaattcataatagagattacttgaactaatattttatatttgcctctgtataatcattttcctttgcaggctaaccttggttgttttcacctttgttgtgagaacagggtagtgcatgactggtttcaacctgccggaaaatttcaaggaaaatccagaagctttcttccggagcgtcagaccgcgagtcgctgctccgcagaaaactctaccgacagagaaaccagccgtaccagcgccaccaattttcaagactatggctagcaagactctccgcgagttcgctgctccctctgctgacaatgtggccattgggccacagatcaacatgggagacatggatttcaatttgaagtccagactcatcacgatggcgcaggctagcccattctgtggcaagcctaatgaggatgccaatgctcatctgcaacagttcctggagatctgtagcatgtacaccatcaagggcgtcagtctcgacgccgtcaggctggactgtttccattctcccttctcgggagagcgaagcagtggttttatgccaaccgtgctgctgtcaacacctgggataagtgttctatggcattcctctcgaagttcttcccgatgggcaaaaccaatgcccttcatggacgaatttcaattttccagcagacgagggatgagtctattccagaagcatgggaacgactgcaggagtacgttgccgcctgtccttatcatgggatggacgactggctgattctgcagaatttttataatggactcaccccgacgtcccgcgaccccgacgtcccgcgatcacctggatgcggcagctggaggagcattcttctttaaaacggttcaaggagtcgttgatctaacagagaagatggtctccaatatgggatggagcgaggaacgactccagacccgacagcgaggtatacacaccgtcaaggagacggagttacttgctgccaagctggacctacttatgaagcgattggacgaccacgagaaacgaccacaaggcaccgtcaaggccttggactcacacgttacgtgtgaagtctgcggcaacacgagtcattctaggaatgactgcccggaaactcgtgaggaggcgatgtacatgggcaacaacaacaacgggtactgtccacaaggtggtcaggggtggaaccaaccacgcccatattatcaatgaggtaacaataacggtaatttctctaaccagccctccttgaaggatctcgtttttgcgcaagctaaaaccactgatgcgctaagcaaaaagcttgcggctaatgacaaggtcctagagaacaaaaatgtcaaattagatggctttgcttccgtttttcaaaatcagctgagctttaataaaatgatagaaacccagttagctgagttggcatctttagtccctgcaaatgaaattgggaggattccggggcaacccgactcctccattgaaaatgtcaaggcgatcacgacgaggagaggtaagtccactcgtgatccgccatatcctaaccctgcaggaactactgggatgtcaaaagaagcaccgtctagtgactcggctgacaaggaagttcagccagaaaagacagtgccgcaagagtacggcgacacacggttgctgccattccctcaacgaaggagaccgtcagtggacgagcaattcgctcgttttattgaagtaatccagaaaatccacatcaacgtgccgttgttggacgccatgcaagtgccaacatacgcccgttatctcaaggacatactcaacaacaagagaccgctcccaacaacggaggtagtcaagctgacgaaacaatgcagcaacgttatactccacaagctcccggaaaagaagaaagattcggggtgtcccacgatcacctactcgatcggggcacaacagttcgaccaggccttgtgcgaccttggagctagcgtcagcgtcatgccaaaagacgttttcgacaagctcaacttcacggtgttggcaccaacaccgatgcgcctacaactggctgactcgtcagtccgttacccggtagggatagcggaggatgtgccagtcaagatatgggatttcttcatcccagttgacttcatggtactggacatggacacgggaaaagagacgccgctcatcctagggcgtccgttcctcagcaccgcgggagccaatattgacgtgggaacggggagtatccgtttccatatcaacgggaaggaggaaaagttttagtttcaaccgaggacggaacaatgctctatggtcagaataaagtacgggccgaacccgcagaatattcaagaggtcgaagtggagccacccaagacggacagcctggtgaaattcatgcagaatttcctgaagaaggaaacaacgatgcccaggaaccgttattggaggacgccggtaaaaccaccaataccagccaagaagctagagcagccggctcagaagaagccgccctccgcaccaaaaccaaggaaggtgtggagggagaagccgaagacgcccgctccatcacctccggagacgggtggaaaaaccatgaactaaatcggaaggaggtacagtcctgcacgtcggactttaaatgacgtgaccttcgccaacaggtaaattggtatgtatctgcatatttgccttcaacaatttgaaatttttgcatcatcacacgtttaattttcaaaattgcatttaggacttttgaattttgaggaaattcttcaaatgaatttttcagaacaaaccaaaataaaattttccacgaaaattcattgtgccacgaccacaccgaccgttggaatccaacggccgaaagtggggccggttgggcccactaggggttcggccaaacaccttggttcggcaacggttccctgccacttttggcagggtaacggctagtgggtcctacatgtcatttctgaccgttgtgggtaccctataagagccagccgaccgagagagggaattccaccccatttcaacacattttctttccctctccaaagtttgctctcaaattcattcaagccttgatagtttccctcaaattcaaacacttagctgcatatacatatatatatatatatatatatatatatatatatataagttgctttggtgaaactaatcggcgggtgaaatccttgtcattcctaacccccgtcgagttagtccgttcttgctccattgtgcggaatgagaaggcgattgtctcgtctgttcaaggggtccagctcttcatcaagtcgtcatgacgagtctagtactcgttcatcagctgatgtctcgatggaagacaccgaagctccgcgacaactcctgaacaacaccgacctcgaccttgtcagtgatcgggagagacaggcctactacatgctgagtgaccgggagtatgctcatacgtaagaatactcaccggagctgctaaaaaagataggtatggatactgaatttcgtgctatttggaaagttgttggttggcagagatttgctgtggtagatgagcctggttctcgtttgcttactttgcaatttctgtgcactttgaaagaaatagaagatgggatttcctttcgctttttccgtgaggagtttacacttacatggaaaggcttaagcacacttcttggttttcacgattcctgtaaaatcgatctccagaaaggaatttctgggttcgagaaaaataggttttgcgaagatatttctggtgctccaatttgcaagaaacctaggatgaatgatatccataatcctacacttaggctcatgcacaaatggattgctatgactctatttcctagaggtgatctgagacccataaggggagatgaattaattatcatgtttgccatggttagaaagtatcaagttctgtgctcctgttgagtgcacttctctgattactcggatagcaaaagggctaggggtcgttagcgaccaaatggcttttatctcagccgctcgtccgcgtattgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33029 - DNA, 18926 bp, Oryza sativa
ccttataaagtatctagatttcactgacttaaactattactggcgtctagctgctgcaaccttcacgcttcctcagggagattcctgctcaccttcttgaggtacaggtgagcactattttgagatcctgttttgaatggtatcgagacctgaagaatggtatctctatcccatattgttgtgtattccaccatacaatctgcttggagcattttaaaaaattgtaaattttagatggtatacagctatatatcaatctagaaagtcatttatatgagtaatataatctattatagcaatagtagcttaacataattttctcttttcaataatgtgaagggtgagggaactgtgagaagaactcctgaacagccggtgaacattccatttgatcaacctgaaggagatacatcagttgaaaggcctatggtggtacggaatgaaacttcacctttcccagaaatggatcagccatgtcttgctaatgatttcttgaagaggtaaatcagcgtgatatgatctatttcccttgtgagttgtttttgtgcaagcagttatttttcctgcacaatgtatttaaagaacagataatttgcatctataacaaacacttgctattttatgttatgtcatttgctgtattttgtttctcccctgaccaaaacaaattcgttcttctctttttgcaggtttgaaattgaggatagagcaataatttcacatatatttcatcaatgggcgaagaaacaggcatttcaaaatccaaaaaggctgcttgataaggtactgaatatttcattttacattggatggatgccatatgccattgattcgttcctataaggagaagtagttttttttttttgtacaaggaaaatatggtcagcagctcactggcggactgaatgaagtcggtagtatcagcaaattacatttatgccatgtctgttgctgtattatttttgctaggagtcaggatctgagacatgttagttctgaaacagtcattggtattgcattgctactgtacatttcatgttcagtctatctatgcttgccttttcagattggttttgttattgatgaacgtttacgaggtaaaggatacaagcgcaaggttggttgctttgttccattgattccactatctccctttctgtcacatcttttatttcatgattgtttattatattgatgttctttatatcatcttgttcgtagtcagtgttatacataggtaatcagtgatattttgatcatacaaattgttatttctcattcaggagattttaccctgacatattaacatgtgagttctttttttccaggatgtattgtgcaagctgaaatcattcttaagtggtgatgaagcgtttggttatgcacaatatgtgagttaagctaaaacgatgaaaattttggcagtctcttgaccttgagcgttgattctctttaataaattatttttttgagaactttaataaattattaatttcatattgtgaactcttaggttatcaagtgggaacagattcctatcgacaagcggagccatttgatgagagagagacaggcaagttcctgaattacgatctgttatgaattaacttagaatttcttttctttttaatattaacaaggcatctacatgatggacacctgtccccaagattctcacatgtttgtgatcttccaggaacatttccaaaagcagaggatagagaactccatgggttcctcagaacctacacctaagcaggtcagttatctttgccaatgctctcatatctttacctactttgactagctggttcatctgacaatcacattgccattatggtgcccgttattgacaatagaaagcccatagttttttttttggcagaaaatagttttactggtttccttcgctttatatgctattcccacctgaatggattatcattcaaacactttgctcatcctttggtgcagatatcgtacctccggaacctggggtgcaccatcacacccacgtctcgcctgcacgcgtcgcatcttatcgagaagtacaaatctctatgacttttcactgcttgaacctgcaggggacacatgatttcaagctcagtctcagaattgggaccatatatacagcaacgctggtgaaagttcctcatattaactgtacatgctgtacatatcgatgtacttttcccgtggacatggtgtggttagagcaaacgtcttgttacattaccaggctgttcttgggccacaagggccaaccaagaaacgaaccgggccttctctttggggaatctggctcggcccacaaaataaccagctatgggagactcagtcacatccctcatgcaacgtacatcctccgtcttgtaaaaaaaatatcaacttctagctatgtactttatgggatggattgagtacgggttatgtgatcattgcctcttgtttttgcgatgatccttgtacgctagtgcctagtggtataaaatgagctttgtatataatttggtccattttttttaaaaaaataaacctgcaataaaacgttttctagaaactggacctacaatatggggccgtgatattcaatgtgatgtgcatacagcatggtgttgtataatttggacgtcgatgtaggatattttgtgagaccattatacgcggttgcctacatagcctcaaattatgtgacacggtgccaatgtgccataaacatctctatctctaaaatgctaccgacggtctagaatatatatgatgtttaggagaaccaaaattgacttaaatgttgttatatttttctgtcctaaacgtcgtatatgatcatgattggatggagtattttattagaggcccacatgtaaaagatatttaagaaaaaaaaagactaaattaccaaaactaccccgctatgtactcctatactgcccagtctgccctacaagaaactcgtgcgtgaacttctactgtcactgcactcttcctctgcacacacgtttcagtctctcatcagcccgacgtttctgctgcaaaaccacggcctgattccgattcacgcaaatcgcggccaaatctcgcaaaccaaaaccaaaatcgccacctgtaatgtaaagaaaagaaaaacaaaaacaaacaaaagtgaaaaacagccaaaccgacggcccaaaaagaagccgcagcggtgcgtttccatgtggcgaatatttccaggatgattccaatcggcgcacggcacctcagcacatcacaccagatatataattaaccaccccgtctctttcacgacccactccgcctcgcctccactcctctcctctccgcatcctcctcatcgcctccgcttctgcttttttttttcttttttctcgttgatcggtttgttcgatcagatcggttctttggagagatggagcagtccttcatcatgatcaagcctgacggcgtccagagaggcctggtaatctgacttctttttttcttttaatgttcttcttgtcgttttggccatcgattttcgagaggaattttgcggtttcggatcggttaaatagcgtagttgattggtgtttgtttgtgagattttgagttgttttggtaactttttgtaccgttttgcgtggtttttaatggggaattttgattttctgttctgcagattggagacatcatcagcaggttcgagaagaaaggattctacctgaggggtatggctgatccttttcccctctcgatttgatcgtatggattcatttttcataactttcttttgtatttttattgatctaattttgggttgacctacccgtttttttcaacacatattatgaaaagcagaggctgacgatatcataatactctgtttcatatgggtaggttggggttgtgagttgtgacatggagaatttgatgggtttaatacatgattcaaaagcaagatttttttatataatttatatgttgatgattggccatttttaactggggacaacagactgacacagtaatattcaatttagtatatcaactgattcgttgtcaagtctaattttgcattacatgacatgggcaacttatttattattatagcagagatcgtcaaagcctcaaagatgtagtctactatttgtacttgtaatcatggaaatatctttctgaaaagaaaacatcatttgtacttgcaatagagttcaactaatatctttggcatgcatttaacgtgctcttttccattttttgttccttattaaaagttgttgtactttagtggaaaccaaaatgttttataaagcattacagaacaacaaaaacagctgtcttaaggaacagcaacaaagaacagaagtaaaggactttcatttaacttcccctgtttataacaactgtgtagccatgtattggttgatgtggcgattataacaactgtgaagcccatttttatgagaattattcgaaatgcacgcaaaacatcatccaaaaacttaatttcatttaacttcccctgtttaagaaatatacttcctccattccaaactataagcatttatgcgtgttattcacaatgaatctcgatcttgagattcattctgaaaaacaagtataaatgctttttattttggaacggaggtaatattcggttgagggatgatggtgcttacgaattactttttgaactgcaatgatccagggatgaagttcatgaatgtggagaggtcctttgcacagcagcactatgccgacctttccgacaagcccttcttccctgggttggtggagtacatcatctctggccccgtcgttgcgatggtttgggaagggaaggatgttgttgccactggccgcaggatcattggggccaccaggccctgggaggcagcccccggcaccatccgtgctgactatgccgtggaagttggcaggtgagtcattcttgtctgtcttggtcatcagctcattattgcttgaattttcagtcagttcttgtgatccttttaatcatgtaaggatcctgagcgatggatggttctttatttgttttgctgctagcatcaaacgatgattttgtttgaaaatgggtggttaagtggcttttattttgatctatataaatgtgtgaacctctgttttttaccagtcagaaggtatcagatagtgaatgtgctgtgatatgatttacaaaaacttttgcatgcattatgatgttcatcttttctatatgttacgatgttagtgtatttagacataataactacttggattatgttaaactatgttcaattctagcttttgtttttgaaaataaaaatcataatgcttcctgcttatcgatgcctaagctcaagctgttgtttcttgtgtaggaatgtcatccatgggagcgactccgtggacaacgggaagaaggagatcgctctctggttccctgaaggtttagctgagtggaggagcaaccttcacccttggatctatgagtcttagagcttcgcgcctataatcgatcacctcttggtggctagttctcgttaaatatttgagttttgtttcagagttgtcatctggctgcctcctgagtcaccattataattctgctgtgatacaatcacagttatatgttgcctgaacttatatggctttttaagtttctggattggatgtgatgggaaaataatactagcagtcagtttttgcttataaatgtcgtaatatcttaatcatgctctttccctaggttcatccaagataagcagatggtgttgcctgattttcttgtggcacataaagctcttagatttgcaagcaacctgctgttctggactttgttggaaaatttactagaactaaccaaatacccgtgctttgctatgtattaaaacaaattaacagtaagatttttagcacaattttgtcatgtagagatgtggagatgaaatatgatagaatcctatatatagagggattattttataacaacatgatagagtaggtgataaataaataaataaaaacttggtgagctgttggtaggttcattatcaccagcattgttctcttttaaaaggagtatagataatgttgaatgcttcaagtttaaaatggcaaaataacacagctgattcttacatgagaaccttatctattcaaatgtacagatgattttgcttagaattggggagaaaatgaatattgcaaatgaagtctggtactctgattggcattgatgagttgattcacaagtttcctgaagaatttctagtcgtgaagtttctgaaatgacaggagagtttcagcctgtctagcaggattgttttttcaattaaaaaaacataaaacagaaccattcttaaaactttcgaaataaatttgaaaactttttctgtgggaaattattttgatgcattgaggggatgttttctcttatttgcatgtcactaaaattgttacgaaaaaaatttaaaaaaaattgagaagatgtattaacatgtgatatattattacacaaacatacaagctcaaaatcaatttctacatcttgcaacgaaaaaacaattaatcgttgcaagatgtagaagttgaatttaaacttacacatgtttgtatagtgatatattaaatgttaatatatattcttaattttttttataaccatatgtaaacaacgagaatccactcacactgtctgctttggtgagtgactctcaaccaggtgcggacgtgtcctgtgcatcatcttcaaggtaagtgtggctcccgatcgtccacctctccaaaccatccatcgcacaaaaaccaccaccacactgtccgcgcatggcgcccagctctccatctcgtgtcgtgtccaagaaacgcttccggctgccatcgccatggcgctcgccaccacctcctctcacgcgctcagctgctacctgcatccccgacggcgccgccgcggcaatgtcgccgtgtcgccgcggtctgagggcggcggtgcccggaggaaggaggaggtggagatcgtcatcgtgggcgccggcgtggcgggcctcgccacggcagcctcgctgcgccggctcggcgtgggcgccaccgtgcttgagcagggcgcgtcgctgcgcgccgggggcacgtcgctgacgcttttcaagaacgggtggcgcgtgctcgacgccatcggcgtcgccgacgagctccgcgccaagcacctccgcatccaagggtacgtctctctcgctccctcccctgtatctccatggatgatctccgagcttctcccgtcgcgttctgagctccgttggtgacgttccagctgaccggccgcaggatgaagatgcggtcggcgtcgtctccggcgtcggcggcgggcggcgtcctccgcgagttctccttcgaggaggaggccccgggtcaggaggtccgcgcggtggagcggcgcgcgctcctcgaggcgctggcgtccaagctgccgccgggcgccatctccttctcgtcgaaggtgcggcgcgtcgccgtcgccgggcagcagcaggggcccggcggcgccaccgagctggagctcgaggacgggaggcggatcgtcgccaaggtggtggtcggctgcgacggcgtgaactcgccgatcgcgcggtggatgggcttctccgagccgaggtacgtcggccacatggcgttccgcgggctcgcgcgctacgacggcgacggcgggcagccgttcgaggcgaaggtgaactacatctacggccgcggcatgcgcgccggtttcgtccccgtctcacccacccgtgtctactggttcatctgcttcaatcgaccaagcccaggttcgcgaaatttgcttagtttataaaaacaaataaatatcatatgtagatttgctttcgaaagtattatcataataccatgaaattaaaacacgaatgttagggaagaactaatatcaaataattagaaagggcaaggcttcgaatccagatcatctagcccaccaccttgtgaagttagccggaagactcctaggagtttcatgaaattaattattagattttatgaacttattttgatataaaatcgattaacatcattgacttaggattcaagtttcaaaagtttaaccaaatgttatcctaaacatcgcgcatttacgaccaaacagattaacaagggaaacaagtgaaattttacatttgaaagttttttttaagaaaaaaactgttcaatgttgtatagcactctctaaatttgttagttattcttgcttgaaatcttagcatttttcgtagctgatgtgtttgaataatctttgactctactaacttagggccaaagatcacggacccggcggcgctcaagagggaggcgctggagctcgtccgcgggtggccggaggacctcctcgccgtgatgcgcgacaccccggacgacgccgtggtgaggacgccgctggtggaccggtggctgtggccggtccttgccccaccggcgtcgaggggcggcgtggtgctggccggagacgcgtggcaccccatgacgcccaacctcggccagggcgcctgttgcgcgctcgaggacgccgtcgtcctggcgcgccgcctcgccaccgccgccgcgagcgagggcggcgaggcgagctcgtacggcgaggctatgcgggcgtacgagcgagagcggtgggggcgggtgttcccgctgacggcgagggcggggctcgtcggcgcgctggtgcagtgggggaacccggcggtgtgcgcggcgcgcgacggcgtggtgatcccgaggctggtcaggctcggccccttcctcgagcacaccaacttcgactgtggcctgctcgagccgtcggcggcggcggcggcaccgtcgccatgacagagccaaagctgttgtctgaacagtggcgcaactgcagctttctcccacactcactctctcgcttcaatgtaactactgtattggatagtggatacaaatttcaatgctagcattttctaactattgttagacaaacatttgcaataatgtgagaaaagacattaccaaaattttgcaattgatacgaatgaatcaatatataaattgaacgtaaccccatatactaatgatgtttaaggactatctactgctcaactctttgctttatctaaaatacattctccaacttcaaaaccagatattatacgctccaaattatgaatacccgaaacatataaccattaaagtcagatttagtacaattggaagccatataagatgctacttataaaaatatttcaaaaaattagtagaccccacatgtcaggggtcaccctcttctttttctctatcttttctctccttcctcttcttcctctataaagactgagcaacaaaggagggaggagggtttatacgtcggcgctccggggagggaatgacggtgatggctgtggtaggacatgtccaacgtcacggagcagccagcagtggtggaggccgaaacgaaaactacgagagtagcggaacacatgcaacaagagcgcagagtttcaaaggagagattttaccaatattttaaaatatattttagccgtgacacgttttttaatgtctactaataaattacacttattttgggtgttttgtagtaaaatttacttttggacaaagctaagagttgagagggttgtaaaataggcttatccctgtagagtcatagatattttagcgcatggtaataggaaacgtataaacttaaactttgtgggggcaacatctcgtggcgggccagacgctgatatgcacgaggttgggctcaacgtgttggcgtcaccaattaaacccagccagctaagttccttcagggggattttgggtgacacgcgaaacaagaaaaaatatcgagtattagttatgataaatatatatatataatttaattatttttaattctttcaataaactttcatatagaatagagcttttttttaaatggaactgctagaaagctttcgcaagttttttgccgtccaaattttcggatttgtggccatcgcatcgtttaagtgtacatgaaagaaagaaaaatttctagaaacaaatttgtacagttttgctataagttacaatgcagttacagtacaactataatacatttacatctcaattatattatagttatattaagaaaacttgcgggaagcgtcgtaattatactataactaaatctgaaaaaaaaagaaaaaaaaacttgggggaagcaccataacagatacggaggaagaggaagcgtgataacggatggtgcggcttagcagagaggagcgatgtggtcgagctcgacggggaggccgtcgtgcggcgtcggcatcgggtccctgagaaacgtgttcttctcctccccgaggcagagcttccacctgaaatgcctcaccaggtagtgcgccgtcaccagcgtctccaccctcgcgagctccatcccggggcagatccgcggcccgccgccgaacggcacgaacgagtacgccgccgccgccgccgcgccgtcgaaccgcgacggctcgaacttggtcggctcgtggaagatggccggatccatgtgcgtcacgctcggcgaccagaagatctgccaccctctcgggatcgtgtagccctcgaactcgacgtcgacgggcgctctcctgaagctgcccaacaccggaggcaccatgcgcagcgtctcctgcgcgacgcgccacgacagcttcatcttggcaacgtcctcgcatgtcagcgcctcgccgtctcgcttgcccctggcgatctcctcatgctctgagtgttcgtcaggggaggggagagttgggtttcttgggcgagaggagaggaaagttagtgctactactacttgccttgggccatggcggcgagggtggccgggtcgttggcgaggtggcggagcatgaaggtgaggaggacggcggaggtgtcgtggccggcaacgagggcgagcacggagttgtcgacgatctcctcctcggtgagcagctgccggccgccgtctcggaggctgaggaggcagctgatgagatcgtcggatggggaagactcgccgtgctccagcttcgccgccttctctctcacggtcgcctcgaccagccggcgagccctcgcgctcgccatgaggcctctgcggaacggggtgaacggcaggtccaccggcaccgtccacaagccctcgtgcatgccgtcgaacgcgtcggcgagctgctcccggatggcgccgcggtcgaggccgaacagcagggtggcgatgacgtcgaacgccagcgtcttcatcagcgggaacacggcgacggtgcggcggccggcccacctggcggcgaggtggcgcctcacctcgctgtcgatcttgccgacgtaccgccgcaccatgtccggcctgaggaactgcaggatggcgccgcggacgcgccggtggtcgtcgccgacgagctccagtatgttcctcctcccgatgatcgccgccaggctccggggctgcttgggcgccagcgcctcgtggtggaacaccaccttgttcgccgccgggccggcgacgagcaccgtcggcgcgccgaacagcgacagcttggacaccgggccgtacctgtcgatcctgtcctgcagccaccggtcggcggtgttgcgccgcatggcgcgcagcagggaaaggctctgcccgatgagcggcaggccgagggagcccggcggcaggttgcgccgcggcggcggcggcggcgacgccctcctcgccaggtacacggccagcggcgtcaggaaggcggcgaggagcgcgatgacgacggcgacggcgacgactgccattgcaacaatagccaaaaagagtgtagctgtgagcctgtgaagctaaagcttaattggaatgagacttgaccaaagagatatcgagcgaacttcatttataagagcgtgagtaactcgtaggatcagtttgcgtacttcccatggtatagaattattcacattcaagcccctctaaactgaacaaggctttagttggtactccctctgtctcactgtctcactcactaaggtacggtcaaacttgataaagtcttcaaaactaatatttgattttaaatttctcatatgctataatgtttgtagaaataaaatcataattataggaaaataaatttaaatgacaatccaataacactatttttatcaaataaaattaaattaataatatataaactatttattggtcaaatatttaaaagttgactcttaaaacgtgcgcgtcttagtgagtaggacagagggagtagtaactttgacaaataaaaatgtttatgggagtatctaaaaaactactataaattttttttgagtataaaagattcagatgtaactataattgaattataattgtaactgcactataattgtattgaaactacaatataagttatataaaacttgcattcaactatggtttgggtaactagcaatggaatctaatgttgacatgtgtgaaaatttatttctatcatttttcgcttcatatacaaatctcaaggcgatccaatggccacaaatctaaaagtttcgagggtaaaaatcttgtgaaagttttctaacaaatccgattgtttatttataaacatatttcacaccgcgtagaaccaaatatatactaatctcgtgtacaaactttgacatcttatcctttttaattttttttttgaaaatatgtcatattttcatgtatttttcttgcaaaatataattatagtactttcatttatcaaaacataataatttaaaagtttttattggccaaagataaaattacactggttaaaataaaaaggaaaggaaggggtgtatttttaccattgcagccttatccttacaattataaatcatacttcctccgtttcacaatgtaaatcattctagcatttcctgtatatttatctagattcattaacatcaatatgaatgtgaaaaatgttagaataatttacattgtgaaacgggggagtactagctaaatatcaatgcgttgtaaggagcaggttgaatataatttatcccatcctccatagctaatgcctaatgggtggactattgtttagtggctcctaaatgtcaccttacgttaggagtagttggtaccaaatttaacaatctctatggtcccacatgtcaattagtgagataaattcactgctcatcaccgttaccactttatagctatatgtcaacatttttttagaaataatacgattttaatggaaaaatgaaaaaaatataggtataccagataaaattataagtttagcatcatatcaaacaactgaagtgtgacaggatatatatcagatagcctatcgaataacattggttcggaccataattgtttgataagatcattggtccgagaaaaaaatagtaaaaggtgcaggcatgcatgcacgcacgcaggaggcctctcgaacattcaacgttctataggtacctcatgcacattagcccatgcacacacgtacacacatgcatcataaagaattgcaaaaaaatcctaccgtctcgtcaaacaacctctatccaacaaccgttgtttgatgggtcatctatcgaagaatagttgttcgataggatgttaaacttatgattttgaatgatcgaactttatttgtacaattttttattaaaaatgtattatttctaaaacaaaaatcgctttatgtacactagaatcttctaggttatccatctacgtctatttgcaacactaaacatatggtctgagtggcctggaattaatggtcacgagtggtccttgagttattgtcaatgtagggttataatcacgtaggttcacaattgcgtcatctaatcactattaagatttggccgcacacagaaaagcaagcactgtgcacatgaatagtgatggtttgtgcccgtatgaacacacgagcatatcttttcatgatcgaaaactgagcttgcatattttaaaattaacaaaattatcataaacgtttttatggatccctgtatcattgtctagttattattataaaaataatttatcgtaaatatgagttgtcttgttaagcctaaaacttagacatattccatcgtaaacgaccttagcagctcggttgtggtcttcctcggcagccaatacggatttctctgcctcgtaaaaaaaaaaaagtaataccgacttctacctcacgtggcagaaaaaacaaaggacactgtttctgtttatgtttgtgtttgaaataaaatatcacaaaactgcaattgtttggtcgcaacttgtatcatctacttatatgccatcacaacccacaacatcatctagtgtctatagcatttaatatattgccgcataagtaaaaatctgatgtggcttaagagttaattaggagagaggtaaaaagatgaagaaaccatttctcatgaaaaaaatcatctctacacaagaaccaagattgaaaacagaaccaagattgaaaacagagtataggtggataaaaggagagagaagagaggtgaaaattacaataataacaaactgttttattaaaaatactccctccttccaaaagttttggaagtttctgttgatcagttcgtatttggcgtataaacatgcatgcatggatttgttaaacatgcatgcatgcaaatccatccgttgcctatttgcactgcagctacacctctttgtttttaagcaaagcttgatgcagctgccattgatcgatccatcctgtgtcgttctatccactacatggcctctgcttgcagcgatccactgcagtgatcaataggaaggatggaagaaaggctcgggcactgcgtgagctgggcaccggattccgccgaggccgacgatgagcatgatggcaaatagcggatccaatttgcatgcatgcaatttcgttcgagtgggagagggagggaaggctccacgcaattttggctgctggcgagggcgagcacgcacggacgcgcgcgacgggcgagggaggacgcgaacggttgcgctcgcgcgcgggcatggacggttgcgcacgcacgtatcgcgaatcaagcgaagcgtcgcttccccctaaatccatgcagatgcagcgatggttaaatgcatcggaggggttccttggtctcagtgcaaacgtaatacgactggtacttttggaaggagggagtaacagttgtgtttggttaggctatggtttttaataaagcaactctgggctatgactttttaaaaagtagctttgcaaaagtagctgtgagaaagccaaaagctatggcttttggaaaagcttcttcctaacgagtagaccccgcatgtcatgcacacaggtatttttctctttctcttgagtcttgacacaggaagccaggggaacgccgctcgtcgctggcaccgttcgcgtactccttgccgtttgccgcgccgccggcctcgtgctcctccgcgtggagagcgggaactcgcgggcgagcgtgccgagacggagcgactgggcggcggcggcggcttatcgaggcggcgcggcgttagacggggtcggcgtcgggcggggaggaaaaggggcggcgccggcgtcgggcggggagggcggcggccagccggccggagggcaggggcggcccacggcgccgggaagcgccgcttgatccccactgttgcgcccgtgtgagaagcgagaggagacgaatagattagcgaaccgttttttcataatggtataggtgggtaattttctcctccaaaaataggggtagaggtgcttttgatttgtactacgtcaaaaactagctttgggcaaaagtagctgtggcttttagactctttggttggtttctgacttttgcaaaagcaggttaaaaagcccaaccaaacatatgtcaatgaacccctatcttcattttaagcggactattggacgatgtaattaccgaatgatattaataaagctcgccattaagaccttcaaaaattcacagcaccttcgacgaattttaacctttttttttgtttttgcgaaaaagggtaaattttacctcagccgcaatgttgcagcaaatgcattcggataattatggattgtttcataatattacataacataaaggtagaaagccaatgattaccggtcaaatgtcctaggataggtaaaatgtacatcttccactttcacagattctgaatctatacctttgcaagtttaccgcatacattgtcgttgcaagtggacatttttccacaacgttctgtagtttcatcatgtatttacttactacaccaccatgatggtgcactctaccagtctatcactgtatcgtacgtgtgccctcgatcgtaacatatccacacccacaggatcgatattgcttgcaatatcactgtactattaaatacaacgaacaacaagaaataaccaaactaaggtacgtactttgccctcagctttgtgtaaagtactcactatttgccgggtccatgactcatgagctgctgctcctcagtctctgcagcctttccagatgagacttgagccaggcaaactcatgttgcatcatctccaggtgactctccgccatccgcatctcctcgcctaataggtttaatctcttctgtacccactctatgctctctttgctataggagaagccgcttggggaggtctcttggttaaccatatacaccttgggggatctgagtagtagaactatgatggttacctgcaatagatgtacagcgccaaatgagtttggtagaagataacaaaggatattgtgaattagtctactttgttttaatttcaaacctttttttgttcgggctattgagttctgcagtaactagcaagactaacagcatttggaccagggaatctaaactataatatgtatgtaatcaaataggtaaaggtacttgcctgcaatagaacgatgatggctaccagtgtcagtgctaacaccggcccgagctgacttgactgtatatatgacaagagtgaacgccaaagttcttgtgatgtggatattatggaatcccatactatactttgttggtgatcatgaatagaaggaacgatgcttctcacaacaggttcatcaggtgcagaactcgagcctggatctgtgttttccaaaggattctcactactgagagtagtccctgatggatcatcaacattagttgagctggaaggtcctgaaagaatggacagagaaaatgatcaatttactgtttcagagtttcgaatatttcatgcaaatgaggacgtaatttggatcaaacaagttagaactgtagggaaagagcaaaggactgatgcagtgaagtggacattcaattaacagacctctcgaatgacagctgctatcctgcttcaaaagatcatgaccctaaaaaacatgacagggaggatcacttaagattcaaattgtaaatagctttgtagtaataatgttctgtgatgagaaaacacatacgagcttgacccatagcccaaaaacatcacggcattcatcttttgttgattgatcaatcttccctgtaattttgatatttaaaaaatgaaaaagcagcagcaagttaagttgtggtagatgaaacaaactgatcttttaagggggtagaaataaacaaataacactgcccccagacatgcaagaatagctcagaaataacacaaataagtaaaattctaaatatggaatgaatttgagtcagaactaagcaaaatatggttgttcactaaatctgcatatatacatttaaaaatgccactataaagaatttaaacgtctcaaactgctggagcgttcaggaatcaggatatatggggtgtatcacctctaaatatggttttctttgagaaggctacattaatatataccctgaggtagcaactgctttcatccaggctgtcttgttcaacatcccagatcccctgtttgaagaataaggaacagtagaaacatcatttcagtatctctacaacatcatcttatggtttcataaaaaaaagtgatatgttcccattgtaaaatgtaaggaagctggaattcatttccatggcagtgctggtcacaaaacccgtgcctagttctcatatggtcaagcttttacgttaaatctgtaacttctgatgtttgattattttgatctaggcgcacatttgtgcttttattttgcttaattttgattcaaacccaccacaaattgacccttagttgggaacaaccagtttatatgaaaataaggagaacaaccagttctagagaatttaaaccatccatctatggatataacaggaatgattgtctgaaaagaagtaataatattttggagagcagatcatatactcatccacaaagaaaagccaccatacaaagtaccatatttccagttgaagtttagtagtgctatatgatttaaaatcccaaatacatccagtcaacagtagtttgttggggaaagtggatttcaagcaagatgaaccaatactgacaaccgagttcctcacctcaacagtaaaatggtccccatatggcgcatcaccaatttgctgagatgtctgaatcatgagatgcctttgaaaaggtaaacaagaaaattaaacatcaggagagtttagcatcaattattcttcagagaacatataatttcttttagcacacagtcaccaaggttgggcatttacattgccatttactgcaataaaccataaaggtatggctaatcaagctaacatataaatgagaaataagaacacacacgattattttgctatgaggctcagatatgatccaccaacaagtgagtgtgaccaacaaagggcgaaaatgaaacaaatgttagtgcatctcaatgacttcaaaatcctcaacattttcagaaaactccattactaggtgtaaccgtgcaaaaatagaggaag

SEQ ID NO: 33030 - DNA, 3696 bp, Oryza sativa
tcattactaccacttgtgacagctgtaccattaacagatctacagtccaacaagctcaaatcaacattcataaacaatcaacagaaaaacagaaagtcccatttgatggaacttaatcaaggagagaattttgttcaaggcaaaagctacctgtctaatggtgatgaatcatcatcttgtttagtttcctttgctccttccaacaaaacataaccattttcatcactgctgtttcctgactttgcatcctatagtgcagtagaagagcaaatacaaacaacttttcagatatgagcttattgataactcttgcactgcactcaatgtcaacaaatagaagttactatagatgcttcataacctggcgttcaaggagcaatctagcatcactgacatgctgttcccagccctctactataatgcgaaaagcttcatcgcgtgacaagaaagatccaaagaagtgctgcaagcaatgcaccttgagtgagatagatctggcataaccacataaggaatcaagacagtgataggttcctcaccctttttgtaccggcaataatttcgatggcattatgaaaaatagcagctgtttttgctttacgtacatcagtcacttcctgcaacggaatagttttctgaaaaaaaaaggaaagatgaaagtagaagagagttgtagtcaataatcttttatagcagtacgagcaacgcatcagtataacatttttgtacatatgccgctataaaatatttaatgagaaatagcagcataaaactattgcagacaaattaatgaaattaatcagatgataatcatattgtagcagcaaaattaactttattggtcagccaattaggacaaaagcaataattaaaacaattttgttggagagcaatccttcatttccagttcaatttagctcaccaagtcagctaataaacaatgttccacttgcaggaagccaacatttaggcattaattacaatcagcacagagaaaatggaaattactagtgggaacaaccactagctcatgcttcaaacagagtaacagggttttgatggacatgtggccttccatatgctaagtgtttaacctactacagaaactatatgaagacaaagcataacagagtagaatgccatttatgatggtccatcagcaacgcaaaatatcaaggcaagaaaacttcaatttagataacacagttccaaaaaaaggagcaactattttaaggacaacatttcttcagctcaatttattgcaacagaatgtgtcaaacaatacaacacaacacagaagatatgacatcaaccagaatccactatgcctcgataataatgtgtatccgaaaaaaaaatgttcggtaatacacttcttaaagtgcaagtgcgactgaacaagctaaaggagcatatatgatgattgccttctgatcattcattaccttggtctcatatccaaaaatgttagagtagaagcatatatggtgtagaaataaatacatatgaccctgcagaataatgtatatttgttagaatctgaaaatcgtagatagtgttgaaggcctgaaactaaagcctatttttttatttaccctgcaaaataatataaccaagctctatcatttgcacaggtcaaacaatggattttttaggtgcaaagcactggctaaggacagtagtgaaaccagattgtctaataatgcagtagtttgaactctgaaactaagtaatgaaagaaggagtgtcatttgcaagacagcaaggatgatggacagtagcacccttaattgcaacaagttagatacattcatctaaacttgttcggtgcctagattagaaatcaatctacactattattgtattatgaaaaatatggattagatcttagtgttaagcctttccatatgtctttgcacatgcttctctacatcaaaggcataaacttgaattagaattggtggtgcacatgtcttaaatcaatacaaagcaaatccaaacagtgaatctaccctcgaaactgcagggccaacacttgccatgtgtattatatcgaaatcaactttggtataggtgatttatgtgtgcttgacctcaaattgactctgttcgtgagtgattgacagctgtgaacacagtatgaacaaccaggttatcattttatttctaaaaatgtgacaagttgcctttggtaaccctgtcctttagttctgcaggcaagcaatgcacaaaagaattttctagatgctgctgtgctcaatggggtggaataataaaatgcaggcaaaaagggaagtatgtattgttgtatttgtaacaagtatgagttaataggtattttggccaaaagtgtcaacataaatgccagcagcttgtcaatattcacagggtcacgatacaagtaaaatagatgtttaaattttgcatattttggaaagattctttttaagccataggtgattctctacttttattgtctagaaaacctgtgttacgaatcaagacttaagttacaagaagtagcactgaatgatgtcatataagaactacctgaagaagaatattttcttggagcgcacaattaaaatcttgcacaagaacctgcaatgcacaaatactaccatcagggataatcataagtgatataatagttcatcaaattactgttcaataaaaaaatgaacttggcatattatcttgatatggcatgctaggtcgacccacaattagagtcactcaaattcatttatcatcaaccaaatgaagtcataaaaagaagttcatgaaactacaagctggctacaaaatcccacaatttcggcaagcttccacaaaatttagtcacagttcaaccatcaactccgccacacattcaatagacagaaccgaatcgccacaacctgatgccactattcaatagaaaatggctcgatttgtcatgatgcgccatgttccaaagcaagtacaagcaatgaacaagtcatgatgcgatttgtcaaggaaaaatgaccacggcacaaaaagtcaaagttcaccgaatcgaacacccagctcaaccactggagcactcaaaattccccgcaacaaaagtatgtcaatccagggtcgtcgaggatcagatcgatcgaatagatgaagcgagaagcagcgatcaaatcaaaattttacctcgtcgggtggcaggcgaaacaaaagcctgtactcctcgctcctgctcgcgagcaacgggctctgcatcaacgaaccaaacaaacccacaccgcgtcagaaacccccaccaaccagtagtagaagcgtagaaccaaacccaaacccaaaatcgaggcgatattccggcagcaatccccgacacgggaagcaaccgacccacccaccgaggggtctggcgtggcggcgagctccccggaccgcgcggactccggcgatgacgcgtccaccgcgggcggcgccgaagcgagccgccgcggcggggaagccggggagggcgcggtggtgtcggcggcggcggcgggggggcccctgctgggggtccggctcggggacgcgacggccggcgacgccatgcccgcaccccgagggggggagggagagggggatacgagggaggggaggcaatcgtacgccggcggcggcgaggtggtggtcgccggggaggaggggggaagagaagagtaggtggagtgaagggggaggagg

SEQ ID NO: 33031 - DNA, 8567 bp, Oryza sativa
cggtgacgtgttcgcgggcagccacccgggcacccggcgtgtcggggtgcgtgtgcgctccgtcgtcgggtcgggttgggtgggttcggccgctggcgacttggagggggaggggaggggggaagacggaacggaaggggaagtgaaatactaccggcagcttctatatgcttctttttttttcgttctttctactatatgtatgttgccatttgtttgtttgtttgtggtatatagcagaaaatctattattacggcaagataataatactctctctgtacttaaatatttaatatttaatgttgttgacttttttaaacatatttaaccgttcgtcttatttaaaaacttttttgaaatatgtaaaactatacgtatacataaaagtatatttaacaatcaatcaactgataggaaaagaattaataattacttaaattttttaaataagacgaacagtcaaacatattttttaaaagattaatggcgttaaatatttagagacggagggagtactattacagaagagctttgttatttatgcaatgtagtacgccaccctataatatccaacgtcttacttgctataaaacctgattatgtaagattaaaacatgattatgtaccatataatgtcgatacaatcccagtatcccaccgatgatacaaattatttttttatggatttccctacagcactaaacaaagagtcaagtttattatacgagaaaataagtgtttgcccttcgaacttgatcgattctctcattttgctatcatcacactctaatgctccaacaattgaatatattatttaaatatatcgtaatgcaacattctttgattttttatatggcatgaaacattaaaatgaatactaagtttgtactccctgtagtcacataccacacgaaaatattaaatggcatatgcatatgctactacctctgtttttttttttgaaagatgacgccgttgactttttatcaatcatcttatttaaaaaatttacgtaattataatttattttattgtgagatgttttatcacttaaagtattgtaagcatgatttatatcttatatatttatataaaatgtataaaatgtttaaacaagataaatggtcaaagatgagttctaaaagtcaacagcgtcatctattaagaaacggagagagtatgttttaatattccatccaatcatagataagtgatatttttggatgcgtaaaatgaacacatttaaactaattaaccctataaactttgaccattgattttatttaaatattttaattcaacttttaaaaagtgatatggtatattcgtttataacttcttttacaataatgtatattaacctttagtgtgaaaataatttgtaatttatttataattatcaacaagtttcttggaacatacaaaagtaatacactatggtaaaatcatctttccacccatctcctaatgatgacagagaactaacagaaagagccaataaataaaagacaaaagctgagaatgaaggatataaatgaagtgctatttaggagggcaaataagagaatccgccaactttaaaaggcaaataaatattcttttttattaatttatcttcactcagaatacatatgcagcccatgcaagttcactgccttttttggttcctccactgattcattatcaacatcacatagccattataactaccatgtcaccattgttttcaggtgtcaccattgttttcaggtatagggattgaaatatcatatatgcagacaagcatggacctcgttcactatccctacgtgaaagattttttttttcctttaggcagggatcgaattatccgattataatataatttgttatagatgcacaatggagtgtatggttttctcttttctttttttatttttacctaggctacagctgcacaatttcagttgtaccttgcaggatttatgttgagttttttttaaaaaaatcacttcctccagttccgtagttcttaacattttagacaaggttaagatcaaagattttattattaataatagaaaattatagttaagatctgttttggtgattgtgccattgttctaaacgtaagaatttttttttcttatacactctaaacgtcaaaagtatgtaaccaaagggagtacatacatttctaacaaactggatattttatcaaccagctaataaatgccttatcggctatcgcaatgtgttctcaaccactgcatcgccgtgcaaagaaaattgggacagggacatgtccttagcatacagtacagataaggcaggcttcattcatggtcagattagtatcaaagcacggacaggcaaatcctcaaaccagcatagaatatcactagcaaccacgccactgacaaatgaaaaaggacaattaaacttccatcttgcccggtcaccctaatactctatatccgcatgcgttgcgttcatgcacggtcgtaatatatattatcagaattaattaaatgctcccctaatcacacatcacgtcgcactagaaaacagttaacgaatgatgatactgatgactatagtgatgtggtagcagtaaacaatcaacaggttgcaaaaaaataaacataaaccagatataaatatgacatattctagtacaataaatttaaacaaacttctatctaaatttattatatttgaatatgtagtattatatctgtatcttaagctgcccgcacgctacggcgatcggaaagacaaccaaagacgaaacgtgtcggtttgggcgtttttttggttttttggaggagaggagagacacgccaaggaacgcatggagcggcggggccagggcagggcggcagtggccgcgagcgcgacggccggccgaccggtcggtcggtccggcttaaaagcgaccggatcgagaatgagaggctgtcccgtgggccctcgctactcgcccaaagagaacagaaggcgtatgaccgacctttacgtcgtctttgtcctcctacaaaacacatgcacattgtacatttgtacctcttccgtttcatttacttttgggattatcaaaaagtcattggatgtaaaacggagtcaaactcaaagcctgtttagatcaatttgctacggtaatttttttttttaaagtttggtggcaaaagatttggtattataattttacaagttggtgtttaaatgcatggtaaaattttgctattaattgctgctgcctctctcatacgcgggtccaatgctttttggccaaatttgctactattaactctcaaatgacaaatgtcaacttgtctgctttttgctattagtgtttagatccattttactaaaaagtgatttaaagcggtaaaacttttgttattttggatgatctaaacaggccctcagtcgtatttttctcaatcgccaatccataccatctttttaggttttaaaataattgataccacacatttatcaatatggatttagatcgagattatacatcccactcgatcaggaatttttttgtcatcattaccctgaacaagttgatttgtattggtatattatacaccccactcgactaggggtttttttagtcattttaccttgaacaagttgatttgttttggttgattacttgattatactcccgaaaaaaaaagaagattacttgattatacatcctatactatactaggcgctttttgaccattttacctttgaacaagttgatttgtaacggagattcttcgtaaggcttctcgtgggacaaattaacaaatatctgaggaatttcattattttcatacgaattccctttaattaatattgtcacgtaaaattccaaaggaccctcgacatttatttttctaacacagattatagacaacttttgattgcatatgttaacattagctaatcggttagatgtttcttcgcgataaaaaaaacatcagttagctgttcacattgaaatgatggagtcatggggatgagtcttatgcaccaggacttaagtcctgatgtctttaaattttagtgcttccaaccaagaacatataggcattctatttgtggtgcaatgtattcaaagaactgtacttagtgatgtttcatatggaattctccatggtatctttcattttattgtcccagagatatcagaaatgtattccaactcagcaacactttactcagttcaatctttgattgtatgcaaccaaaggttcacatatgatgctctgtgcaagctcaattatattcaatataatccttacacgtgttgcataacttagaaaatagggcatcatgtaggcaattgtcagaatgacacatgattaagccaatccaaaagaaaaacacaaacactgctgaaagtatatatagcgaatcaaattattagaacatacattattattaagtaacaaaagtaatggatggcaagtttcacctagtttcttcaccatctcctctcagttttgctttctttttcctgttctcccagaggccccaaatgaccagagcgggagaggcccctcctctcccagggattatggcggccaacatttcacccatggcaggagagcaaaaaaactgtggtgggagaacaaaaaagagttcatcttttcttctccccagtactagaaataggacgatactttgacgtgacatcagattactgagtgatgtcattgtcaaactcaaagagtcaccaagggggatgatcctgtggcccttatgtgaagagtcaccttttcccagactaaaaatcctctgatggcacttgatacaagggtgcaaaaagagtcgctaaatgatcttagaaacaacctttgataagtgtgtttcaccctgaaaggaatggttaatcctaactatgcaccttcatgatataatagaagagaaatacaagagattggagcaactttagttcctcatatgaagttatgaacaaaactgaaaagcaattgtttgctctgacatgctaatattattattgatgtgttttcacgctctattgtgcttaatctccagcaaatacatgaactgtattctttcgtgtctcaagcattactcaaaggtcatacctcatataagttgcagaatatccagggactgagttattctatacttaggtgtcatctatcgtgctttgacttcccatattctgggatccttatgactaactttcttggagtgagttattttcttttccttagatgacatctatgctttgacttctcatgttctgggatactcatggactaactttctttttctctggttgcaggtggaacattgctctaagtaaacaagggtaatagcatttcgtttagttgttcaaaattagcatgtttcaatcttcttgaaccctgaaatctgcgagactttcaaaaatatttgtagcaggagattctttctcctgcacatcaatgcaatagataggggttgtcgatggcatctctactcaaaccttgtttcagatgtgaggacttttcccaatttctgtggggggaaaagcatgtaaaaattcatcagtaactctgaatgtcttctcactttcaagaacaatcatctgcaactcactgaaacagggtctgaaacttcactcttcttttgatgctgccagatctttcatatccaatgcctatcttactgtgcactagtttgacagccagatcagtatttcctgcttttcgaagtgcattgatcatcatcgtacgaactctcccaggtatttcacgtcctttctgtacaatgccatctgctaatttgcaggcctgcttgaatctgccagccttacacagcacattgatcatatcctcatgggccgtctctggaatcacccccattggagcaagttcatccaatatcctgcatgcccggctgaatttaccagaaagacagagcccactggcaagggtcctgaaagctgcagctgtgggagtaattcccttgtcgatcatcgcgtcccaaaacttcagtgcctcttcattcttgtgttccttgaacaaaccatcaatgagaatggtataagtatacactgtttgatcacagccatcatcttccatccgtttatacaaggcacatgcatcatccattcttcctgatttggctaatccatcaatcagcacattgtagcagtatgaatcaggcacaaaacctttagcaatcatctcctcaaatagctcctttgattggtcgaccattccagcttttccaaaaccatctatcaaacttgtatagaagatggcattcactgcaatccccttctcttgacaacttctgaagcatgcaactgcctcatctagtttaccaaagcggcacaagcagttaacgatcactccatatgtgactgagtcgagcttaagcccactatctttcatcctctcaaagagtgccattgcctccttctctcttccaaatttacccatcgagtcaatgagtgcagtgtatatagctgcattggctgcgcaacctcgcttcagcatcctttcaaacacagccattccctcgaatggcttcccatccttgcagagtgctccaatcaccaaaacataagcatgttgtggtatgtcgttccccattcccctctcctccatttcttggaacaaaccaatgcacaccggaaacgtgccttcactgtaatggcactgcatcagtgtaaggtacgtcaccttgtccggtgtgagcttcgcctgttcctgcatctcgctgagccgcgccatcgcatcatgcgccctcccggcgcggcagtaccccttgatgagaatgttgtaggagaccacgtcaggacgcacttgatcctccgtggacattgcgtcgaacacgttgacggcggtatcaagaaggccagcgttaacgaggccgtcgagaaggcagttgtagatcagcctggaaggctcgacgcctgcgaggcgcatggccttccacgcccacaggagctcctcggcgaggccgagagccgcgaggctgcggatcagagacgccgaagacgacggcgtgaggtgccgcaaggcggtgtccccgtgcgcgcgcagctcggcgacgagctgccgcgcgtgcgccgccgcggcggcggcgtcgggggtggcctccctggaggaggaggaggaggagtgggcgaaggagcggagcagcgagacgtagcagctcacgagatggtgcgggtgggagaggaggtcggcggcgacggcgctggggagggagcggtagaagtggagcgaggggagcgggttggggaggaggtgcggcgagcggagcgcggcggcgacgaaggccggggagaggcggaggaggaaggtcgcgcagaaggcacggaggtcggcggcgagcgtggcgggaggggagcggaggatgagggagacgacgcgggcgagccacggcgacggggtgggggacgaggaggcggaggaggcggcgtacgggcgggggtccgagaggtcggtgtacggctcgatccactccggcggcgggagcggcggctggtgggggtggccgccgtgggaagcggcggccactcgccggcagagcggaacgtgacagaatcgccgcattggggcgtgcgtgataggcaattaggaaccggaggaatatgttagagcatctccaacagttctccgtcaaactctacaagttaaattttaacaacttcagcacaaaatagcagtccaacagactctctactcaaatggccaagttaaatgcctgcccaaactcctccccccaaatttagccatccaatcagaatagccaaatgtgggccccaccatctctctcctctctcacccggagaaaattgacattgtgccatcctcaaaaagtgggtttcgcccaaatgccatgctggaagtgggcttcgttaaaatgccactttcaacacatggttacacgctaaaatactatctcggaccaaattaccctcctctcatcttcttcctccctccatcaccatcagctctcgccggcggccaccatctgccttcgcgcgagctctcctccatggagaaccacaggccacaggccctgcggggacccctcccatggctcccctccccgtgccccctcccatccgccaccatcccagccccgccctccgcgagcccccgcacccgtcccggccaccgccgccgtcgcctgcacctccgatgaccaccgcgccgccccttcgccatggccatgcccaccaacgactccgccgtgcgggtgcgcctccgccgcctggaagaacgggagtggctaggacggcgggttggcatgaaagacagagaccgccgacgtcggcgtcggtggcgcggatggcgtggagcgtgaccacggggtcgtcggttggggacggtcgaggcggggaggaagtggtgcggagatggaggcggacgaggcgggggttgtcggggaagaaggggagcggaggtagaggcggatgaggtgggcgtggcagaggcgagccggctcggcatcccttgtcagaggtggaagaaggtagtacaggggtatttttgtccgttcgggcattatagcgtgtagtcttcgattgaaaatggcattttaataaagc

SEQ ID NO: 33032 - DNA, 4415 bp, Oryza sativa
ttgagaatggcacaatgtcaattttctcccgcccccaagccgccgcccccagaccgccgccgcgccggccgccgtcgcccccaggccgccgccgccgccctctgcgccgcctccgccgcgcgccgtcccaccgccgctcgccgctacgggaggcttagacggcgcctgccccgtcgcgcagccgtcgccctccgcccaccccgtcgttcgccgcagccgcggccttcgctcgctgcagccgtcgcgcagcctccgcccggcccgccgcagcccggcgcctccgctcgtcgcaaccgcggcattcgctcgccgtggccgtcgccccgcctccgcccgccccgccgtggcctttgctcgccacagccgccggccttcgctcgccttcgcctgccccgccggtcgccgcagtcgtcgccccgcctcagctcgccccgccgctcgctgaggcactgcccgtcgccccgcctccgcccgtcggcacgcaagtcgtcgtcgccgttgccgtccgccgtcgccgcaccgagataggtgcgccagtggggaaggggaagtagtactggagggagaagggagatgtaatatggccatgggtggggaaaaaaaagatggaagaaggtatgttgaggctgacatatgggttttatttgtcattgacttgtaatggaaatgatagatggagaggctgttcgagtaaacaagagtttgacttgccaaattagatggagagttggccaaatagacatttggagagtcaaaattggagaggctgttggagatgctcttagtgatggtgatgactgatgaaacatactccctccgtaaaaaaaaaatctggacagatatatattcagattcgttatactagatgtgtcatatctattactaggttgattttttatattcactactaggttagttttttatgggacgaagggagcaaggctcttggaaatgcagaatcgtcaatacccggaaaagaaaaaaaacgttaaaatagatgccatgtttattggatttttatgaaatttagaaacatagaaaagtttcaaaaatgttgtttgataatcacaccgaaaaacctaggaattcaagaccagaaaacatgaggtaagacctcatactaattttcctacaaaatttccgtataatagtccattcctaagaatttcaaactgaataaaataattataatgcacgggcatataagtagttgctgaaaaataggacaaagcaaaatagagagtataaaagtgagaaaaaagaaaagagaaaaactatagagaaaatattatagttcatatattacaatgttagcttttatatatgggcttatagccagcatttagctctactattaaacttgctccatgggtgtgtttagatgagcaattggaatttgcttttcctcgtacacaaaacgaaatggattattggtgtatgattaattaaatattagctaatttttttaaaaaaatattaatatgatttgtttttttgaacttagttatggtgatgcacggagttagtataaaatttcctatctctctactactttaaaaaaaagacatatttccgttaatatctacttagtgattgagaagggtctattatgtgctctcatgcgattagccccctcactgttaatatctattcacgcatttacattgaactgataatcggacaaaattgcaacttggcctctttttcttagcaagattttatttatttttattatgcagacaaatctggcacttaatttagggtgtgtttagataatgggaaatggggggtggggttgtgatttggaaatgaatgaagggttagtattaaatggaaaagggagaatgaatggttacgatttaaagcggcgcatcgagcttgtcaacgacggaccgacctcggagttgcggatgaagctcccgtaccaaacgatggcgccgctgagctctcgccatatccgtcggctctggccttggacggaggtgacatctcggcagcggtggcggcacatcgtcggtggcagcccgaatacggcgtctcggcagcatagcagctcgaccgtcgccatcttcccttccttccttctcatctgacacacacatagcctcagagataacgcaaagctccgacacactaacgagggtgctttgtttggctccgcgttcttcacttggtagcgggcggagcatacgtggcagggaatctggcagggaatctttgatgtggaagcccaacgagattgcgaatgggcgaacagtcgcgcgccccctcccctgcgcgactggacgcgtgtcgcatgcggagagggggcgcgcgggcggcggcacagcgcacggtttttcttctttttttcccacaattccgcacggtttcctctcttttagttttttttgtttttttctttccgcggtttttttgtttgtttttttgccgcacggtttctttttttacttttctttccgtatattttttattgttttattttttaatacgtacatatacatatacaaagtttgtatatgtgtatttttatatgtacatgtataaactttgtatatatacgtatataaagttggcatattttgtatacatacatatacaaactttgtatactacgtatataaacttaatatatgtgtatatattttttataatatacatatgtcggtgatatgggaccgggagtatcatgaccagaggcttgaggcagacgcaattgcccacgtggcctggcaccttcggggacgtcgggcccgagggtgaggtgtccgccctcctcctgatttcccccgagggggggggggggttgcgcttgccccggccccgagggccgaggcaccccgaccccttaaggaagtctgcgacacatatatgggataagtgagcacagctgtgctcacctaacagcatttattgcagtctggtcaagcgtgtcacgctgcatgcgacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccagtcagacgctggtcgcgtcagcaacgggcagccacgatcccacgttgcgcctgtctccgccgggagtggaggtaggtgtgggctgtcccatcgaagtgtcattcggacagcgaccataccaatctccgtccataaagagaagaaaagtccagtttggaaagggaagggtgcatgtggtatccccttgaagtataaaaggaggaccttgcccatagagaaggggttgattcttttcgagattgagagcctagaacgggggagaagtcggctcacactttgtagctccttcatacacagatccaccaaaacacaggagtagggtattacgcttctcagcggcccgaacctgtatacatcgccggtgtctcgcgttctcttgctagcagacaatctttccacaaacagagagagcttgagatctcaccctaagcccccggccgaaccggcaaaggggggcccgcgcggtctcccggtgaggagccacgagctccgtcatctggcgcgccaggtagggggctcagtgtgtgttttctgagctctcagactcttccgtgtgcgccaagtttttcttgttcagcctaatggccgagcaaggaaaagcgcacgatctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctagcgcgctcctacgtcacccacccgtcgtccatgaccctgagtctccagctcagcgatggctggacgacgtggccaacttggtcgtgacggcccagcagcgcctgggtgctggttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaatgcattaacaggatttttagtggaattttcagagctctagaaataattttaaccaattaaaaatcactaaagtg

SEQ ID NO: 33033 - DNA, 25287 bp, Oryza sativa
tgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaaccgttttcgcactcaatttctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccccggctggtcctggacggggggttttaatacacattctgcttggaattctattcgggaatttctgggcgtgacaagttggtatcagagccgaccttgaccgtaggacaagccaaatggaaagacctaagagccctctgaatccttttcattgcatatgctctttgcaattggatttgttccgggaaaatggggatctgttcttgtggttcaagggaaaaatcttggtcgctcgtttaaagtgagtttttcaaaacgagtcagtctagggttttagtaaaattattgggatttattcgtcagtcagttggggtttgaggggtgaaatgcattaggtcctagcccggtaacatgggttgcaaggtgtttatgctttgttcgttattattattatgtatctaatttcccattattttatcgttatgtgagtctgtcttatttattcgctctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgacgattccgccgctcagtggcgagcttcctcaccgtgtccgcttggaggtccatggttacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcacctccagttccgcccgcagctccggcagttcccgcagttcctccagctccagctccagctccagctcccgcgttcactctctccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccgaccgcaggagccgttccgagcattaggctcgttttcccattagtttatcgattgtctagtttctgcttgttagtttgtgtgtttaggttgcttgtttggggtcagttgacggtcgatatcatgtgcctatgatatggctgtcttaataaggatttttgtttgctctttttaagtgtttttaattcagatcagaacaattgcagttttaattcctatataataaagcttagttcttgagcatctgtttttcttctcttccccgtctgctcttccctccagatggtttacaccaggactggcaaccgcacgacaggcgagggcagcaacggcgaagaacgcgtggatggtgtgcaccccaacagtgattctggcaatggtccgccaccacttcccgagaatccgacccttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccggagtttctacgtgtcaggccacccaccttctccagcaccaccaaccctatggaggcaaatgactggctccatgcgatagagaagaagctgaatctcctgcagtgcaatgatcaggagaaggtcgctttcgccacacaccagcttcagggtcccgcgtcagcttggtgggacaaccacatggccacccgcccaccgggtactgaagtcacgtgggcagagttctgccgtagcttcaggaaggcacaggtgccagacggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggagaatcaacgcaacaagatggacaggaagaggaaggccgctcagttcagggcaccccaggaaagtcaccagaggtcgcgcttcactcccgggcaacagggtggacctaccaccatgattgttcgtcaacaccgcccgttcaaccccagcaacttccaccagggctccagtggcagccagaatcaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccaatgcgggttcataccccagggaatagctccacttcggttcaattcagcccttctataacaatagaaattcaaaggtcaccgtttctagccaacctcattcttctcgaatccaaagacctagatgtcattcttgggatggattggctgaccaagtttaagggggtcattgattgtgcgaatcgcacagtcaccctgaccaatgagaaaggagaaaccgtggtgtacaaatctctagtctcgccaaagaaaggagcctcgttgaatcagattgagacggaaatcccagtggacgccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgtggtattcatcgacgacattcttatctattcaaagtccgaggaagaacatgaacaacatctccgtctagtactcgagaagttgaaggagcaccagctatacgccaagttcagcaagtgtgacttctggttgacggaagtcaaatttctgggccatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtatcaagacctcaaggaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcctgggacaaaagcttaccatatgcggaattctcgtataacaacagctaccaggccagtttacagatggcaccgtttgaagctctatacggccggaagtgccgcacacctcttttctgggatcagacaggcgaacgtcaactgttcggaacagaagtattagcgggagcagaagagaaagtcagaatcatcagggagagattgaggattgctcagtctcgacagaagagctacgcggataaccgtcgaagggagctaacttttgaggccggagactacgtgtatcttcgtgtcactccgctccggggagtacaccgtttccagacgaaaggcaagttggcaccacgcttcgtgggaccatacagaatcttggaacgaaggggagaagttgcttatcagctagaacttccatccaatatgatcggcatccatgacgtgttccacgtgtcccaattaaagaagtgtttaagggtacctgaagaacaggctgattcggaacacatcgatatccaggaggacctgacatatgtggagaagccggttcgcatacttgataccagtgaaaggagaaccagaaacaaggtcacccggttttgccgagttcagtggagtcatcattcggaagaagaagcgacctgggaaagggaagatgagttgaaagccgcccatccgtacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaatgcattaacaggatttttagtggaattttcagagctctagaaataattttaaccaattaaaaatcactaaagtgcaatttttaattccaaggaaaacccttttcttttttttctttttcttttccctccctttttccctccttttttcttttcggatgggccgccggcccattcccctccttcctccccctcctccttgctgggccggccgcaggccgagggcccagtctggcagccgccgcccgcctcctctctcggggtcgccgacaggtggggcccacctgtcgggtccttcccccacctcccgccgatcccggcgcgccgccgcgccgaaaccgccgccgcgcccacgcctccgtctcttccgggccacgtcggccacgcccgcgcgtgcgccgcgtctcccgcgccctttcccctctccctcccgttcgcgcccgcgcccgagatggccgggattcgaaaaccgaatcccgcctctctctcctccccactcccccacgtcggccgtcgaatcccgccgctcccggccacgtccggctccctctccccctttttaagcatcgccgtcctcctctctcgctttttccccatttcgccgatctctcccgagctccccatcgcctccgcgccgtgcaaccacccgccgccgccgcttttgctactccggccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcgccatggccgccgccttcggccggcgctctcgccctcccacgctctttcctctctctctaatccctctccttttgttcgttaggaggttccggagctcgtcccgccgtcgtcgtcgtcctccgtcggccgccgtcgtcgaccgttgtcggtgaggcttccccctcctctttctccttttccccgtaccgtgtagccgcgtgcgcgccgcttagccgcgtagccgccgctcctcctctagccgccgctccccgccgccggtcggtcgccgtcggtcgccgccttgcgccgctgccgcatgcgcgccgccgccgtgtgagcgccgcgccgccggcgccatggtcgccgccgtctcgcgccgcgcccgcgcgccccggccgcgaggtcccgccgccgtccgatctacccttgggtagatcagggccgtcggttcggccgccacgtggcgccgccgcccctcctttcccccgtgccgctgacccgtgggcccgcgcgccgctaccccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccggtgtacttcgagatagtcgccgaggtccctccagcagcagagcaaggcaagtcatgcttgtcacttgaacatgttgatcctgtattgcaaatgctctattgttttctttcaaatattgcattgttttataatatcactatgggatggatacctattgttacagccatgcttttggatatcatgctcctttgttagcttgggttataacatgattagactttggactaggaatttcttagccatgcttagttcaactagcacacattggggatctcatttaaaacctagactataggtttatatgataatgttggtttaataccaccgcgctggtgttggttaaataaaatgaaccacatggtgggctgtgggtgcatggttttgctagtcgcacccatggtagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttatacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaaccgttttcgcactcaatttctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccccggctggtcctggacggggggttttaatacacattctgcttggaattctattcgggaatttctgggcgtgacactggtggacggtccgccaccaccaagacttccggcgccgccaccaccggttccgtgtcatcaaggcggagggcgcggcgagcggcggcggctgcacggcattcggctgccactccctcgtcgacaccttcgactcgggaggatcagcatggggagccggatgcccgcctcaacatcgagcgccggcgtaatagccggcgtactccccgtgcaacggagggcgcctcctcgtccagagtgtcacctcgacatggacgtgaggatcagccctctgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggagacgacagggtcatggcgaatttctttcccatggccctgaagggacaggcacggggttggctaatgaacttgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagggcgctccgcgggccacccgaaaggggaggcctgcgagcgacaaaaagaaagaggctggtactcccagccgggagcgcccagccagcaagtggtgctccgtccacaacacctccctccacggtctcgcggactgtcgcgcagtcaaaaatttggctgagcgaacgaggaagtgggaggaggacaggaggcaggaacgccgtgagggcaagtccgcggcagttccctccgttaaacggcgaagtgaggccagacaaaaggcccccgccgttgaccccgatgacggtgatgatgacctaggtttccaagaacctggggccaccattgccactgtcgacgggggagcgtgtgctcacgtttctcgccggagcttcaaggctatgaagcgagagcttctggccgcggcccctactcatgaggcgacgcgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccctgcggcctttgatgctatcaaggccccggggatggtgctccagccgtctcaaccgatcgtcggtgtgacgccggggcacacatggccgttaggtcacatcgacctaccggtcaccttcggtggatcagccaacttccgcacggagcgggtgaacttcgatgtggcggacctcggtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatacgacgaggtcccggtcaaggaggttgccttgggcgacggcccatccaagaccacacggatcggtggtcttctggatggcaaataggaagacgcgctcgtctccttcctgcgggcaaacgctgacgtcttcgcctggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcattcccaaggcgaacggcaagcttcggatgtgcatcgactacaccgaccttaacaagattaagttaatttgtacaaaaaagaggcatgaaggccttagaagaaagaaaaagaaaaaattggagattggcgggggcctgggggctcattccaatgcgcccgggtcgctggccccgtcgccaccgtcgtcctcgccgctggcgtcgccctcctcgttggagctgggggcgaacgcgagccgaggggccgacccctcgaagctttggacgatgtggttggcggcatccccgacccgcgcgcgcgcgtcgtcctcggtcccaggagggaactcctccagcgccatccatggagagaagttggggtcccgggcctggtagctcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcatgcgggagaccgcatcccaaagcatgtcgggcccaatctcgcccgccaagcgaagggcctcggcctccccggtggaggaatccagcgctcgctgcatatcggcgacggtgtgttcggcagctgcgaggcgggcggctaagtcgctttcgcccgcggccgccccaccgatatgcgccctcgcgtccagctccttttcccgcgcctcgagatcagcagcccgctgctccagtgcggctctctcggcgcggacgcattcaagattgcggcacgcctgctcctcctgcgccgcctcgcgaagggacaggctgtccgccagccgtttggtcgtggcctcagcctcctcgagagctcgttcccgctcagcgagtgcgtcctcgcggaggcggagcgcgcactcctcttcggcgcaggcggcctcgtgcgccgccagcgtcgtctcccggagagcagcggcggcctcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacatgctgggctcggggatgtcccccggacccgtttgatcctgggcgtcgcccggggaggtgggcccaggcgatgtgcccgcggcctcgtcgcgagcctccccggaggctgtcgcctgagggttgcccgagggagtgggcccagttgacgcgccagcagcagctgttgcctcagcctggcgagcccgggcggccacctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgaagacgaacctgcgagggggtcggttgaatgaccaccttggaggggaaatcaggtttccccggcatggttccgtctcccccgtcttgcggagccttttcttcttgcgctccccctcgagctgcgacgtcggcgcggccccctccgggcgccgactgctggcacgcgccgccccgccccctcggggaggagatgggggggggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgcagcagagggggaggatctcctgaggaatgcgagacgcctccacggagctaagattcagcaccctttggaccacgatcttgaagtcctcgggagcccaatcccatctggctccctggtgggtccgcatgtagtcttcagacccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagagctccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacgctgccgtcgtgcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcaaaatggattgttgtcgcgtcccaaatcgactctaaaattcatcctcaaaattgtgcaaaagaataattaaaaatttaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttgaaaaggttttataaaaagaaaaatcctaaaagaagttctttcccccccccctttccctcttgggccggctcggcccattccctccctctctctctctcttctcccgcggcccatcggctccccgcgcgcgcgcgcgccgctgacaggcgggcccgcccgccactctcgctgacgggtgggacccacctgtcatctccctcctctcgccgcgcccgccgccagcgcccgtgccctagcgccgccgccgccgcgaatcccgccgctcccgtccgccccgcgtgcaatcaagaggggggaattaatccccgcgttcccctcccccgtttccccctctttcccctctctctctccctcggattcgttcgaatcaagcccgtaatcgtcgccggcgcaatcaatggcgcccgaaatcttcgcgaccgattcctccctctccggccgctctttccttcccccggcgctatttaaacgttgcccgagctccgctcttccgtttccgccgctcaccgctcgctctcgccgtcggaatcgtgctagcgccgtgctcctctctctccgccgtcgccgtcgaccttcggttcgccgccgccgccgctccggacctcctcctcactcggcgacacctccgtccgcttcgccgtgtcgccgtcgaccccgtccgccgctccgcttcgcccgtcgaccgccggagcaccgtcgtcatcgtcttcccgaaccgcgccgccgtcttcttccgcttcggccgccatttccgccgccttcgctgtctcggggtgagccgtggaccgctccgttcgtttcccccttccctcctctctctcgggtgccgctccgccgcgccgttggtcgccggcggcgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccccaccccgtggacccggtccgcgcgtcccctctctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgcaaagaacccatttttgtgctttgtttctgctgttatgtggagttatttagtgttaaagcctttttcttttccgttggtcgtgtagacgctgcagcttcggaagatccgctcttcgttgaagtcgaagccgtcgattgggaaaacgagcaaggcaagacacatcatcttgatcatattgaatcccagtatataaaattatgttgatttaaattattgcattatcgctttatttaaattcccgcgttatcactgttttacttagccatgcctatttacctttgttatgaccatattattattgttattgttattattattaccttgttcaccctaggcaaacaaaacctcaactagtggactctctactcatggcaccactagtttaattttaggtagatgcttcgcaatctaattaggtaaccttaggtggttttacaactatagactttgggaaattttcatatcacctggacactatggaattgttggtttatgatggaattggacatacacctctcttcccctttcaaaacccctaaaacctgttttcggtggggtttgggtgcatgccagttgtgggaagtagcaccccggccactataaggattaagctcgggcctctgttgcaaagcactatcgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctactgcgaggggctcagttccgtctgcctgtcccgggggttccggccgtaggcggaattgggtcggtactcttgtctaaggctaggatgggttagaaactatgtcacgtcttccgtctgtataccgtggtggtatgtggcacgtggttacacgtgaggaagacgtgtcttgtgggtaaagatgtacacctctgatcagagtataatctattcgaatagccgagccctcggttaagggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgtgtttacaaaatggccttgagcaactaaatgtctttaaatgctgtttactgcaaccctaacccctctatgttataattcctttgtactcccttgcatttattctgcatttgtgggtgtgtcttgttgagtacggtggttgtactcagtcttgcttaattttcccaagcccagatgaggagctccttgaagatgaaggctttggtgtctagctcgtgcctgccgtcaagcgcctgtggtcgtcgccctagtcttccgctgtttttcgttgtctttgtgtgctgggccgttgttgcccgtgtaataattttatatacgcttccgcttgttaaactctgatttgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttgttatttgtgaaaactgtctagtctctctctgtcttgctgcttcatttatcgtcaaaatctgatctttgaaaatattgcttttcttttctttgtttgtagatggccggcagcgtcacccgtcgtggtttggacatgactggcttcgtcttggagctgcgaggcatgtgcgtggtcttggggtatccacacggagtggattaccaggtcaggccgctcccggagcaggagggtgaggatgcagagcctcacgctgcttgggaggtcactgcagtgatcctctccggctctcccgagcggacttcgctgacagtcaccgcgggtggcgactccttccccgccgcttgccagaacgccgctctcctcgccatcggcactcttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtcgagaacaacatgaagatcctggagctgcgtcaagagaatctgcagctcaagaaggacctcgacgcgttggaggcgcagctgcatcagctcaagatcgcccagggagagatcagccgccccaagcgtcgccgcgtctgccgcagccagaagatcaccgcccgcaagagcacctccaggcccgagcttgttcgtcagtccctggcgtggacttgcttcgtcgagaccccttgtgccgagcctgcgcccgtggttccccaggagggggaagcctccggcgttggtagctcggagggtgcgctgttgctcaccttccgtcctggcccgtcgcagcggtagacgagcagttagtaggcctgcgcgtgtgtttttcttcgtttttcttcttgagttgtgtggggcatggttatgtcggtgtgtgccataactgtgtcggagcctgtcttattttatttgcctaagcaacttgaaccttaatgaaccaatttaatagcagtgataaatttaagaataatagtagtcgtgggtggttagttttaatcgtcagctcttcttctctgtttgctggttccgtgtggggttttcagatggtgacgaccaggagaaatgttaacaccggtggaggcaaccaacccgaaggcagcaaccccaacccccaaggcaacccacctccaccaccaccaccagacaccaacgctattctcacccagatcctcgcccaacaagccaacatgatgaatgctttcctccaccacctccaaaattcaccacaacagaatgctccaccaccccctccccaacactccaaactcgccgaattcctccgcatccgcccacctaccttctccagctccaacaaccctgtggatgctttggattggttgcatgccgtggggaagaagctagacacggtgcagtgcagcgacgaagagaaagtcatcttcgccgcccatcagctgcagggacccgcatctctctggtgggaccatttccaggccacgcagccagaagggcaaccgattacttggactcgcttcaccgccgctttccggagaacccatgtgcccgctggagtcgtggctcttaagaagagggaatttcgggagttgaagcaaggcaatcgctccgtgatggagtatttgcatgagttcaacaatctagcccgttatgccccggaggatgtgcgggaagatgaggagaagcaagagaagttcttggcaggaatggaccctgagctgtccgttcgtctcgtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctctcagcagcagcagcagcagcagcaacctcgctccgcgcctcgacctcaattcgtggtgcgcgtcccacagcagcaacagcagcagaatcagcaagggactcgtgcgccacgtcctcctacgccaactgtgcagcctgttcaaggtcgcagggacgcttcaggtccgcagcgtctgtgcttcaactgcttcgagcccgggcactttgcggataaatgcccaaagccaaggcgtcagcaaggccaagcgcctccccgctccaacaacggtggcaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtattatagccctgccgttcctatagaaattcaggggattccttttccctcggatctgattctgctagacaccaagaacttggatgtgattcttgggatgaattggttggcccaattccaaggggtagtggattgcgcgaggcgcactgtcactctgtaccgagggccagaacaaccggttgttttctttgcacctccaacctctgtcagaagttcagaactgcatcagataggtctgtcagaaatccccatcgtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatctgttcgatcagcttaaaggtgccaccgtattctccaagattgatcttcgttccggatatcaccaattacgtattcgtgaagaagatattccgaagaccgcattcaccacgcgatatggactgtatgaattcacggtgatgtcgttcggcttgaccaatgctcctgccttcttcatgaacttaatgaacaaagtgttcatggaatacttggacaagtttgttgtggttttcatcgatgacattctgatatactcacaatcagaggaagaccatcagcaccatctccgtttggtattgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacctaagacagtcactcaaatccgcagtttcttaggtttggcaggatactaccggagattcatcgagaacttctccaaaatcgctcgacccatgacacagttgctgaagaaagaagagaagtttgtgtggagcccgcaatgcgagaaggcgtttcaaactctcaaggaaaagctggtttcctcgccagtgttaatcttgccggatactcgcaaggacttcatggtgtattgtgacgcttcgcgccaaggattggggtgcgtgctcatgcaggacggtcatgtggtagcctatgcttcacgtcagctacgacctcatgaaggcaactaccctacgcatgacttggagttagcagcggtggttcatgctctaaaaatctggcggcactacctcattgggaatcgctgtgaaatctataccgaccataagagcttgaaatacatcttcacccagtcggatctgaatcttcggcaaaggagatggttagaactcatcaaggattatgatgtgggaatacactatcatcctggtaaggccaacgtggttgccgacgctctaagtcggaagagccactgcaacactctcaacgtccgaggcattccacccgagcttaatcaacagatggaagccctgaacctaagcatagttggtcgcggatgcttggctgcgttggaagccaagcctaccttgctcgatcaaatccgcgaggctcagaagaatgatccggacatgcatggactcctcaagaatatgaaacagggtaaagccgcaggtttcacagaggatgaacacggaaccttatggaacggaaagcgggtatgcgttccagatagcagagaacttaaacagctgatactccaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccagcctctccaagtgccggaatggaaatgggatgaaattgggatggatttcatcaccggccttccaaaaacccaaggtggatatgattctatatgggtaatagtggatcgattaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcagattctagaagatatgcttcgcgcatgtgtcctagacttcgggaagacttgggataagagtctcccctatgccgagttctcctacaataacagctatcaagccagcatacaaatggcaccctatgaagcgttgtatgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcagacaaaagggaagctcgcacctcggtatgtgggtcccttccgtatcatcgctcgacgcggagaagtcgcctaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaagccagtgaaaatcctggacaccatggagcgcaggaccaggaaccgagtaatccgtttttgcaaggtccagtggagcaaccacgccaaagaagaagctacttgggagcgcgaagacgagctgaaggcagcccatcccggtctcttcgctagttcttccgaatctcggggtcgagattccgtttaaggggggtaggtttgtcgcgtcccaaatcgactctaaaattcatcctcaaaattgtgcaaaagaataattaaaaatttaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttgaaaaggttttataaaaagaaaaatcctaaaagaagttcttttcccccccctttccctcttgggccggctcggcccattccct

SEQ ID NO: 33034 - DNA, 23979 bp, Oryza sativa
  unsure (1)..(23979): unsure at all n locations
cgctgtttttcgttgtctttgtgtgctgggccgttgttgcccgtgtaataattttatatacgcttccgcttgttaaactctgatttgtatcaacttttggtgtaccttgcctcctgggacaaggaataatacacgcacgtcaggaacgcctgttgggtgatttccggtcgtgacaattgtatcgtgcgcgcgttaattatgctcgccgaccgaagcggcgttaccgtatctccgggcgagacaaatctactcacccagattcgcgcgctgctcaattggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaattgcccacgtggcctggcaccttcggggacgtcgggcccgagggtgaggtgtccgccctcctcctgatttcccccgagggggggggttgcgcttgccccggccccgagggccgaggcaccccgaccccttaaggaagtctgcgacacatatatgggataagtgagcacagctgtgctcacctaacagcatttattgcagtctggtcaagcgtgtcacgctgcatgcgacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccagtcagacgctggtcgcgtcagcaacgggcagccacgatcccacgttgcgcctgtctccgccgggagtggaggtaggtgtgggctgtcccatcgaagtgtcattcggacagcgaccatacatctccgtccataaagagaagaaaagtccagtttggaaagggaagggtgcatgtggtatccccttgaagtataaaaggaggaccttgcccatagagaaggggttgattcttttcgagattgagagcctagaacgggggagaagtcggctcacactttgtagctccttcatacacagatccaccaaaacacaggagtagggtattacgcttctcagcggcccgaacctgtatacatcgccggtgtctcgcgttctcttgctagcagacaatctttccacaaacagagagagcttgagatctcaccctaagcccccggccgaaccggcaaaggggggcccgcgcggtctcccggtgaggagccacgagctccgtcaacatacatacatacatacatacatacatacatacatacatacatacatatatatatatatatatatatatatagacacacactttatatacatacatataaactttgtatacgtgtctatataaagtatatgcatatacatgcactgtacagagagactaaaacgtgagaaactgatcgaacggcacgcgaggggcgcgactgatcgccaatcagtgcctcccgaatcctgaggctgaatgacataagtgtgcattgtgagaattgtatccaatgtgtagctttgttctagatggcatagctttttcaagtgaagcactatggatggccttgggaggtcagtcgcccccccccccccccccttctagtctctcttacagtatacaatgtatatagtatatccatacgtgtgtgtatatatatagtaatatatttttaatgcataaaaaatatatacacacaaaatttatataggacgtatacaaattttgtatacatacgaatacaaacttagtatacatacatgttaaaaacacccggaaaaaacggaccataaaagaaacaggaaaaaaaagaaaaaaccaaccgaagagaaaaaaaaaacagaaaaaaaccaaaaaaagggaaaacccgctcctccctcatcccgcacggcacgtctaccgtcctctctctccacgcgcgacatgtgtccagtcgcgcggggaggggcgcgcgactgatcgcatatactagcaatctcgcttggagcaggtacaatagcaggctataaggcagctacaaacatattttaatgagataaaagatgagagagaagagcagcaggttacagatctgtagccagctgcagcacggacttcaagacacagtgtgtgtatgataggtgggaccatatattaatagtatagtaaagcatctattgtataaattggctattagattggctataaacgaattagagctagtagtgggctatactatactattaaacttgctcttagagagggcggcgaacttatcgcactggcacgcgaccacccgcgcatcagccagcccccacatgcattgtgtccgagcgtgacactgacaactacgtctcatgtaggggtggaaaaaaaagctcgggctcgtgagctcagctcggacttggctcgagcttggttggcttggctcagctcgtaagtcaaacaagccaagcccaagcctcctttttagctcgttgctgaaatgagccgagccgagctagctcgcgagccgcttgttttggctcgtaagcctaggccatcgtgtgtttatattgattattttactttatatagtgttattatttgtcaacttgaaatttatcattaagattttgaagaattgaatataaaaacttatttaaattttacatgttgatgatttgtttttacttttttttaataattattaaatatatatgaagaggtgtttcaacagaaaggcttgcaagccagctcgagctggctcgagccaggaaacgagccgagccgagcttaagttttagcttgtttttctaaccaagccgagccaagccaagcctagttttttgcgagccactacaagccaagccgagccaggcttgactcggctcgtttccacccctaatctcatgtatagttggccatgtgggccgcccggcacggcacggcccaggcccggccgtgcctgggccgaggcttgtcgggccggcacggcccgaccgacgcaccgggccgtgccgtgccagcccacgtgccgcactcacggcccaggaccggcccaacacgcctcgggccgtgccgggccggcccgaaggcacgatgggccgtcgtgcttttcctcagaataagtttaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataatctcatggcatacgtacgtactcccgagtcggacatctctctgtcggccgttggttctatcccgagtcggacatctccctggcctcccggtgcatatatacgcttcgctccatataaggtacgagagagcggccgcccggcgtgatcgatcgatatcaaagtatagctagtagaacaccatggatcagaacggtgctctttcaggagctggaagatcaatctcatcaacgacaacgaagaaggccgaggcggcgtcgcggtcgccgcagcagcagcagccggatcacgacgtggaggcgatggaaccagatgcggagtgggaaatactacgcccgttgtcaccggaccctcctgagttggaggaggcgctgcgacggctagcggaagccgagcgtatcacgggcgacgagagagctgctgccgccgcccgcgcgaggcccggggagaagaggtccgtgtccgagctgccggcgggctggaagtaggagtgggacgactccgtcgcgatggccaagcgctacaagtgcaactactgggacgaccctgcgtacgatggcgtgctccaggatatcggtcctctcctggctcgtggcgccgccgtcatcaactacgccgaccgcgacccctaactaagccttgcattccttgagggaaaaaaaaacagattttctttctttctgtgtttgtttgatcaattagtttttatttgcacatgcaccgtggtgcatatatataagatgtacatttcgctaagaaatactccctccgtttcacaatgtaagtcattctagcatttcccacatttatattgatgttaaggaatctatataaatatatatgtctagatttattaacatcaatattaatttgaaaaatactaaaatgacttacattttaaaacggatgaagtagttgtcagtcgataataaaagaagtaaataactcgatggttaccgaccctctcattctcttttgcactacccctcctacaagaacatgctcagaactggctcgtggctgtttttttttctcttttctttttctagttttttttaacaaaaatatattaatataagatatatccactatataaacatgtaaaattcaaatttagatttatacatgttgtaataaaaataacaaattgtataagttaaatttgaccttgtatacaatttgcgaggtgatatatcacatattatttatcttataaaaaaatttaagtttttttatgaccatttagatggtatgtaagagaatgacggaatgtcgtctactgaaacgaccaaaaaccatctccggaagatagagattatattatgtggcaacactgaattagcacaggtcaacagtacgtgagcacgatcacaaagaagaatgttgtcaaccaacatgcatattaagtatcaatttgcaaacaccctaggcttgcccaagtaatagtctataacagagaggcaggcaggagttatcaagctaatactaataagagagcaaagtgctaaggagaagaaaccgatatctagtaggaacaaaccgaagatgaagtcaaaatagttggagctagcagaaagaggagggagggaggacgggcgaagtagaagaagatcgagtagttagcctcctttgcgaggcaaaagatgagacgggtgtcgacgcagccgggggggaggggagatgggtctcgtctgcaagttcaccatcttcaaccgcagttcggacgcccgtctcgaatgagaatcatattgcttgatcagatcgtcaatcttggcctcgctgcgttttgtggaatcaattgcagatgcccagtcccgcgtcttcttggctatttctctgttctttcttcgttcttcaacctctcgctcgatcttaacccatacggcctccatttgctggtacaccactcccagttcaattgacgccgactcccgcgcggctgacttgtcgtccgcgaccgcgacgacgacggcctcgccaccctgcgccgcgtcgccgactcccgccaccaaggcctgcggctcagcgccgacgcccacgccaccctccacaaccgctgggcgaacacgcagcggcagagccccgccaccctcgacgtcctcaacagctccctcgaccgctgggcgaacatgcagctgcagcggcagcggcggagccccgccaccctcggcgtcctcaaccgctgggcgaacacgcggcagtcgagcctggtcaccctcgaccgctgggcgaacatgcagcggcagagccccgccaccatcggccgctggcggaccacgcagcgacagcaaagcctcgccaccgcgcctgccgcgcgcctcgacgcgacgaagcggggccccgacccgaccacggactcgccaacgcggcgaacgcagacgagcaggtccttgtcgccgccgccgcaaatctgggcgtagagctcccttcgaccactgcggtctggcaccaggaagccccgaactgctgcgcccggtgagtacgcgcgcttgctgtccgtgacttccaaaacgggaagccagaatggcccgtcggtgttggcgccgatcttgggcaaccacactggagtatgaaggggtggaggaggaggaggaggagaagcgacggcaacctggctaccgtgctggcgtcctctctccacgtccacgacttcgccacgcacggcccgagagggagcagcgtgcccacctcctagtgcgtggccacgagcgacgggatggagatcgccgccgcggcgtggctgctggcgcggaccagcaatccattgggcgggatcgcgcccggcgccgcctcgtgccccagcaccatcgagctccagctcctccaggacgccgcgtcgcggttgccgtggttcccccgcgacgaggccgtggccgccgtggcgtggctgaggacgtggtggaggagcctcattccacgcggcgcggtggggaccgacccgatgaggagggcgctcgtggtcgtggaggccgccaaaccgccgcggagaagcatggcgaccaccgccctggccgtggcggttgccgaagggaagccggccgcgggcgcggcggcgtggctgtggcggagcagccgccacccatggcgcgcggcgcggctcggccgcctgttgattccgcatgttgcgtgttgcgcttgcggttgcggaggaggaaggcggttgcgaatgcggcggtgggtgggtgagggaagggcggcgattggggtaatcgtggatgggagccgtggcggaggggattttattgaccggcacgcgctgcacttgcacgagcgcgcggcggcaagcggctcgatctatcgacgaggatgagaggaatggagaggcaggtgggcccagcctctctgcttccagaagcttcgatacaaagctctgctctctgcttagcttccgctgcaagccagagccgagagggaagggaagaagaagaagaagaaggccgttgcatcgctgcttgtcgatttctctgatttatacctcgtccaatcagtagtgtacactgcacgtttccttccttggccttgccaccctaccactcgcgccttcctcgccgccgtcagcgataccttcgccgtgctcctcgccaacctgtcatccagcggtggtggtggcggcggagccactcgccgacgcgccggcgttggccatggcgtagtgccgcccgtacgtcgcgggagcggactgcgtcgcgtgcttcgacgccggccgccgcgtcgcgcctccgcgccaggtgcggcgccgccaacagcgggcgcgccatcctcgacggctgcgtcgtgaggtacgagagcgccgcctgcctcgacggcccggccacgctgcctgagaacacgcaggtgtgcaacggctccgccgacgtcgccgacggcgggttcgtggacgcagcgcgtgggctggtcggcgagctcgcggccgcggcgcctcgcgcctcgtggctcgcggcgtcccagtgagtggagactgttggggagggcgggtgcacgcagtgccaggaggtggcggcgaggaacatcgacgggcggccgccggactccgacgggcgcgccatggacgccggctgcttcatgaggttctccgacaagccgttcttcccggcgaacgcgacaatagaccgtggcggttgccaaatgggagccgaccgtcgcggcgcattgtggtggtcacgccgatgcggggaaaccagcatctccggccgcttcgctggcggcgatatcggaagggtggagccacgtcgtgcggcggcggaaacagccatcgaggcgacgagcggcatcagcgcccgttctcttcttctcctcttcccgcacgacgcggtggcgcgcgatggtaatccgcatcgagctcgggactcaggagggcaggtacgtggagagccctcggtatcgaggagccccgtggcgtcgccaccggacgaggcgcaagtcacggcgaccttcgacttcgacgtcgctgatttcgacggcatcaagcactcgctgcactctctcgtgcgggtgatttcatcagtgtggtgccgactgccgacagccacggcgtgcggctcaatgcaatctgcctatctcgccgcttgacatggcatcccgacgccggtggcgattcgtgggttcgctgcctgccttccgccgccggtggccaccccgtaacgcatagagccgccggtcacctcctcggcgcgggcgaggcggtcgcagtgcttctcctccgctacgcaacggccggcctccacgaggttcctcctgttcgggtccgggccccgcacgtcagcggctccaaggggagggcacacggtggaccaagtccaccgcggcctaggcggcgccgtggactaggagcacgggcggtccacgggcagcgcccaaaatcggcaacggagggagctgactcgccaggcgtcggcggcacacggccggacggccaccggcggcggcggcgcgacgcggcggcgaaaagaggggaaagggagaggagacggagggggtcctcaccgaggggcgccggcgacggaacgacgacggaaggcggccggcggagcccggcggagtgggggcggcggcgttccggcgacgggcggcgccaacagaggggcagccaaggggcgccgtgacgtgaggaaggtgatggatgggttaggcgagcgcagggtggccgggaaccacgaggaagggtagttggaggcaacaagcacggcgatggagctcacctcgcgcggggcagatggcgttccggctggagccaagggactcctcgtccttgcagagccgaaggaggcgacgacgcatcgcgaggtggtctgggacggcagcaggaggcggccggaggcggaaaatgcggcagcggcctaaggttggcggtggggatggtttttcggtggtggttgaagggagaggagcggctgccggggtggagctcagcatggcgatgctgacggcggcggcggcgcagcgcagcggccactagggcggtagtggtggccggctggacgcgacgggaggcagtggtggctcggatgcacggtggaatggcgttttggtggtggttttgtggatttggagtggaggccggggtggagcttgatgtggcgaagccgtcggtggaaacggtgcagcacggcggcgacgggaacggcggtggtgggcggctgaatgatgccggcaagcggcggaggttggtggcacggtggggcggctttccggtggctattggggaaaatggagcagctgccggggtgcggcaaagagcggcgaacgcgatggcgcaagcggcgcggcgcggggacagcggcagcggcggcagcggccggctggagggtcgctggtgagcggcggcgcttgggctcacgtggggagcacgggagagggcgcgatgagctcggggaggaagggtaaacgaaagaggagagcacggggaggctttttatagagcgagggagcaacggggaggccggggagtggcgaatttggagcggcaacggccggcgacgtgggtgacatcgtgggcgaagtggagctcgatcccggcgcgattttctggggaaacgtggggagagtgttgagcaggtggaggggaaccgatttcactcggtttgggcgcgagggcacgagtgggagggctggaatcggcggcgacgtgggcggcaacaggcggcatggcggcttcgggcggttgctggccgggatggaggaaggttcgggatggacctgacaagtgggtcccgcagtcccacttgtcggcctgagggagagagggagcagggggttatttagacttcaagggcgagcgggccgagggggggagatagaggcccgagagggggaggggcgcgcgggccgcgggggaggggaaggattcttgggccgaaaatggcccaaggaggaggggagtttttaatttgtttcctttttatttaattgattcaatgaactttgtactattaaaattacttcttgagctccgaaaattcacggaaaattccggagagtatattagggcacaaaaaatattacaaaatattcttggccaatgatttttaaaggaaattttaatttcctccataatttcacttgattaaattgatttatcttttatttaatttctagacaatgcaatattaaatgatttttaatcccgaccgaaaatcggggcattacagctgtgaatgccctcacagtgcaagtagctctcccagtgaggttcgcaggttactggctgtgttgggtgggctccacgagccaacattttgatgtggttcacgtggccttgcgaagacccgagaggcatagcagaggtggggcccgcgtcacatgtagtgctcggggaaatgtttgttttggagcaacaagtgttagccacaagtaaaatcaacttgaacatgtggctcataggattttaccgttgcaattatcacctcatgagctatctctaccctgacatgataatctacaaggttctcatgagaacacaaaagttcatcatgtgtttcttgtaaatccatatacttgttagtgatctcaccaagtttggaatttggagcacataaaaaaccaatgtcatctcggtaacatgtatcgatattgatttatcttgtatttaaccttgtgtaggttgtattgtattctcatagcatttaagaatttacattccttgcatatgtgaaagtcatcatttatgcatttttgagcaagataggttgtggcatacgagtgtttagtactcaatcatattcatgcatatcacatccctcatatgtgctcaagttggctaagtgctagttggtaatttcaaaataaaccatttagccaaaagtgaaaattttgaacaagtatagcttttctatgagaatatatttggaaatgattttaaagtatgtttgaaatgtctctcaatacttttgtatttcaaagaagagctaattttcaaagaaaatgaattcaacaaaaatgtagctctaagtatcttgttttagcttttaacttaaatgttttgtatacttaattctaaaaggaatttgtgaatggtttcaaaatgaaaaagatagtttggctaattcaaacatttttggtattcaaaatttctccaagaagccaatcaatcaaaagaaatttaaatctcaatcttatccaaaacattatcttgaccataaacggccacctactagcacttagatgagttctcattgttgggttgcataaatgcatcattctagctcaaatgggtacataagattcattcatactcatttctctccaaaaccatctcatttgcttcttttcgcttttttagagaaaggtatttgagaagagagcttttgtagtcttttgtaaaaaaaaatggcctttactatcaaatcttgaattcatggagcaaaaatgagggatgcatcaatggggagcaatctgaatcaaatccatattcctcttgctctcaaatttgaattttccgaaaagttgcatctatagtctttcaaaagagcctattttggtcaaaagtcaaaaatcttatttaaatagcccaaatttgtgaaaatcctttcaaaagtatcctaatatgtatttcaaatgttttgcaaggcttttgaagtaaaaattttcatttgtgaaacaaaatagcaaaattggtctcaatagtatcttttatgatcttgtttttgctcaaaatgatctatctccctaaatcaaaatctattgcattttttaaaatatttctaatataaaagtttgagggttggtcattccaaacatttctctaattcaaagtttccccaaaagaccaattattcaaactctataaccttttgagtttcagccaaaaccttgacttgaccatttttgccaaaacttgcatatggtgtgttaagccttttgagccaaagttctttgtgagtcttggcttagaagtgtttctataaccctcctaaggtcttacaaatgtcaaactccacagatttaaaatttgaatgtgatttgaactctcaactcaaattttatcaatctaaaggcctacaatgctccttttgtattttcttttgatagaaaaaagatttttaagaaattctttttggaaaagttactcacaagtataaagatcataactgcacggcttcaactcatttggatttgatttgaaattattttgactttttctctttttgctcagcttactgaaattttcagaacaagggctgatttgtgatttttgtatctccaaatagattgcaaatttggaagagatcaccatatgacttttgttcctctgtagttgagctcgattgccaaatttacccagaatagttagaggtcatttgggtgctttttcaatgttgttttataagctaatatggagttatcaaaaatctgaaaaatctgaaacttccagtttattgaaactttgagatgtttttatctataaatgggatgcaaactagaagtaacttacataacaacttttgatcctcaatagttgaagtttacttccaaatttactcaaaattttcagtggtcatttggatgccttttcaactccttttcagtctcaaaagtctgaaaaaaatcagaatgttttagttggctgaaagattttgagcttcatttctacatttcggttgagatctaggaaatggtcccaaaataaaacttgtgtattctttcatgatctagctccagaatttatggcatatttttttgatctcgtttccacatgtttccattgccaaaagttgccacctttgctatatgcttttcagcaaaacatggattcaagtgcatatcacttcttgttgattatttgagcatggtggtgaaatataagatatttcaagtaatgagacctttctttttagaaaaacttcatgaattcttgaactcttttggatgtgttccttgcttgaactcttttggtttttgaaatgcccatgatatatgaatccaccgaaactcaaaagtcatttttatacttttcagaaccaagcctccatgggtagactccaaattctaatctttgccaccaaatacaagttgatccttgctatcaaagccaactaccatttcttgattccaaatttacacttgcatacacaagtagtgtccatataaaatggtagtatcttttgatcatcttgaactcggtatttactaatctttgtcattccattaccgggattacacacttgaccaaaaatctctcaagtatctttgatcaaactcctctcacagagaaaataattgatgagtacatttcgagagaaagttcaaatgctcacaatcactccctcctacaaataaaatccattctaattcttcttatctaagtgacaagactccgagagtaagggggagcatttcttacatggatcttttctcaaatttttgctttgcactttcatctaatttttttatttggtcttatgaatgtttgttcttgttttgcttgagcaaaattgtttctctttcggttccatgcaaatctttttgtgattaatgccaaaagggggagaatatttgaggatcccatgtttgatatgatcgttgatatacagggggaaaatattctaggatcccacaattggtgcatatcatcacttatcaaagcatccagcatgcactatatgcacaagcatcgcatgcatagcatacaacatgcaccatatgcacaagcatcacatgcatggatataaatcaattgccattttctcatatcatgttgatatcatgttaatttatatcattgatttcacccttcatatccaaatgtggtcattattaatggatttgtcgtaaatcaccaaaaagggggagattgaaagttcaagtgccattaatttggttttggtgattaatgacaaatccaattacacgagactaacattgttataagcatatctttatctactagtctcatatatgaatatatgaaagtggaatacattagtgagataagagaacaaacaccaccagccgacatttctgctcctcaaagaactccatcacctccagcacatcccacttacaaaccgagggtatgcatttattttctatctattgctccaatcctttatgccgattctcaacttgtactattgtagaaaaagaagctagcttccaagaaaccaagagcactagccccatcggtaaactaaacttgaaatctttctttttaagtttccaaataactgatgctaatccaaacttatttcttttcagcctcctcgttctccaactcctattcctcatgaatcaagcgaacgcactccatcagctgcaggtagccatcatgtggaggaagaagtagcaccagcccctgccatccctgtaagtgcctcttttgaatccacaaatcatatcggctatcatgttacttctactaatcagtaacctcaatattcccctttttcatgttctagccgatatgttttcttttgacatcaggtagtttatggatgaagaggaagaaactacaagtaaagccttggtgcctctagccgataatgtgaaaacaaccttgctggatatctcaaagtggcttgaaggctccctagaaactctggtggtcagttgtggatcaatcagagatagattccttgtaatctacgaccaactcccagatgaactagccgatgttatcaccccagcggcatacctcgaacagcatcagctcaagcttgaaaaggctaaacaaagggttgctgatcgccgtgaaagaaaagatcttgaggccaccatccaggctagtaggacttctattaatgaagaaaaggcaaaacttgatgagttggaagctggtccaaggtccactcaagccaacatagatcggctgaatactcggaagatagaactcctagccgaattggagcagtgcaatgcacatattgctattgaagaacataaacttgccgatctgcccaaagctactgaggatcagagatcatagctcaaatcttctgtcaaacatctagctgatctaatcaagtccctgaaagtaattcttggatctgatgcagtcgatacccagatcattgatgaggtagaacagattaggcaacgaattatatcggctatccaaaaatatgtatgtggatgagctaaacatgtaacatgtgaatgtatttagtttgttaccaaacattgttaatgcctagagaattttgacaacaacatatttagtctatcgctctatcctatcaaaatttagtaatattgtcaacttgacaaaattttggtattgctaaaatttgaaaaatgtttattttggcagtataatactctctccatctacttttgatagttatattttcaaatttgaaaaatttatttttgataggcatatttcaatccaacaacttatcatcttaatgactttctcagatttaatgcatgactctccattcttccacacaagattggttgcatgggcatcgagaaatgtaaatattaatgaatcgcttgtttacgagaaatgactagtagcatgtttaaatggatgataagtagaattatttatccttgatctgtgtgtcaagataaaatatgactatcaaaagcagatggaggaggagtaataagaaggctaaaaaaaaattggtgtctaaacggggaagatgcattcttaatggcagcaatcccccacgtcgacacgcagcccaagcgaccgtggccctccaggccccgactcccgagcacgagtatgcggcaacgagccggacaccagcaccacccaccaccgtggagcccaaccgaacccgaaacccactctccccactacaatcccacaaaacacagagaatatcaccgaggcgaacgaaaccgaaaagaaagcgaaaccccgatcccccaaaccctagcgcgtactagccccccgggcaaatcgccggcggcgatggcgatggacgcggagcggcggcaggcggagctgatcgagcagttttccgcgcaggcggccgccctctccttgtcggcgccgcagctgtcggcgctcgtgctagaggccacctcccacccggcccttttcgccttctccgagctcctttccctccccgccctctccaaggtataagggaccccccgcctctcgctccgcctgcgccccgccgcgccgcgcgtgtttagggttagggttttgggggtggaccacctctcctcccccctctgatttcgatctaatgtcagttcgttgatgcagctcactggaacgcagtatgcgtcgtctctggacgtgctccgcctcttcgcctatgggacattgaaggactacaagagtaagatcaccccctcccgttgcgattcgtacattacattgcccttatgtatgtgttgtcatgcgtcatatgtgtatgcttatttggtgcgtgagtctagtgcattgtcttgttgttgtgtgttaggggtacgccctatgaaatagccgcttaccatggacgcgattggcatgtgagggccatagcccatatgtttaatggttaacaatagtgctgatttgtgttaatgttaattcacactttttttttgtgttatattgttataggttaattttttgatgggattcacatactaattaatcataattcatctttgtcttatggtttatattctgcaacaatatgtggatagaattatcacatttctgtgcttgaaatcataatttgagctgtgacaatcaatttgccttttcacccaccaatatgatcagtgtgtgtcaggctgtggttgctagaattttgttgtttcctctctcatcggcatgtcattaaaacggtctgcagtttgtggtattctctgtttatagtaatatcagataagtgcagaacatgaacatttactgtttcattaattgtttttaattttcatacatgtaggtaattctggcaatctccctgcattgttacctgatcaagtccggaagctgaagcaactcagcgtgctaactttggctgagtcaaccaaggtgcaaatttaggctgatactgtctaatatgctatgcatttttttttttgcttatcctgtgtacataaagttactaagggagcgtttagatccttggcaatggggattttagccttgcatagcaaggggagttatcatttggtagtaaaagaaaacaaatctaactttctctgtcaatctagcttaacaattgtcagaaaaaacttgctgtcaaaggagagaaaaaatggccccatcttcatcgacaagcatgtgagcatgaactgttgatggcaccaaatatcgtgcctcgctgccttgcttatgtgggccatagatgaaatgagcaggtttatgccaggctgagcaaagataatttaagatccaaatgtatcctcacagttgtttcatcaaataatagctggtctgcatgtttattatctaggtttttcattcttctttctttacgtatgatgggaaatagttctatgcagttatatgtgttaagtgatagtgattctctgaacagataacaaccaatgccagaaacaagcttcttccatcctattatgtgtgcccaatttagctttacactatctgtgaatactatcttattctttatgtgcatagcctgtttgagtgtgcactggaagtcaagttcatgtagtattatcttttaccttaaaactctgttctatgtttttgctttagacaatactaaatgtgcttggtttttattatcatttctattcaggtgctaccatatgatcaactcatgcaagaattggatgtttccaatgtaagagaactcgaagatttcctcatcaatgagtgcatgtactcggtgagaatttttttgccttaggcacttaaatctctattttccatcttctaacctccctaacaaaaaccatgtcattacaaatatatcttgtgtggattattgctcttgtaagctctctagcctttaggatcatcggtttgtttcttgaacttttacaccatagatgctagtattctagtcaaatattaacgtttaattgcttccctagggtattgtcaggggcaaattggatcagctgcggaggtgttttgaggtcagatgcttgttcttacaagtacattgttcatggtttcattgtttagctggcaaatgatccccctaaattctgtctgtacttgacaggtacaatttgcaactggaagggatcttacacctgatcagctgaacaatatgatagatacattatctgactggtgtgtacctttacttgagtgattgttgcatcccatccctattttttgttcacagaagttttaatgtttgcatttatatatggttctccctcatatctgatatgaccttctgaaagatacattgaggtcatgtgttatgggaactgcggctgggttattttgctatgtttatttgttctagactccatgtgtgttgtcccttcaggctactattgtagatggtatggttttggttgttttttgtagttgggtgctgtagggataatgtgaaattgtgtcttctcttgccaacccactctgtctgccttttaacctttttaagttttaattatacactatccattgtttttattgtcagttcatagctttatgttttaaatcatatagaagtgtttccttgaatttgttaaaagatgaataacctctgaggtttttcatttagacaatagtgtatatgcatcatttggtgctgatattgtgcttttgacatttcacaagtaatcagtttatatgctcgtgctttgacatttttactcggtccattttatgttgaagcattatgaggtgcatgttaacgggaccaatggaagtttattggtaccaactcatgctgatgtaaattgcacaggctggaacatcggataatttattgcatcagattcaggagaaaattaagtgggctgatacaatgagtgaagtgaacaagaagcaccagaaagagttcgaagacaaggtagaagaagccaaaaaatcaatcaaggtgagttggatcaatttgaagcaccaactatactgtagtttttcagatattgaatgatgaacagtaaaaaaggaaaaaaaacttgcatctgttttgttttttctagcgaacatcaggcttttgcataattcttatgatgtttttctatgttcctcattcttctgatgacctgttgacccatgtccatttactgtcatgtgttccattctgattttagtattaaatgcttttaagtattcatatagtattaaatagtggaattgccggaccatgtttcttacttgatggcagaagttgaacaatttaagcaggcagacatcgacttacgggggcatgacgactttctctctgaacctggaggaataatggattttgaagaggaccgcatccgaccaaaaaggtaatatattttttctctctcttgtgggtttggatttgcttaccttacataatatttttaaattttgtttagtatagcctgttaaaaatgtaaggcagtttgctgtcaagttgttagggacagctatcagagttatgttgtcaagcaacttttactagtgaaacaattggtggtgttaatggaaccgcagttgtagttcgtagccttatttggctaaggattgcctagtaaccttcagctatttttaaattggttgtcaacatgtttaataatacggatgtatctttaccttgtggtgtatacaatgcttttcattgtataaaattgctctattaccacagctacgaataattttttaaaatctgattgcaggaggcgacaaccaatggcatagtttcaatggcatacttacctgcctccccacttgtggaagtgctgacgccctaccttgagacattttggcaccagagctgaggaaacttccccacatcaatttatttatggtgcttccttttgaagcgagtatccgttatcattgtctcttctggagaaaatattcgttttggtacgagatgtacaaggttgacacttaccgtagcatttgtttgctggtaaaaaaaaatacaggtggctggcttagcgttgtaaagatcatggttctgaaagtattttttggtgacttaaagttcgctctgtttgcattttggctgtgtttgtagctgtgattcatcagccacgctcatcaagttgaaacttgaaagctatcaacttacgaaattattttataggaattagttcatatcctacggtcatctggaagaactgccgtattgtaaaggagccctaaattgttttgggtcgtacttagcaaatgattttaactattaattcatatgatcctttggacaccacaagttttatcgaccttgttgaatggtgcctcatgcttccagatccacgttccagcttggaatgtgaggcctactcttgtaaaaagaacaaccttaaaatgcccaggattgtctgagagtctgataaaatgctaggttgtctacggacatgttgaaacattagagtcgttaatttggctacacaaaattgaaagcatgaaaatactgtaggatttggtggtaaggcagacagaaaactgtgatatttacaaatattggtttcactgagaactaaaccacccacacgcgtacagaaatagtcaaggttgtccatctaaaaaagggaaaacaaattgtcctctcaaaagaaaaaaaaggttgtcccctaaaaaaccaaggctatcactaacatgatgttgacatcactcattgcttgcagttactgaggttagcatagctgcttgggtaaaatttgctgccatctactctgcaacaagagagcaattttggttaagtggtttaaaaaaaaaggctgcagacttgatctgcacatctaggtgttgagacaaaattcaggtttgcacattctatacttataatatacccatgcagtgtaattcacatattgaatacgaaacctacatcacatttcacgccacagaacggcagacatgtagttgaagtgtgcactatgttgtgctcacatagacagtaaaaatgcacagctcctgaatcagtgatcacagtccaccagttttagctcacacttaaatactgaaatcagtgatactaaccatgctgaaagtgcattgactaaatacatcaagctaattttttaatgtcaaagttgaatccagtgagaatccaaatgaaattttatgctcatggttcacataaatcataaacactgcagtttatgagattcacttttctccaataaagagtgaaagaacaaagatctaaagcagccactttcataaattatggaagggcacatcaatgttaaattcaatttgcattgttggtaaaagaaactatgctacactatgctaaccacacaagattatgtatctgatccaagcaaatataagtaacagaaagaggcatacattcagaactctgatttcacttgtcttctttattcccgctatgatcagcaatcatcttctccttggtattaatgcgcaactggacacttccaacctgattcatttggctttcatagtatttcttcctcttcaagcactgcattgctgcttgcttatttcctgattttgtgaactccttggcacgttccatctcctgagagatcttcttttgcagaactgcctcttttgccacgaagacatcacgggcctatagagccatagtaacataagcaattaactcacaaggtaataaaacgatgcgttcatagagttgccaacagtcctgaatatcatacaattgtttagctaagtaaaacactttcagattatttagctcagaaaggcaaaaataaaaacaaaacgagataaaggggaaatagctcttaaaaaaccagagctttgccctgtttttttaattcagcagtcaagcaggcacaaatgcagcaacttactgaacttaccctatttatgtaacttaaaagggaaaagaaacagcaatttcaaagagacctttttttttcccatcaacagtagtaagcctaacaaatccatggcaggtgctaccccccttttttcttaatcctcttatttgaatatgaacatgaaagttgcattcaaagggtgtttccctttaatttcttactgtgcttttcacattataatttggcatcgctactaaagcccacattgacactaaaagcaccccaaaaccagcatctgtttttctctttcacaactccctgcatcagcaacaggtgagaaaaaaaaaacataatttgatctaaccaaaagaactagtaattcaattaacagatactacatccattcagtgccatcaggaggcctcggtaggagggtagggcactaggcagcaactggggtctgaaccatgaacaactcgcattgtacgcccgcgatacagagtcctagaagatcactgtggacaagaaagtcatgaacaccactgaagaaaaaaaaaaaagaaaaacacacgaatcgctcgctccatctcctcctcccaccgggggcgcagggacgaaacaagcacgcactcatcgattcacccactgggggcatgacaaaccgtagcatctccctctcttgagtcgacaaacgcaaaaaaaaaaaaaaaaaaaaaaaaaaaaaaaaaaacgcattccgcccccttttctttttgctcactatcgcattcaaattggtgggagagaagattcttgggggatgagatgggagaggaaggagacggacctgcttgagctggtcggaggcggagcactcgtcgcggcagccgcggaggagccaggcgaacatcaccgcggaatcgctcgccggcggcggcagcggctactggcaggaggagagagagagagagagagagaaagatggtggggagcaacggcaacggcaacggccgaggaggaaaggggaaaaattagagcaggaaaaataaaggaaaaagcatatggggatggcaagtgggcctctccgttttgatttttttaagagataatccattatatgccactgactttgtcgcacgtctacgatttgccactgactttgtcacgttctacaatatgccatcgacttttgcttaacttctacgatttaccatcaccgtccggttagccaccgttagtactgtacaaatttgtcgaaatgaccaaaataccatatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcattttgacaaatttgtacagtactaacggagactaaccggacggcgatgataaattgtagaagttaagcaaaagtcgatggcatattgtagaacatgataaagtcagtggcaaatcgtagacgtgtgataaagtcagtggtaaataattgattctctctttttttaaagtgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33035 - DNA, 737 bp, Oryza sativa
tactagtactgagcttcattaaacgtttaatatcactgtgcttgattctgttcaatttctttaattacagctactttatcattttttgacagaaatacctacttgaaaagcgtgcgattgttgatgctgatgggggtaaattattaaatgaagataatgacatcagatcagtaagtacagttcatacacctttgatgctcttagtgttttgcacattgatcctcgagaaagactaaactttgaatgcaccaagaatcaattttggattatactgtctcaagcattcagaacttgaagaaattatggcaacagagcttgaaggatacaaagatgcatttatatttacatatttgtactgtagtagcctgctgctttgggtcagtcagaagcatccatcggaagacacttattcttgataaaaatgacttaaaattgcttttttttttgtcaatcaccatggttggacactcaatgtcaattgtctatttccaggacttaaaaccatggactatgtctaatttaccataccatcaccaattttattgatgaaacaatagtgtgttacacaaggttatgaatagttaattctagcttagtttcccatattgtttggactccttgttgattatgtttataacttcctgtcccctattacttgactcggtgttttggcgataattaaaatggtttgctttggtatgtattaagaaccagtacatgtagatggaaatcataat

SEQ ID NO: 33036 - DNA, 872 bp, Oryza sativa
cattatccacagctctatatatcataacctttctgaattttaatgtatgtctaccatataccattcccagcttgcacatttttttatcgtcacaacataaaacagcatacttctgataaaaaatgagaaaacattacggctaaattctatgattttataacacatagaaagatgaacaaaccgtaaattccctactgattaaagtacaatacctgcacgataaacacaacatcccactctaaaccttttgactgcgaatcatagaagggaatatacatcttttagtgtcagaattgccaaatggcacaaataaatttattgcagttaagggaataaagaacctggtggatagttgttaatgtgatagagtttttattttcctcctttcgtgatctgaagttttcagtttctctcaaagagatataatcaataaaggctttaagtgtagaagcacagcctttctcctcagtcttgcttgtatccactgaactagaaaaatgtgttgataagaagtcagacacatcatccattaaaaactgaaggacctgcagtttgatttaggataagttaacaccacctctctgtatacaaaatgtatgtcaaatataaaccatccaaacaaaaaatgttcaaaatccaaaaaagaaagttcataaagagacctcatatgagtctaacaaaccaaatcaaatatcggtaatatcaacaacaattagcgtacttgggtttgatatatattgcaacgcccaatcagaacaaaaaagaactttggtggaatatagctcccccgccccccgacctctcctatcctcttatgtcatgttagggtgcatttcattcttaagtattccctactgaaaaccttaggtgga

SEQ ID NO: 33037 - DNA, 1328 bp, Oryza sativa
gttagctctaagcctcaaagcctctcttaactcagcaaggagaagccttgctggcactattagagggtgagttatccctcagtcttttgacccttaccctatccggtccataataccaccttttttttctcgaacgtgcaagagagctgtgcatcattatattaagaagataggggagtgagtctagaaagactcgtacaggcccttaagggccagggttaaacacaacgaagaaaaaactagaaaagaaggaaactacgatcagcaaccaaacaaactttatggtcaaaaactaataagacccttggcccccacaatacaccatataataacacagaacattcccaaaataatttggtgaaaaaaacaaaatcagcctgcatggttggtttcttgaataattatagatgatagtgcacttgtgtttaccaaatcaatgcttcatatcatatacacagaaaaattatggtcagcaacaactaaagtattaatttgaaaaggtaccagtaattttcatgttttaaaatgttaatagaaccaaggattataaattgataatttggcagtaagaaagcaactcaagaaatcacaagaaattgctagtccgcgataatattgggagtaaaaattaatccaagcacctttttcctgtagaaagccacaccatgaatattaaaaggaatttttctgttgcggaatgacgcctggaatgctttgccagtgatctgtgtacaggtaacttagaccataaacacaaccaaaaaatatggttcagcaataagtggaagatttctcaacctgtctgcgatataggacagcaattttgccaaaatgacatccttcaactgaactagatgtggtttcaataatcttgtcaataacaaatgcacattgtgaatcttcactgtggcactccttaacaatgatctatacaaaatgatggatagaataagtaactggaatgatgcaagaagaagcaatatgtggcatctttaaggacaccttattcccagagggattgtcggtctcagcaagtttgtggctttgccgtttagtgttgttgtgaattaaagctgttgctgcttcaacaattgcccgtgtagagcgatagttcttgctcaatctgacctaaactcatcagcacgaaaacacaattaacagacatcaagctgagaatcaagattgtgcatcaaagacaaagtgcatgttaggaaactcctacagagatgccgtaattacctctttgtgatttggaaaatctctacgaaatgaatcaaagccagagacatcagcaccattgaaactgaagatggactgaaaatgagaag

SEQ ID NO: 33038 - DNA, 3877 bp, Oryza sativa
acgtggagttgtcgattactgtctgtagctttaaatcccctaagcccagcatctaggaagaaccttaaatcatttcctttatgcgttctacattctgctgtgatatgtaacagtaaggtggaactagcatatccaatctagagagaatctagcattccacacacactttaggtagatgcaacagtgcacctcactttacaggatgcatacaatataacatgtacccagttcctttcagaagctccctatgcaccaaaatagagaagggaataaaaacaaaaatgcttaaatgatgaattcttcaaaagtagaaggcacctgtgtaacaaacttctgccatttcttagctttgtccttgaaagaatttttaatatctccatcgcaattcttatttgcatctcctagaccattatttttgtcactttccaatagacgctctgcctcaataacagccctcctctgctgcccatttccatagattatgaattcagatgtgcggcctagcctttaaaggatttattagaacatcagaatcatacaataaaacaataaataagataagattccaatcatctaaaatgattcctacacttgctaagatgtaggaaataagagcgcactgaaagcagggaaaatgtgctcatcatactagcaaatatgatacaccataacaaattgtcagtcggtgaatttagagacattaaactacaattgaagatgatgactgctttgatgtactaaatcagattaagcagggaaaatgtgctcatcctactagcaaatatgatacaccataacaaattgtcagtcagtgaatttagaaacattaaactacaattgaagatgatgactgatttgatgtactaaatcagattgtgctggtatctctatgtaatgggtattttaatgcatttctgacttttatcacaatgaatagcgtgatcataaaaatcataagttaaaatagaaaacaagaatttattttcagcttcattcttttccaggctgcatcttattcagatattactttctcagaaccaaatggtctacaacactaagttcattgatatgcacttcaaagataaatgtgcaagtgtagtatgctgagcagaagcatgtcgatatccattgttgcattgtattttaagtattatccaccaacagaaaagacatacttttcagcatgggtcctgcaaagctgcaagcagaatgagtgaaatgtgcttattacaatctccttggcaactgccttccccaccactgtcccaattcgatcccgcatttcagaagcagcagcagttgtgaatgtcatagcaagaatgtttgatggtggaaattcctaatcatcaggcaaggagatatgtgaatatgtgagcttcaagaaaaaaaaaatccatacaatttcactctgattatatcaaccagtgaaccttacctctttgagcagtgtgagcacccgaccaaccattgttgatgtcttgaatcatgccaattatgggaaggaaattttcagtatatacaccagcatggaatttaatatggcatgacaggacctttgatatgttcaataaagctcaaatagacattattttttagtacaattaacttttttcaatcacaacaaagtttatggaatctgcaatattgttatgtgtgaccgatatgaaaaatacgataaaatggatggcacttgcaccgtttaacgtttgaaaggatataatctacggaatatatttggcttgaatggtcagatggatttcattcagaaacaatcattaactgtatcagctacaagaacaaaagctacaaaattaatgcatatcgataaatgactattatttttattagtcaaacaggctaaatcatgcatgatgttggtctaaaaggacctgagcatctgacgaaattggtctcagttggtttcacatcgaagctggggccaataatttatgacagcggttaactcaacaacatatgtccataatactgaagattaagacattgaaacaaaacacactggttatatatgcaattcgcagagaaaggatgtttgtacatacctttccacttcctggaccagcaactatcattagtggaatagtcacatcactacatgcagcttccctctgcctgtcattcagggactgcaaatattcgtagtacttctttggaacacacccttcattttcctcaatttctagttccgtttcctgtggctcctcctggcccttggtagcatcaccctgatggatagcatcaagatcctccaagaatgcatcgacaagctaaatattccccaagagaaaaggaattaaacacatttttcttgattccaaagcaaacctagtaattcaatttttagtttcccagttcaccttccgagaatgaggaaacatgaattagccaccaccgaacaactgttcatcatttatttgtcgaaagttaagaaatgaagcaaataagccatacctctccttcccgctcttcatggcaaattactgagggaactgaaggaccatcgctattttttccgtccatatcctcctggcacttggcagaagagcctgtatggtgcacctcctcagtaatgtcactgatgttccagaatgcatcctcaaactgccgcccaagcaaacaaaacatcctaagttcctttagccacttgacacctaacaactaacatgataatgtcttaaaaaatatgcacttcatacacaacggcatttcaaggggaaaaaaacaggtcggcattcatttgcccaacttttcttatcgaagtgcaacaaaaagaaaatttccaatacttcacagaccatcctaattctcttctaatttcaaagaatatatcacactctcctatcagtgttagggatgaggaaaaccacaattagactctcaaagttgagtgagccagattgctccaaccaataactattcatcaggaccttacagagttttccaccgtttgacatacctctccaccccctgtggcaattgaaatggccggtggaagtgaatcatcaccaaaccacagttcacagatttcttcttcatccgcatcctccatttcttcctggctcgtggctaaaggctgagcatcaccctcctcaccaatggcattctcctccttccggaatgcatctccagactggattccccacaaagaaagaacaatcaaaattagttccctattaaaagtagccacttcaggatctggtacagcacatttcatttctgatatatcgaaatggcggaagttttgctttcctagttcaaaaagaaaaaaaatcgccagtatacagttgaactgccagcagtcacagattcataataatatcacactgataaactaattctgccccccaaatccttctcgatcctaaagcaatcccatttcatgaaacaacaagtttcagaatcccttaggcctcgccacttccctcccaattacaagattcctaaatccacaaatgcgcccttagatccctaaaccccagtttagaatgaaacgagagagcagcaaaaaaaaaaataccactccgctctccggttcggaggggatcgatggcggcgcttcgccggcctccttatccttcctggccgaggaccgctcgtgctcctcgcaaatggcgtccacctcccgcaggaacgcctcgtccatgccttcgtcgtcgtcgagaaggaacctgcaggagggcctgggcgccttcggggcgggggtgctgtacccgtacccgcatcctccccctccggatccccgctgccgcagggcgttgccggtgacgtcggcgagcgggcggcgcggcggcggccacgggggctgcggagggggcggggatgggggagggcgcttgcaggggaggagggaggatgaccc

SEQ ID NO: 33039 - DNA, 4810 bp, Oryza sativa
  unsure (1)..(4810): unsure at all n locations
gttttttgggtggaggttggtgcgtgtgggcgggaggagaaaatgggggcttcgctgaaatgccatcctacaattgggattcgcccaaataccactttcaactgagcccaacccgctgaaatgccatcccaaatcattttcatcaaaaataaaagattttactctatttttcacatgatttgacgaaattacccctcagtcaatttcatcgttagaaataaatcggctgggaaagcgagacgcatagggttagggtttccgtccgccacgccgatctgggcgccgccgcgcgacctccctagcgccgccgcgccgccctacccttccctcccctcgcgccaccgcctcccctagcgacgacgcggcgcgcctcccctcgcgccgccgcgccgcgttgcggccgtcccgtggcgccgacctctccctcgcgccgccacgccgcgttgcggccgtccctggcgccgacgaggtctccccgacgaggtctccccgagcgccgcgtctcggccggcgccctcccctcgcgccgacgctcgaccggcgccctcccctagcgctgccgctcggccggcggcctcccctcacgccaccctgcgctcggccgtactgcggcccctctccacgtcggtgtgtcgccgtcccggatatacttgcaggagtgatgcagatggattgcagttggcatgagctcatcaccgggtagttcctaggatgtaaaggtccttttttcatatgttcatcacatcctgtgtacatggtactctatatcctctaaatcgaatgaaccaggggtattttggtcatcaaagttgtgagaaaagagagaaaatgattttgatttactacacaggaagagaatggcatttcagcgggttgggctcagttgaaagtggtatttgggcgaatcccaattgtaggatggcacttcagcgaagccctgttttgaggatggtataatccccattttctcgggcgggaggggagggagggcttcgccgaagcgttgtgtttttcaaacgaaggaaaaaatagaccgatttacgaaaaaggaaaatttatgtgtgtcggtatttttttaagaagaaatactcagcgtgttttcttgaaacaatacaccccttattactacactattaatcaagggcatctctctttgtttgtaaaaaaaaagtgcatctcttttctcttcaacctcaatgataaaaaaaccaaattttgatatgcctcctcccccgctgcaatgacaacggattcgttgtcatgtatagaaaacgaatataccaaaatgataatccgttttctaaaaagtgtacctcaatgataatccgttttctaaaaagtgtacctctaaatatttactaggctgcaatgacaaccaaaatttgttgcatatcaaaatttattatattatatcatatcgggtagaagggtgttatagtatgtaatggagggagtacgtttcgatcaatactccctccgtcccataaaaaaccaacctagtactggatgtgacacattctagtactacgaatctgaacatacatttgtcatgtgtcacatcccgtcctatattcactttttttgacggaaggagtatgtaccaaccagttgcgtgaattacaattgatgggcttttaactttctttcgtataatataagggatataatatccaatatgttgctacaagaatttaagcgtaagaggatatgggggatgtgcacattgagaatgttaaaaggttaatattgagagtgttgaaaaatatgaacaaagttattgaactgataaaaacacgtttttagtatgcatccatgcaaaagaacggtacaacatataagtgaattctgcatgtggacatcacctcaaccgataccactctgaataggagtcacttttcaccagtttcaacagttagatgattctttataccttgtttcatagttaagcgatatgaatcagatccgatttatatttactttaagagaactagcctagagctcgtaaaactagaatattagagaaggacctaatatcaaataattaggaggggtgaggctttgaacccaagtcgtctagcccaccaccttgtggagctagtcggaagacccctgggcatttctcaagctagcctagagctcgtacgttacaacggaaaacaaactgaaattcttacttattattaaatcaattaataaacacttatttagtctaagtaatgttatgattattcttattgaacaaataagttattttgaattttgggggagtcaatagtgatataggagaaaacttgttgaaaaatgatgtaatagtatagattgtggtcattagatatcagctgtaagggtgatgtggaagaacaccacccctactattaacattttaagtactctatatgtttcatattataaggtgttttgattttttttccaagttaaacttttatatgtttgactgagtttataaaaaaagtagaagtattttaaacaccaaattagtttcatgaaatatagtatgaaatatattttgataatatgtgttgttttgtgatgaaatgatactcgataaaattagtcaaatgtaaagaagtttaaatagaaaaaaaaattgtcaaaatgacttactccctcgtccctccgtcctaaaatataaatatttttagctatgaatatcagatttatagctaaaaatacttatattttaagacggatggagtaacttataatacggagagagtagtatagattaaattggacttttttttcgattttgctatatctcactcgaaagattttttcttatctcttactcgattttctcactcaaatttacagtgcattttcttataagttacaatgtaatttatggaacttacactgtaaattttgtaagttacattgtaatttttgaatcttcgcatgtaaattttaaattttgtattggatttggtctttttcttaaggatatggtaatttagtgtccattatggtgtttcttaattgttttttgttttttattatatctatcggattttaattcaaagattaaaaatctgtgtgatacaatcataaaaatctttcgagagatgtataggtactcttttttttttttctgacggcggagaggcgaggcaatggggtggtctttaacggatgggttgaaaatgggttgggctttaacggacggcccacatgtcatctggtccatcagaaccagcgacgcggagagactggagaactagggctccgcctccctataaggagcgttgccactagtggagacccgagtcccgaccacgacgtccgccgcggtcgctgccactgcactgcactgcactctaccccggcgagcaccacgaccggcggcgagagatgcagatcttcgtgaggacgctggacgagtgcatcacgctggaggtcgagggcagcgacaccatcggcgacgtcaaggtcaagatccacgacaagaacggtatataattgattaactcgcttagctgagctcctccccttcgccctgctcgtcggtggccggcaaagccaactgcatttcctctcgcgcttatcggaatagtccagctccgccttttctttaaccgtcccgattcgaggatttcagggtatgaaaatcatagctttcctttctcttaaaaaaaaaattatccgattgggtagtgaacgatcgataaggttattggattagtttgcttccacttgcgtttcttcagagcaagaattgtatggggggattggtgtatttcttgccaaatcgctggacattccaatttgattaccatttaccagtttgtaccatgaatttgggggttaatttggtttgagttgtacggcaggcatcccggcggacgaccagcggctgatgcacgccgggaggcagctggatgatcgacggacgctggccgactacggcatccagacggagcacacgcttcgcctcgccattcgtctccgccgccgcggccaacctcctcacactcgcgctcaagcacaatgagaagaagatgatctgtcgcaggtacgtcctttaatttgcgcatttccatccaaaaacccaattagggcaagtacaataatctactattagcctgtccacctcagcgtgatttgacgtggaggcgcgctatgcgaggagaagggtgtgagccggcgcttgcatgagcgcccgttttgcacaggctaccatgcaatcagtgggacccacatggcctaagcgcagcatgcatatggcccggtatgcttgatgggccaggcaaaaccaatttcattggttggccaagcctggattgttgagccttgtagagactattattgtatacatcaactgtaaaacaagttctaaatgagttggataagaattagagtaagcaatcggctcttctattgcccttgcccttaggggagtcactctccttgatttgagaatctgcggcggccccattgtttcgttttttcggggaataatccaaacggcatatttacaaattaaaaataatttgtgaacaaaatttttataaatgtgttcttaccgatctaaaagttaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33040 - DNA, 10899 bp, Oryza sativa
  unsure (1)..(10899): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacgatgtggttggcggcatcccggacccgcgcgcgcgcatcgtcctcggtcccgggggggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgccgggcccaatctcgcccgccaagcgaagggcctcggcctccccggtggaggagtccagcgctcgctgcatatcggcgacggtgtgttcggcagctgcgaggcgggcggctaagtcgctttcgcctgcggccgccccaccgatatgcgccctcgcgtccagctccttttcccgagcctcgaggtcagcagcccgctgttccagtgcggctctctcggcgcggacgcattcaagattgcggcgcgcctgctcctcctgcgccacctcgcgaagggacaggctgtccgccagccatttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggtggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctccgcggccgcaggatcttcggcctcggactggccggacttggggtggcgggaggaatgcgacgggacatcgctgaagcagaagaaaaaaccagaagacgaacaaaatgagtaagaaaaagcttccttttgggagaaagatggttgcaatgagagtgagacgaacctgcgagggggtcggttgaatgaccaccttggaggggaaatcaggtttccccggcatggttccgtctcccccgtcttgcgaagccctttctttttgcactccccctcgggctgcgacgtcagcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgtggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgtgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgagggaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggttgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggactttttcccttttggaaggctgaggggaaagggagttaatcctttgtaacttgtccatacacaaatccacaaaaacacaggagtagggtattacgcttcgcagcggcccgaacctgtatagatcgccgtgtctcgcgtttcttcctagcaagcgatctttccacatacagagagagcttgagatctcaccctaagcccccggccgaaccggcaaaggggggcctgcgcggtctcccggtgaggggccacgagctccgtcacttatgaactgtgacaatcaaacggtaattgtcaaagtgaatagttctaaggataatatgaaatcgtctagacatgtgaaaagacgattgaagtctgtcagtaaattgagaaactctggagttatagcgttggattacatccaaacagctagaaacctagcagatcctttcacgaagggactatcacgaaatatgatagataatgcatcgaaggagatgggtttgagacccatgtgagttatactatggtggtaacccagtctatgtgatcggaaatcccgtgaattagaacctgggaagaacaaaccattagtaaactagaggagagtaccaatctatatgtaacatcccggcctagggcttaataggattaatagaatactcatatcaacaagttgcaacttcttttccggaagccaatctccaaagaactccagggttaagcgtgctgcgctggcactggacacatggacgtggccaagagaggacgttcctagcctagggttgatcgacgggggcgtcgatctctcttaagggggtgagggtgtaacatcccggcctagggcttaataggattaatagaatactcatatcaacaagttgcaacttcttttcctagggcttaataggattaatagaatactcatatcaacaagttgcaacttcttttccggaagccaatctccaaagaactccagggttaagcgtgcttggcctggagcaatttgggatgggtgaccgaccgggaagaatttcccgggtgcacacgagtgaggacaaagtgtgcagaaaagacatgtgttggtcctctaagtgaagatgcatgtactctcatgagctggaaggcaggttggctatgccttaatgagttctgttggctttaattagcgaagatgctgtcttgcagagcattcttgaaagaactcacctttgtaagcttgactgttggtcgcagtctatgaagattttgggtgaatcttttaggaagcttattaaagacctaggagtatgacttatacgctccacccgaggggtagtctacagacggtctagtaccagataagactctgagtgaaacttgcttgcataagacttgtaattcaagacgtagtccattgttcaagttgtgagtaagtgtagcttggagttctaggtggatgttcaaccttgatcggtctccatcgaaccgctggtatataaaagtacattggaaaaggcaaatcttagtgggattttgagatttggtgggggattgttagaattaatagatgggctaaggcccattcgaagattaattctttgaaaaatcacaaaagcccacctcatgggatggcatgcatgtggagtttagtaccaccttgcttattctaggagagggggacctccttaaaagggaggatgccctcctagcttcttgaagcatgtgtggtggagagaagagggggaacacgcgctcgctcgcctcgcctcgcctcacctggcctggtagggcaggggcagggcaggcggcgcgcgtgcacgacatacgcgtcgaatggtccgcaaaattggctcctcacccttgcacagatgcagcctccttttgcagttttgttttgctgtaggaaaattcggatttgttttgttttggaaacattccgaaaaatccgctgcgtgaaaacggcgtggagtccggataagttacgcgcgacttatccggttcggttacgcggagtggagatcgtgcgggcgccctgatcaagcgacctatctctatataaactgagccgccgccttcacgcaaaacacacgaaatcaatctagggtttgcctcctcctctgtgctgcgccgtcgctcgtagactactccaccccgctcgctggcgtgcacctgcgatcgggagagcaggtctcaggaacctctgccttcgacgtcctgcaccgggagaaggcggcaataaggtttttgggaagcgcttcgcgcgactgctcactgttcgtccacgacggctcgccttcctctccgctcgcgtgctgcgcgccttcgtcgacgctcgcaaccgcgagtagttcctgccgagcaaccggtctttccgccacctcggtacgtgttcgacatgttgcgtatatttgatctgttcatgttttactgcttagtttacatgtgtaaatctaatgatacattaatgctagtatacatctgtaatgtcatgatttatttatggaatatattaaatcattatatttctatattctcaacacacacaactccaggtaccttagctaaagatccaagctcatcaatcagtgaatgtgcttttgcaacttaactacagcaaggttaggtaattaggtccacactgcacatccttcagtggaactattggtgcctggcccattttcctgagctgccgttgaattgaatcttggtgccgccaagacgaggcaagctaagacgatatatatgttgtaggctagctatagctagctacttccctcaatctagctacagccatgcaacacaatttgcctgagttaatttgctagcatgcatctgcttgaaattacttcaacgagttatttagtaggacatgtttccttatttattaatttatgtgggttaatatatcgttcagaaatttcgttctaccttaatataagagagccacgtgagaaatcgaaattatgactaggctttaaggaagcatgccaacgcataatgtgaactagctagagactcatcgagataggatagggacttagagctaatcgcacaactacatgaacaagtgttctgtaaaaagaaaatagcaacactccttaccaataaagcagttatgacagcacacccaaggacttgaaaagtcattaattgtgctcacctaacgtggaccaccgtgcttctcgtcgttactaacccgtgttcctcggaataatgattaattcaatcaaactaacaagcgcttcaagaaggtaaaaaattccaatcaatcgatcggctttaaattgagaagcatttcattgtagagatcgagaataatgtggaagtgtggctctggcacagtacgtacatttccctgggatgggcacagtaggatgctctgggattttgtttgcttttgtgggaagtgtaagaaaagctgcctgctgcatgctgctatgtgtgcagccaagcgcacagtaataactagaaattaaagagagagataaaagatattgagatcgatatgtgtgtgtggagttgtggaccaatggatggaccagctagctgctgatcgatcaagatataatataagatagtatcatgcatgcattgtggtaagatatcgatctctatatatatatctctctccctatatataaagaaaaatataaaaaaaatacaaagaaaaatatttatcggctaataaattaatcaaattgaacgtacgtgcgtaccctctcctaccgtccaaagttgctttgtcgcttgatccatcacatcagctagctagctcgatggatcatgtcacagtgacttggtgtccatgcatgcgatccagatcgagccagcctgatatagtaacttaccactcgttgaccgcactattaattactacctccattccaaaatatttaatgccattgacttttttaaaaatgtttgaccgttcgtcttattcaaaaaatttaagtaattgttaattctttttctatcatttgatttattgttaaatatacttttatgtatacatatagtttcacacatatcacaaaagtttttgaataaaacgaatggtcaaacatatttaaaaaagttaacggtgtcaaacatttagggaaggagggagtagttcctccatccggtttcccaatgtaagattttataggattgtccatgtgtctagatttattaacatctatataaatgtggacaatgctagaaagtcttacgatatgaaacatatggagtaattaattaattccctaaatcacaaagaaaaaattaacttgctcgttgctactagtacatgatgttgtctgcatcaactaaacctacacataactattttagagctcatttgaaacgcaaactagattcttaaagtacaagaataggaaaacacggaattaaaatgtcacaactcacaccatgataaattctatagaaaacaatactaccgaaatgtttgaatgtaccacaagaaaaacacatcatatttaattaagttcacattttgatttggtagagaaataatgcagagagaaagagagagaatgcatcggaagtccgaaaggaatttgcaaacctaaagttagacttcatgctagaattccgccaaaatctggagtattaattactttaatgcagtcctacaaaccaaacgtgtgcacataggattttttttcctttggattgagttcctctgcttttcttccaaaattacttaattcagtacaaaggagctattagttttaattttaaataaaactaggatcaaaaccatggtatgtagaatcaagtagtcatatccttcagtaattttgacatacaatgcatccttagcttcagtaagctcatcaatggatcataattttctggtgtagtttttatctcatctaatcaatcgacagcaaaaattgtgcaaaaaaaataattttctaaccgtgtaaagatcatatgtgaagattgtagatatcattggatgccaataataatgcatgctaataacctgcagggttgagaccttccgcacgccctcgccagttaatgggtccgaccatattgtaccaacaatatactaggacaacactaataataacaaatgcaagtaaatcatgcataccattttttatatataaaaaaaaccacatgcatgcatgccctatagttattctagcaagtcaatgtttttgtgacggaatgtcagtacaggttaattagcgcgactaaagcatgttgtaaaattctgattgagtgcacgtactacatgttaaattcactaaaactaaagagaaagtggcacaacaataatgctagtaaattaaagccaaaaatgcacctgtgcatactcatctttaattggttaggctagtgacactagagacttacagtaatcaatatattgagaacggtcctttctctgtgcatatatgttcagtgcttatttggacttatatatatagtctggcatattcagtatacttttcatgacataagtttaggaaaacttttgtagtgattctcttaattagtcccaatgatatctattgtatttaatgtattttattatttaaggttattataaaaaacaaggtttttcaactactaggaaattgatcttttggcacgaaaaaattagtgcattagagccaaaatcatggcaatagatatgtattgcttcaattctaaaatcgttattagctgtggtacgtaatataacccgttgttttaattaggttgttgctacaattttaattttatggtaacaaatatttatattgccacaaaataaacattgcaataagatacgttcactacggcaaaaccaaaaaaatattggtaatagtataaactatatatactgccagaactcatatgtggttgcaacattttcgtggcaatagtgaatttttcctgtagtgatcatttacttttatatattgtatataatagagttcttgtgttaaaattgaagtccaaaaagaaacgtatatacacatgtgcaataattttttttcaaaagaagttctataactaatatgtccagcctcttgaccaactaaggatagacaggtgtgtgtgtgtgtatgtatacacacaaacacaatatatgattcttagtgggcggactcatgcaatcacgtttgcaccatcatgttaatggtgcacatatataaatatataatggattattttcaaaaactaaaaaaccgactatggataaatgtcgagaacctt

SEQ ID NO: 33041 - DNA, 7766 bp, Oryza sativa
tttttaattccgaatttcagctatttctaaattatatttctatatggactctgatttttattttttttccgattaatgtaagaatttctaggtcatgagagcgaacgtggaggctctttttaattctgaattttaagttagttttaaattcctatatgaactctatactctaattctaatattcctaattttttaattccgaatttctatttttttcttaattgtatttctatttggactctatactctacttctaatattccttatttttaattccgaatttcagttattttctaattgtatttctatatggactctagtctcctcttctaatattccttattttttaatttcgaattttaactatttctaaattgtatttctatattgactctagtctcctcttctaatatttcttattttttaattctgaatttcagctatttctaaattgtatttctatatggactcttctttttatttttctccgattaatatgagaatttctacgtcatgagagtgaacgtggaggcacttttttatttcaaattttagttagttttaaattcctatatggactctatacactctacttctaatatttcttatttttaagggactgtctgtactgccatccagtatttttaattccgaatttctattatttcctaattgtatttctatatggactctagtctcctcttctaatattccttatttttaattctgaatttcaactatttctaaattgtatttctatatggactctagtctcctcttctaatattccttattttttaattccgaatttcaactatttctaaattgtatttctatatggactctgatttttctttttctccgattaatgtgagaatttctagaccataagaacgaacgtggaggctccttttttattcctttaataatataatagattttgtaatggaatcgccctaagtatagaaaaccacaacactaccgatgcacacattattagacagtaacaggtcaataaataattaagtataaaaataggaatataatataaataataataatatatatatgcacgcatcaatgtggaaagcagtgtcctaattaagttaattggcaagagacgcaaccgaaatgatggaaaacaaaaggtgctgaaagaagggggatgaaagtgagatatcatgtagcgaaagaaacaggcgagccaacaaatgaaggcaaaggcaggttgcatggcctactgcatctgcatctctgcatgcccggctcactctccctctccctctcttctctctctatcataagtgccaccatgtctctgtcccctcgtcgttttcctctagctaagcaagctatctagcttctctctctctctcatgcataccgatacggatcggaggagcaaatatatattgcaaggagagaagaagaggaggggaaaataaaaggaagctacaggctacaggtagtagcagaggacgaagaatgcgcatatggtggtgtggccatcatcgatcgagcgagagcagctagcttgttggttgccgcatatatctgacttgctgtgttgcaataggctggggggggggggggggggggggatgcatccatctacagttggtgtgtggggcgaacagttgcttcgcgctgtagcttgtagcttgtgtggtggccaaataaatactatcagctgatcgatccatggtctctgcgacgaccgactcaaaacacgacgcgtttgccacctagcagctatatatcttcctttcctttgctacctcgatcgttctcgatatctagtatcgatcgatctgactctgcatgcatcccactcatatacataccgatcatcgatcgagcaatcgaactctctgctctctcatgctcatatgctatcatgcatgcatgtgagagagagaaaaagagagagattcagagatcaatcgagctggtagtagccggccagtagcactgtgagtgcgtgcactactagtgctcctgcaggcaaggctggacgggagtgggagtgtgtgtaccagtactagctactagtgaatactgaataggcagcagcaacagcagcagcagctaattaagcatcagacagaaactagaaagagcgagcacgccactatggatatgatggaggaggaggctgccaacgccgccactgctcaagctgctgctgctggcgacctcgccgacgtcgtggcccgtgccaatgcacgcgcattcctcgtctccacccctcaccatcacccctcacctctgcatcctcttcctcctcctcccatgcctcaggcgcctcaccaatactatcccgccccccagatcaccatcccttaccaccaccaccaccacggagagcttcggcgccctaccaccatcgcttacaccgacgcacctgtgccgttcgagacggcggggccgccatccacggtcgtcgactcataccaccacctcacacccggcgacgccggctacgggatgccgcggccgcttgctctccagatctcccagcacgccctctgtggcggcggcgacgtggtgatgggcggcggaggcgcaggcgctgccgatgatggagaagaagccatcaggatctcgccactgacgccgtctgctcatcatcaaatgatgaaaaggtttggcatgctagctagctcttaacattattaattagttctctaattaattggattcatatttcgatcactcctcttcttccttaatgtatacacatcttggtccttccttcaattgatgatttgcatccctctgatcgatcccggctttgtgttaccgcttctttttatcactttgatctttttattagttcatgcatgtgtgtgtgtgcagatatctttggctctcattttcagcattcctttcgatccattacatatactgacagattatatatatatgagtcgtcattaattctgacttcatcacctttaagcaagctagcaggatttcatggattggcatttgatgcttgcaccccctacccatatcgccaaattaatattaactcgatcttactcttctcagagttttactcctcgcatatggccgttttcagtattaatgctcatatctagcaactgtacatgtacacataactctttgacaggtttggaactaaatcatacttgacttcagttcctcctaatttgcttttcacgtttctctaatgagcgaggaatacttacatcaatcgatttccaattaatcaaaagtcttaactatttagtgttagtttattttcaagcaattaattaattacttgcttgcatcctttggcatatatactacaggaagaatgaggtgaagaaagtggtgtgcatcccggcgccgccagcgacgagtagccgtggaggtggaggagaggtgatcccgtctgatctatgggcatggaggaagtacggccagaaacccatcaaaggctctccttatccacggtaaaccggccacattttcatctgtttcttcccctctttttttttttaacacgcgctcacttaatcgatctgttcatatatatcttgtacctaatgacccgattcatacatgaagtttatttgcatcaagatctcatcaaatatctttcaatcattcctattcctcccattcttgataaacaattaatcactttctgcataaatatttttatacttaatgaccgatccaatttatacgaagtttattggaatcaagagatatctcatcagatatatatgtttcgttcattcctattgtgtgcttactgcttagttatattatgttccctctaggtattaattatattcattttatattatgtaagttcattaatatttattgctcatatctctgcaggtactgtatctctgggcaaaagcatcaaaatcatggccatccttttttataagctaattaactaaaaaacaagcagcttccatatttcttgtttagacaatttcaattggtttggcataattaaacaacttttgaaatatatatatactgatcccctatgagtccaagtgtaagccatcttagccttttttaaactctaaaagtatgttgtttcaaaatttgcaggcatcttttaatttcaacttatatttatggtttcggtgtaaaaaaacttatatttatggtttctcttgccaaataaattatatttttctcataaataaactaccaatattttccaaaacaatataaataaagggtaacaaaagtcgcttgagctatttttttttaattcttgcacataagttttaaatggcttacatatggaataaggaagtacatatatatctgtacaccccccccccccccccaattttcaattcaaacaacattttttgttagtaagccacaactttgggtttattacttagctagattacatgaagttccccattatttgcttgttggcttataagtcattgacacaatttaaattgagttaattgcactttggtccatcttttattaccaaagtttcactttttgggctaccctctagctaatattttcactttagactaggtaagattatctttgttgcagtttggaccaccccaagtcacttttctagtgcatctaccctctaatcttgtgaataatagtctacatgtgagccaggaagttagcggtttatgggtgttgatgtggttaaagtcatttatgtgctcgagaaaagtttttgggatggttcaaagtgaaacaaaggcaaactaatctagtccaaagagaaaagatgttttaaagggtagttcaaagtgaaactttggtgataaaaggtcatttactcatttattttaaagttaattttaaattatcctccttttttattttaaacttatttccaaccttggctttttaccactaatggtataaatagtatataaaaggcctaacctaaaattattttcggttgcttcgtttacttttgtataacttatcagccaaagccaaccaacgtgaatagaacccaaaattaatttactgcacaatacacatttaatataccaaatctccaatgatccaaatcaagtatacaaaacatttcttttagaaaaataattcgacagcatcataatagacaatatgcttgtctattattgattaattatttgtgtagtgttgggtttcaaacttccaatggcacttgaacgacctaataagggtttggatggatatgtatggattaatcaaacgtatataatcacttcagattgtgtcggagtttcaacattgtaccgtctgaaggttatatatacacctatgcccaagcaatccctaaaatgtaaatctatcatcaatgaattcttccatatatacatggggatctaataagtgattcatcacaattatgacccaatgtagtgtcatttgtgagaaactaatactcccaattgcaaattgcgtaaatcaaacattattaattgttgaaatagtagatattgcaagactgccacaaattaagttgcttttacttttgaggcaaaaattggaacaaaatagctatgtttgccgttttcaaattaatttaaaaggtaaaaatgaaacttcaagtacagggatcgataagcttaatttactcacaattaattaaatttctcgatgaattaacaattattctggcttagtggactcagtttgacattactgtgccatcttcaaatttgatcaaaccattcatacactgcattctaagggtatatatatatctaggcacaataattttatatatatgcggttgatcaggaaattaattaaaaaataataattcactgatgagttgattttgtgggcggtgatgatgcaggggttactacagatgcagcagctcaaagggatgtatggcgaggaagcaggtggagcgcagccgcagcgaccccaacatgctggtgatcacctacgcggcggagcacaaccacccatggccgatgcaacgtaatgtgctcgccggatatgcccgttctcatcacagtactcatgctactgcctccagcagccgccacaagcaacagcagcagcagcagaccaaccagctgcagcctgcactgatcacaagctcatcgtcttcttcctcctccccattcaatctctacgccgacgtcgtgctcggtggccaacaggccaacatgatgatgacgacggagggcgccggcgctggacttggcatccaaccttcagcagctgatgaggtctttgcagagctggaggagttggagcctgataatcctactatgatcaatgcaaacatgcaggtgtactccaccaccagcaggccaggggtaagcagctatgatcatcagtggcacaagttctaataattaaaccatgcagtacctatatatatatatatcagaacttcaatattcgagagaggagatcagaggaaattgaattctagcacgtacaattaatacatcatgactatgcaaaatttacatatatatgatatgatggtcgcctgtgcgattattagtgaccaaattaaagattgtcagagatataggcgtgtacttacgcttatatgtatcacgctgaggtatactgtatttacaagaagataaataaaatatccatatccctctagatgcttttgattggtatcctgtatcgactgatccatatatatgtgcaatatattagctaatttatgtcattagtacatgcgtgctatattaagaagagatagatggcaaaaaggagtcacgtaccacatctttttctggatggcttaaaaattatcacattgataggataaaaggatctatattaatttgcatcatttggttgtcatgctaagtgggctggaaacactaaaaaatctatgttggagggggcaatagtgttagtttttttcttcaaaatttcctcgagctagctataaaattcaatgtaaaatttgaagacaaggggaggccgagttggccccttcgccgtctccgtctccgtctctaggtctagattagattataacgggatagatcgatcaagatagttatagatgtatacatgtaaacagatagagatgtatattaaatacagtacgttctacttttaaatctagttctttctgcacaaaatctcgcatgggaggttaattagttaaaaaaaaacgtgtacatatatttgtgctttcatgttcggatatttgaaatacctataccactttaaaagaaggcaatggtgcatggtggcaaccaccgcccctatcaatgacatgcaggttctcaaatgtactctacaataagaagactactagaaacagcttgattcaactagatagagaagtggatatattattgtatatcgtctatatatttttcccacgtgaatatgtaataccgtaccatatgattctctttttaatccgtaacaaaatacgggcatattctagctactaatatgtacatatatgaactgcatgcagtccccattagtagtacttaatttgggaggtagttatattccatctgctgcaagttttcatactttgcacatgagaaaaatgaatgaattagtctggtgaaaaataagatgaagaaaatgctttaatgtggtggtttaattttttgctttgcttggttttatggtggtttgtagtttctagggttggcttacactggtggagaacggggctttactcccggttcgtaacccccctgtagtcccggttttcaaaccgggactatcaatccgggactaaagattgtgggtgaaaaaaccgggagtaaaaatctatttttagtcacggt

SEQ ID NO: 33042 - DNA, 4584 bp, Oryza sativa
aactataaacatattttaaaaagataaaagagaagatagaagagcagcgggctatagatatgtagccagctgcagcacggatttcaagacataatgtgtacgtgtatgacagatgggaccaggtattaatagtatagtaagcaactattgtatgaattagctattaaattggctatagatgatttggagctagtagttggctatactattaaccttgctttaagtgcaatcatgagttttcgtgtccaactttgatcgtccatcttatttgaaaattttttataattaatattttttatgagatgataaaaacatgaatattacttttctcgtgacttatgtttttaatttttttaaaaaaaatttaaataagacggacgatcaaatttgggcgcggaaaaccatggctgaggttaaaatgagatggagagagtattatgggtcagacactataaaaaacatttttttctggcggctaaaacctatatttcctagcggctagacgttcagcaagcaattagaagttagtccaaatcaacgatctttactgactgcatccgacatctagtgaaaatcagcaaaaataaaatcaaaaaatattttgatttttactaggcatataacacaactaagcatcctaattgataatttaggcaacttttcagattaaattcgcaggtatgtggtttgtataggattcaaactcaaagacctctctctacgcatatgtattacattaccatctcaccatgaagcacttattcagaatgctattgttttgattttcattgttcgaaacttaaaatacttatttgtctctctaaatgatttcaaataaaaaaattcatgaactacaaagttgtagatttcgtagagctctataactttggtacagatcatgtgtccatcaaaggttatttaaatcatatatctgaaatgttgtaaaatagatcttgaatcttataacgaatactagatctacaagtttggtataaattttattttcatttgactttttaggaaaaagttaggtacaaatgcatatttttctaaaattgattttcacaaacggacgtcttaaacgcacgccagtaaaaatcgattttcactagccgatgcttatgtcgtccgctagtaaaagtgaacgtgtttttcactgtcaagactatttttagtccatctgaaaaaaatgaaaggaaattgccatggaaaatcatttttttagtgaaagttacattaatttgaagactttacctaatgtctatccagtctaactgtgttgctatgcattaacatcgaaatataaatgctagttcctatttatataaatatatgcatgctggtccaccctctttaatttatcacttgctcgcttgatcgacacaagaagttgaaaaattactagttgatacctcgcacttgttacgatatatggataaatataggttatatattatagaaatgataaatgtatgtatttaaataatgtaaaaatgatgtggagatgatgatttgacattgcttatatactgaggtttaaaagtacaacaaaattatgaatgatatgccatgtttctatgaaatttaaaatactctaatcataattattagtggatgataatatgacacatttatatatattaagttctaaaagatagtgagtacaaactataaatgcatatcgatcaagtgcgcagcaacagcgtaaagtgcctgttgtctccatgataacgagactggttaaataggccggttggccgatcaaactctacatcctacccttttttgccttgcccctcaaaaagataaactcctatatgtacacagtactatcaattaaatactccctctatctacttttgatagtcatatttcatcttggcacatagaccaaggataagtaattctacttatcatccatttaaacatgccactagtcattcctcgtaaacaagcgattcattaatatttacatttctcgatgcacatgcagcctgtcaacgggtggtacccgtagaccggatatagagggtattggggtacgttggtacaagaatctacgtaatacgacatcaagcagacaaaagacgaggattatactggttcagaccccttggtaggtaatagccataatctagttgatgtgggattatatagtggaaaacacaagttacaaagggaacaatggaacttgacggatccggcgagatcgtggtcgagttggttcgactagatccccggcgacttggctccttgcgggctccgacttcgtaggctgtgagggtcgtgttggctctgagattcgatgccccaggtcctccctggggggtcccttttatatcgcaggtcaggcggtttccaagtagaactcggagataacagaccctatacgatacattgatgacccagtcttgtccgagtaagactcttcccatccgtagacttcgtgaatgatttccttagtgtacgcgggaagtatccgtatgcgcgtgggtatgccatgccgatatgtaacatatatcgaagggtaaagggtatgcctaacccataaccctgacagtagcccccgacttctgcttaaatgaactcgtgtaaccattcgcgacttgttgtgtcgagactgttgtcgttcccggtgtgaggaccatagagacaggacgtagtcgagaacaccgtgtgaagcccaacggtcacgagtgaatttaaactgaagtccaaaaaactgccgcgcgtaacggatccagaaatctccggcgggcatctctcccctttccttggaagtcgtaccgtcggaagtgtgtctatttaaaggaattttggggatccattttgaagtccgcctattgtgaagaaaacatcccgcctgtaagcgctcttcgtcttctccgctgccacaagaaaccctagttcatcgacctgagccctttctctggcgatctccgatcaacgatggatctcggcaaatcatcctccaccagtgtgtcactgaagaagcttcaggaagacggcgcccttcctggtcgcggaaccatggaaagggaagcaggaggtactaatccccagcccgtcttaggtcgcatggttgcgatcgaagactatattctctgcggttttctccttgtgccttccgaatttcttctcttggttttgaacttctacggtctttctcttctccatttgaaccccaactctatcgccttccttagcatcttttctcatctttgtgaggcctacattggggtagagccctttcttgatctctttcgcttctactacgagctgcgttggatggagtccaacagggtgtctggttgcgtcgggttccgacttcgggatggcctgaagtcgcgttatatccccttccagtgcccttcttctcgcaacaaatggcggactaggtggttctaccttcagatcaaagattcggaccctgtcttcgttgttcccaaagaacaaccggacaagatttcgtcttggaccgcaaagccccctttgaccccctctctccagtcgtttatcgacattatcgacgatctccgagtacgaggcttgtcggggtatgaagtcgctgcagacttcgttggtaggcggatccagccgctccaggctcgggcacatccagcctttgattattccggaccggaggatgcgacccgggtttctcctcggggtatctttctcgcatttatccagacatgctcatgttcgtgttcctcttgatttatcaaaatttggtctcgattcacaggtctgaacagcaaagctgtggaacgtcgtgttggccaagtgatgatcagtggtccgacaacggcgagtaccatccccgttcccttttgtgagaaaggtgcggctgaacgtgatgctgccatcaatgtaagtgtacccgataggcattctacgttttccttccgagatcacatcgtgacttgattaagcgtaggcccttcatctgactgacatcatcgagccgctcgcggaccatcaggtggcggcgtctctgaaagagaaggtcgccaaggaggcgtctgatgctgctgctgctactacaagtggtggcaatgttccgacaaaggggaggaagttctcctctgtgagcggacatcgtcgcaaggcatcaaccccctcggtaagctatcctgtcgtcaaatcgtacagccagaagaatttcgccttacttcgcatcgaccatttttcaggcctcggacacgtctctcccgcctccacgacgacaacgccttgtgacggttggcgagaagtaagttgatgaacttaagtttctgtgattttattcgagtgttgtctgaaccatgcccgtctcatagggcggcgcgggcgaaggctgggcaagacaagtccggagggacctccggcacgtcgcccgctgcggcctcgtcggatgtcatgctcgcacccgggggccgcgaggtgacaccaagcggcccagtcaacgatcccgcggctggccgtggtccaccggctaccgtcctcacctgggaggagctctaggttgagatggggcgcctcctcgaggctggtgctcgcggcatcggtcacgagattgtggaggcaaggggctgcaggaat

SEQ ID NO: 33043 - DNA, 20533 bp, Oryza sativa
gacctcaagaagatgagggagttggtggccggcaacgagcgacaacggcaggggctcgagcaccgcatgtcagagcttgggaacaatctgtcgaaaatccgtggctcattgcgggtcacctatactggtctgcaccagctcgccggggagtgtggcattaagtctactatcccggcgaatcccgacgagttctcgttgacatcttctcttgcggagctggcggcggcgatggaggagatcccctccaagcatgcggctaggatcggggaggagacatcgaacgggatctacaccggggcgtgccacgtccttgcgtgtgtaaagctggcgcatcctgaactcgatctgcgcgagatcttggatcagggggcggctagcaacacgcgtaaggagatgatggaagaagtcggtgacctgggggaatctgttctccccctttttgaagagtggggcctcttgtactccctagatatgctgtgtaaaactggatcttaaccgcctttgtgcgagcagttattattctagcttactcttgcatgttgatcttgaaagctttttgtcccttgtagagatgttgatgacgaggatgtccagcagcatgggcaacccgagtcaccggcgattattccggctctcacgtttgaccaacatgcatcgcccgacaatgtagaccaaacccttgcctcggggacggagatggcgaccacttccttaggttagtgatccattcatccctttttgcgcctctgactagatcacctatgttctcggaagaggcgtgtagcctgacttagtcgttcccacactgagcagatctcgagagtgctcttgctggccaagatcgtcgtatccaatattggaagacaaaatttgaagtagcggaactcgagagaactatggttgtagtgaagaaaaagcaggctgtggaaacgctccgaggtcgcgaggtgtggttcaactcgtacttgaagagttgctgcacatccatggccaaggtttgtagagagcttcgagtacctcgtggggatcccgaggagtccgcggctgggtacatctcgtggctgaacggagcctgtgctcaacttgatggcgtcggcaagtgtatcgacgaggccttgaagcaggaatgtcgtcgatcgagccgatatgccggagggcacgtgttggcttgtctacgagatcatcgcccgcgcctggacctcgattttctccgtgagggctttgctcgttctcggaggactccggcagagatagaccacctggcgaggtcgatggcgccgttggcggagaagatattccagtctatggattggcgttggccttcttggtagtcttcgtaccctgtgatagatatctcaggaaaaaggtgtaatatagctttggatttgtgtaaaaactgtaagaagtattttgtaaaatagaaaagaaatctatctttaacaaatctttcttactccggatgtcatgtgtaagagtgtgttctcagttcacgactttaatcagtcgtttgagtcgtacactctccctagcccccagccttgtcgtctgagggattttctcggaggataaggctcttggacctttgacctgccttggttgaataagctctgatcctagcccccagccgtgaagttggaaagttaatttccgatttcgcggcttggttaatatgcatggcgagaactcttacatgaccagatcttacatggtctttcgtctctacaggatctgacaaggccttatcggctctgggcgtccccagccgaagatcccttgggttcctcggaggccttgtcaagacggcgtaaagggacataaggataggtttcaacgctaggtgtcatcagggtaagggatcatcgggcgggaacactttgattctaatatgggcctaagaataggctttattgatactgtaaggtgtcttacaggtacggatggtattgactcatacatagaatttacgtagttggtcaatgttccaagaatttgctaacttgcgaccctcgccgtctgcaattttgaatgcgcctggccgcaagacttgtgtgatcgtgtaaggtccttcccatttgggtgagagtttgtttcgccctgcttggctttgaacccgtcggaggacgtagtcgccgatcgaaagtatgcgtgctcggatgcgcttctcgtggtaacggcggagggcctgttgatagctggctgctcgaatggcaactcgttcgcgatgttcctcgagtagatttacattgacgtttcgttgctcctcctggtcctcatcggaatgcttctgtactcgtgtactctgatgtcgtagctcgctagggagtatggcctccgagccgtacacgaggaagaagggtgtttcctagttggacgtcgtcggagtggtgtgtacgacccatagtactgatgggagttcttcgacccattttttgtcatgtgacatgagcctgtcgtagacgcgggttttgatcccttgtagtactatatcgtttgccctctcgacttgtctgttgctttgagggtgagagaacgaggcgaagcatatcttgactcccagcccgatgcagtaatcctggaagtcagcgctgatgaactgggagccgttgtcggttatgatgcggtgcggtagtccgtatctgcaaaatatccccttgatgaatttgatggcgttgtcagccttgatttcccccgtgggtagccaccctgtcctcgtgggaatggtccgagtatatctagcccccagcacgagaacggccacgtaagagggatagtctggagcgcttgcacgggtagctttgtgtgtttactgtggaattgacaggcttcacatcgctggaccatgtcgcatgcatctttaaggacggttggccagaaaaacccttgtcgaaaagctttcccgaccaatgtccgaccggcggcgtgtgacccacaaatgccttcatgtatatcaaggaggaggtgtctgccgtcgtcggacgagacgcatttgagaagtaccccgtttggcgctttcttgtatagatcgtcgccgaccatacagtagatctttgctttacgggttattttctcggcctctgtatcgtccttgggcagctcctcgctgttgatgaatttgattagtgggatgcgccagtcgtctgtggtctcgatatcggcaacggcgcgttctgcctttgtggcctccgagctaatgtcgggggtgtccgggctaacttcgccgctaacctctttcactgatggcttcgtcaggatgtccagaaaagtgccgggctcgagcggttctcgtctggacgcacgtcgtgctaggtcatctggctcgatgttgtctttgcggtagacgtgtcggacttcgatcccatcgaaccttttccctagcttcctgacttctgtgatatacttagataactcggggttagagcatttataatctttgtgcacctggttcgtgactagctcggagtcccctttcacgattagtcgcttgaccccaagtgcggctgcagctcttatcccggcgagtagtccctcgtattcggctgtgttattggtcgccctgaagttgaggtggattgcgtgcttgaattgatctccggaaggagacgtcaagataaatcctgcccctgctccttagctgttgagtgcaccatcgaacgccattgtccacgtttcgttatcgacttggttgtctgatttgttatcaggcatagtccaatcggctacaaagtcggcgagtacctgggacttgatggctgttcgtggcgcaaagtggacatcaaactggctcagctcgactacccatttcgcaatgcaaccgacaacgtatttgtttctcacgacttcaccgagaggaaaggaggagacaactgtgactctgtgggcttgaaagtagtggcgtagcttccttgatgtcatgatgaccgcgtaaagtagcttttggatctgtggatatcttgtctttgcatcgtggagagcttcgctgacgtagtagactggtcgttgtactttctctctctcgacaacgatgatggtgctaacggaatatggcgtggcggcaatatagaggaataattattcattaggttggggggcaacaagtacaggggggtttgataggtagcgcttgagtgcaacgaatgccttttcggcttcctgtgtccatacaaatttgtcttgcttcttcagcagagcgaagaaaggttgtcctcgttctcccatcttagcgacgaacctgctcaatgctgccatgcatccggttagcttctgtacttccttgagtcttgtgggtgacttcatgttctcgattgccttgatcttctcaggatttgcttctattcctctgccagagatgaggaaaccgagcagctttcccgacggtgctccgaacgtgcacttctctggattgagcatgaggcgatatcgtcggaggttgtcgaacgtttcccacagatcgtcaatcaatgagtcaaatgttttggtcttgacgacgatgtcgtcgacatatgcctcgacattgctgccgagctggtcgctaagtgcgccctggaccgtgtgctggaaggtatttcctgcggttatcagtccgaacggcatcttaacatagcaaaataccctgaacggcgtgatgaatgatgtcttctcttcgtcctcttttgccatgctgatttggtggtagccagagtaagcgtcgataaagctcaacagctcacagccggctgttgagtccaccagttgatctattcgaggaagagggaagtgatccttggggcatgccttattgaggtcggtgaagtcgacgcacattctccattttccgttggccttccgcaccatgactggattggctagccactctggatgaagtacttctttgatgaagccagctttgagaagtttgtcgagctcttctcgtatggcttgttttcggtctggtgcaaatctccgcagtctttgctttactggcttggcatcaggtcgcaccatgagtttgtgctcaattatctccctggggacccccgacatgtcggacggctgccaagcgaacacgtcagcattgtcgcggaggaaggtgatgagtacgagttcctatttctcggttagtgtcgccccgatctcgacgatcttgtcggggttggcactggagagtggaacgatcttgattgcgccgtccggtttcggcgtcttgtttgttttgctcactttcttgggtggctcagtcgtggcgggtgggctgggcgtttgctcaactatgtcgaggctccgtttgtcgcattgcaccgccagctttgtgttcccttgaatagtgattgttcccttcggtcccggcatcttgagcacttgatacgcgtagtgagatgcggccataaacttcgcaagtgcagttctcccgatgatggcgttgtaagctgtatcgaattcagcgacatcaaaggtgatctgctctgttcggaagttgttggattggccaaaagtcacaggcaacgtaatcttgcccaatggtctggacgaggattggggagtaattccatgaaagggttgatcggttggtgtcaactcgctttgtggaattcccatcgcgtccagagtgctggtgaaaagaaggttgattgagctgccaccgtcgatgaggactcgtgcgaccttgatgttccgaatagtgggttcgaccacgatcggatatattcctggaatgacggcggtcttggggtggtcttcttccgagaactctatcttctgttcagaccacttcatcttgggtgcagcccccaaccatgtcgaacagacttcgcgttccactttcttatactctcgcttcgaggagtatgttgtggaatctccgaagatgtgtgaaacgtggaggtcagggtctggatatgctgagtctgattcctggggagccgcctccacgtccttttcgaccacgcgtactcgtttgcctttttcagatgcaatgtgcttctcgagcgattttttgaaaacaaagcaatcttccaaaacatgtatgtccgtcttgtgtatggggcaccatgctttctttgtgtcgctactttgtgggtctgggcgcttgggagggttcgcgtattctgctgcgaggacttccgcttgagctttccttttcccatttttgcgattcttcttcttgcttgactcaggtgcgtcagtggctgatttcttctctcccccggtcttcggcttatcgttcttgcgtcttagcgcatcatctgcgtgggcgcatcgctcaacaatctcgaacaatctccgattggttgtgatgcgtcttgtcgccaactcctgggtagtatagcgatctctaacaccggatttgaaggcacgaattacagaagcgtcggtgattttggggattgtatttctgcactcgttgaagcgctgaacatattccctcaaggattcacccgggttctgtgtcaacgcgtgtaggtcgtcttcgatcgcgtggcgcttgtaggttccttggaagttggcgacgaactgctgccacaggtctgcccacgaagagattgagtagggcggaagatgcatcagccatgaacgtgcggagccttttaacgcagttggcaaataattcgccaatgcgttgtcgtctgctccggcagcgtagagtactgtggagtagacttgaaggaactcttctgggtcggtgctcccatcgtatttctctattgctcggggtcggaatctctcaggccatcggacatcacgtagggaacgactgaaagccctacacccagcgctgggggcggtgggttgtcggcgatcgtgtgtccttcatggatgtctgtctgatgatgaggaagacgaggatgatgacgatgatgatgggtcgtttggttctggcgtacgattacgaggatgtcggcttggatctggagaatcctgtcgtcgtctcccgctgttgtcttggcgccagtctccatcatcgtcgtcgttatggcgacgtcctcgatcagtatcgtttggcacccgccgttcgcgatcgttgtgatcgtggtggttgtggcggttatcacggtctcggtcctcgtttgagcggtctcctcgatcttcgttatcatggcaccgtgaagagacatgacgtcgggaacgattctcattgtctcatgtgcgtcgtgcctctcggcggccgttgatgtgatctcggagatcgccagtgccacgaggtggaggggtagctcgctgaggcaattccctccgttcagggttttcaccgttggcatcgccagttggtggctgctctgggtgtgctgcggcagcggcctcttcgaacgcgttactgaggttggtcactgattcccgtagtcgttctgtccaacgcgcgagattgtcgttcagaacgggatcgtagggggtttccctcagtatagcgttgacggctctgatgtgctgagctggagtggtcaattgattctccgcttctgcattggtgcacgctgatatgccgacatcatcgatagccaatacctcccgaggcgcgcttgtgaaggtgcaagactgatggttcgtgaggatcgatatcgattaccccaacaaatcgatctgaagttggcgtcgctcctcgttccttgtctttatcccagatggggatgtgtgactgttggaccttaggggatggcgcttccatggcgctggaaaagaccttgcagcttgaaaggtcgtgattctttgtcttgtgaataggacaatagacagcacgagttggagaaatacgctgaattccacgctctttgtaggcgcaaatttcagcgcggacgttgaggaaaacccagcaggcttgcaaagtgtgtttcctggttttgtggataggacaccaggaccttgtcgcttcggaagtcatcttcgtcggctcgcggttcatgtcggaacgacaaggtttggccacattagaatccttcttgagctcggatgtcgtcgatactccgttctccgcctcggcgggaggatttttcgacatggagtcgccttggtttgtagccactgcgttctcgtttccagtcattggcggaccggttgagatcggcgtcgtggtgtaaaccgggaagacgatttcgctaacttgggtccacaccagcatcgttgaagcagggaatacttggctgaggttggtgttgacgctgttgtcgacgaggctggatgacatagtagtagaaccttgagtaccaagggcccctacctggcgcgccactgtcgacgggtggtacccgtagaccggatatagagggtattggggtacgttggtacaaggatctacgtaatacgacatcaagcagacaaaagacgaggattatactggttcagaccccttggtaggtaatagccctaatccagttgatgtgggattatatagtggaaaacacaggttacaaagggaacaatggaacttgacggatccggcgagatcgtggtcgagttggttcgactagatccccggcgacttggctccttgcgggctccgacttcgtaggctgtgagggttgtgttggctctgagattcaatgccctaggtcctccccggggagtcccttttatatcgcaggttagacggtttccaagtagaactcggagataacagaccctatacgatacattgatgacctagtgttatccgagtaagactcttcccattcgtagacttcgtgaaggatttccttagtgtacgcgggaagtatccgtatgcgcgtgggtatgccatgccgatatgtaacgtatatcgaaaggtaaagggtatgcctaacccgtaaccctgacacagccaatcttgtgtggaagaatagagagtcacacattaattctgagaaagtcattaagatgataggttgttggattgaaatatgcctatcaaaaataaatttttcagatttggaaatatgactatcaaaagtagatggagggaatatatagcaggccagtccatgcattcattaaaattcaattttgtcccttttatgagtttactgtagcactacaaacaggtgcttggtttattttgaaaaatggatttatgttctttcaaatagtctacatttaaccgtacgcacaccacactcgcgcaccagtgtcaaccatctgcaaattcatagtcacaataaaatccaatagaaagcgcactgtgaccaaagtaatgttagtggtggacgtaggattctaaaaatgcttgggggcacaaagttgaaataggtagcatcaatatatgacaaaacctaaagcgtatcaaaggaaacaaaacatttttatgttgaaaataataaattacgtacactaagaaaattacttataattaattgtagttgttttttattgttatttgcaattctgaaagcaaatacagcgtgctgttaaccatatatatatatatatatatatatatatatatatatatatatatatatatatatatatatatatatatatatatatatatatatatatcacacttttaactatctatcaggaaataatgtgaacatcacattgtatatatatatctctatgctaaaagtcaatatttggttgttttcacttttcacagacaaatgtgtagcactttcgtggaacatgtagcttaattattcaacgcatggtgccatatagtataatgcatggttgcaatataattgaccggtgaggtgagttgtacctatacttgtcaaaatgtcattctcaggctctcaacgaagaatattgttgccctccttcagaccatcacattattctccataattatgcactcaattaatctccaccagtaggcttcattttcgtaattatttcgttttagtctagaatgaaagacaagtacatatctatataaagtatatacatagccgtatatagtaaatttgattaagttcctagcttggttatttattaaatactccaatatatattgcattttgcatgaagtattttacagtgaattaatgatgcacaaagatgattaatagttttgaccaaattaaaatgaatggttaggaatacgcgcattgaacagaagattagctaggtgtaatggttactccctccgtctcaaaatagatcaatttaggtatataaatttgaacatatacatcactaaattagcgtataaaagttgatttttctttcgaggctaaatgtagtagtaactgaacagaaagcctagctagcttcgaggtgctaggtaagctaggtgcactgtaccaagtgacacctgaacaaaaagatcatccatgcatgcattgacgaccgcatggagtagtctactggctactacctcaaagttttcacatttatctacacgtgttatcacttgtgcagattcctgtaaagaatgaagttttctttacggatgtatagcgtattataattaaattgatacgtatgtacttcccgtacggatcccaaagaagttgctttataataattaaagctcaattagtcaggcgctaatatttttcttgttttacgtatcctaacttatcttcatcttccttaaaaaataacaccacctaaatataacaacacaatggtacgtatatatatagctggttaatttgagctgaaactatgctattttcagttaatccggtagagaaagaaattagattggattgagaacattaattcattttacaccaaaatagatgtgaatttattccgcacctaatttggtttcaatccctttgaaaggtctcaacaatatggaattaatggtggaaggcagtaccaaatcatcgatcgtctaattaaggctgaaaattgttaaaccgtcgtaatggatagatggatctgatataattaggagtagagtagtagtaacacagtatatatattcatatatatactgctccctcttttcacaaatatatttctaaaacacataaaattaaaattcgtatattttaaaatgatggaagtaagtatttctagattgtattggagagattaaggatgtaaaaaaagtataatgtgttttatccattgagagatggttggatcaagaatgtaaaaaaagaagtcataatgtgttttattgtatcgagagattgttgagggcagtgtggttcagatcgataatagacagagaaatttaaatactaattaagagataggagtaactgatagagacaagtataacttttaaaatacttaccctgctttctcaatctcaaaataagttaatttttcttctgccctgcatatcaatataaaattaaaaagtctgggaatcccactttattaatcccaatgtagttattgctctctttttctattatcaatatatttatcctctattttacaaattctgatgcagtgaatacttcaaaataattttaggataaaaagaagacgataaaaaattggacccattctaagatggagggagtatggggttacgcttgagatggttaagtttgcggaaaaataatcaaaactagtatgggttcagattcataatgctagcatatatactttattggtctaattttagattaatttttagaattggattttttataaatagagagaatattatatttcatctactagatttgtttgttttggatgggaaataggcagcgtcgtcgtgtagtctcatcgtgtggtctcatctctggatatgatggatctatgtgctgctatatgcaaggcaatgcatggtcagatctgggtcaggtcgtcctgcagagcagtgcagtggagtactgcggtagctgtgtttggcatgcatgcaacagtggcttttggtcagagcaactgccagtggagaccatatggcccggagatccatggcctctgtagctttgcttttctggccctgtgcaacaagcaccagcagctggctttactgcattagcaagcaccacattgtttaatagccgtgtgattgtgcccatgcatggccattgggatgcatgagaggaagcaactaagggtatttttgctagcctttaggtgattgaaatcgcttgtctgggcatccaacagccaggggtagttctttcagtgattggaagctcttcctcttctccgatacctgctatgaataaagggaggggtaaggaagaaggggtaactaatcaacaacgatgataattgcaatagcaaccaggtttggtgggagtattcttgcccgcagctgcaggggattacaacaggaaagggttcgactcccttgtcctccttgttacatggcacttgtggttgaaaagaaatgctcgtgttttcaaggagatacttttcatggtggagatggtggtgttcatcgtatcgttcaataaggaaagctttgggttgtggcgttatctagtcccctaaaagttcttcttggcgtttagatacaagctctttctctttttttgttttcaggaatttggttgtctttcctagttaatctagtgtgcccgccatctctcctgtaaccccccatgacctgcatcagctagtcgtggttgtaaaatctcctttccccctattaatatatcgatgtgcaaggcttttgcacgtttgaaaaaaatgatagcaatattctttcagtgattaattgtgagctcttcttcttctctgatgcccttttgatgattgccatggattggattaggtttcaagagggtggttaaggtgggagggggggttaagaaagaggggaagggggttttccctaggcttagaggggcagtagtggcgacggtcagagcagtggtgggtagtggccagcgagcaatggaggacagcggtggcactgtcggagccatggggctagaggtggtggcaggcagggttggcatcgaaagacgacagcaaatgagactggttatgataggagccaccggcgatgaggaaggaccgacagggtaggggcttcacatcattgtatttggagaagaagaacatcggacaaagggggaagggcgggaggaggccggtctagtaggcatcaccaacaccggcaaggccaaggtgttgtgtgggaagcggagcacgcggcatcagcacaagctttctcatcccaagcacatcgtgaatgaggagggaggaggaggagataaggttactatttttccctctgtaaagaaaatgctaattctaattccctcctctttcatgaagccatatcacttcaactatttttagtctttggaccattcatcaagggtacaaattgcatcttttttccccaaaagccacactatacaacccaatcatttataaccttttggatatttgatcaaggtataatatataagcacacaatagaaaatcgtatagtatgtaagaaatctatatatctataaagttgatcttcactaaggctgtgttcgtttgtgtgagatagggtgagaaaacaactcgttttccgcgcgcacgcttcccaaactactaaacgatgcgttttttgcaaaaattttctataggaaagttgttttaaaaaatcatattaatccatttttgaaatttaaaatagtttatactcaattaatcatgcgctaatggctcatctcgttttgcgtatctttccaatcttctcaatcccctatctctcaaactcaccctaagtgtagttatgatatgcatcaccttaattgtttttagcctttgaatgattcatcaaaaatgcaaattgtatattttctctccaaaagtcacaccatacaacctaatcatttataacctttggataattgattaaggtaaaaaaatatatagtaaccaagaaataaaattttacaactcatatatactattttatcacacacttctcccgcaaacaacgcgttgggtacccatctaaaactagttaatcacacaaattatcataccttctatatgttgtgcagttaattacccattagttacacaaaatagttttcttaaattaaagataatagtatttagtagtaaccgtcgtttacccgtaccacgcacgcaaaagcttggtctgggtctgtgggtgcgggtggctggcctatgttttggtttggccggtggtggccggggaggtacggattgaacacagctgaggatggcattgaccttcctttttccttttggttttttctttctctggactggatctggatcatccatgcggctctagatgccgatgccaatgccatgcctgcctctgcctgctgccaaccaaaaagatgcatgcatgtcctcctaccttcctatacataggattcctgcatgcatgctccttcatcatctctttcattcacttgattatttctcttacgattcattatttcatgaaaaaaaaccttgtttaccatgtaaacatttataattatttatactcgaaaaaacaaatgagactagtgatgagatatatcatatcgtgtgtttgatttaacactcaataaaagtatgaaaccataccaaaaaaaaatgctaatggcgactgacttcggtgttcattttggtttgttgcaaaaaacaaaagaagaagaagaagaagaagaagaagaagaagaagaagaagaagaagaagaacataattccaatatgttggcaaagctaactaaaagctttgaagtaacattgtcaaaactcttactttgctaaaattttggcttgctagggagtatttttaaatggatgcaatcaaacaagcccatatataagaacgcatgatgttgtggttattatctactactctactatatactacttaaaaaataagaggtgcttccatcgtccgtcaaaaaaaccgggtgaaaaaaaaaccgggcagaaaaaaccaagtttgtccgatcataaaaaccggacgaaaaaaaagtccgatccaaaaaaaagtgaaaaaaaaaccgggcgaaaaaaacacctgtccctggcaaaaaaacacccgatcccttaaaagggaaaaaaaagtccgagagacaaaccgtttaatgaataaaaaaagcgaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaaagaaaagtccgataaaaaaacctagtgaaaaaaaaccgggcggaaaaaaaacaaatatgtccgacaaaaaaaaaggaaaaaaaaggaaaaaataccgaaacgaatccgactacatcgacgcggtaaaaagagtttaaaaaaataaaaagaaaactatcctattccaaagaaaaatgaattatatgtatcgtggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaaattgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatctgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaagggaaaaaatcaaaacgattccgactccgttgacgcgataaaaaagggcgaaaaaattgtctgtttctaaagaaaaaggaattatacgcgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgtttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacgtggttatgcatgaaaaacgtatattatcattacgttttttcacccgttgcaacgcacgggcatatttgctagtataactccaaagatgactataatacgttaattaaaggggaggcattatacctggtttattacgcttgagggaggtgatccaatcaggagcaagagctaagggggtcaaatagacttattccttattggactaaccttatgcactgacagcccagaaaaattggaatatgtatgggctcctgccttcccttcccaatgggccaatgagccatcttttcatccactaggccatatatattgctttcctccacaagatgaaaggagaaagttcattttgactcccttaactagtgaccgaatctaattcgtacccctcaaccacaataccggatatctcgaacccccaactattaaaatcagtgtaatttgactccctcggtggttttggagggcggtttcgctgacatggcgcctacgtggcggtattgacctgttcttcgttccacatggtgctaacgcggcgcgtaggtggcattagaattaaaatttatgtgtggggcctatttgtcattcacaaaaatatgtgtgggacccactaacatgtgggccccacatctcatgctctctgatcttcctcctccctctcctcgtcgctcccttctctctctttcctctcactctctctctttcccgcggtgggaggcgagggctagagacgacggtgagcggcggagacgacggaaggcgcgacggagatgcggaaatggcagcggctcgattccccagctgtcgccgctcccgccccagatgagctcaatgtgtggcacccgcggtggtcgggccgaacgacacggctgtgttcgcggcgtcagatggatggatggggtcatggcggtagccggcgacgagcggcacagcttggcggcggagctgtgcgactaaacgtcatcgtcgacgaccgaattgacgtagagggtggtcgccatcgaggatgccatggcgggaacaaggagctgactccttgaggaaaagaggagtcggctggcgttgttcccactttgccgtcaccgccctcccaacctcttgtcgccgtcacaaccttcccggcttcgtgtagccgccttcgttggagaagacgaagaagcatcgagtcggagaagcaaaacggcggcaacagcagtggtagaacgtcgtttggaagagcggcagccaccgccttcgtccttctgtgccttccgctccctcgctgcctctgatagcctagccgccccgaccacaaaagagatgggggaggtcactcctcgtcactgcctttcggtgctcccaccctgagcccgccctggacacagcgtgcgagggccgcgcggacctcatccgccactgccgccctccccgagtcctggcctctctgccgtggaagaggaagagggaaaagaaggagagggaggggagaaatgggaagaaacggaggggatggattgcagcggcaagtcacagctcgagctccgcaatggtgatcggcagagaccggatttggggggtttcggcagtggtggtgattgggcgccagcgaggtgtggattgggatttctgggaggagagaagctcgactgtggtggtggcttggttgatcggggactgaaagaggtctaatcgaagtcgcgagctcgcaaaggggacccgaccctcgctcgcccaccctcccgcccgccaccaccactgcctgccgacggcccctgtcccacgctcgccgatggggaagagaaagagaggggggaggaagaaggaagaagagagagcatgagatgtggggccacatgtctatgggtcccacacatatttttttaatgacaaatgggcccccaaacatattttttaattctaatgccacctaatcgacacgtcagcgccgaatggggacgaagaccaggtcaatattgccacgtagacaccacgtcagcaaaaccgccctctaaaaccgccaagggagttaaattgcaccggttttaatagttggggggtcgagatatccgtaattgtggttcagggatatgaatcagattcgatcactagttaagggaatcaaagtgaacttattcccaagatgaaatccctagcgaggaacatctcactctttctaggaaaagcaatttcccattgatttcatcaaacatctctctatattccaaagatgaccgatcattccttttcatcctattcccaataaaaacatatatattctcccatggtttcttcctccaacaactcataatcgttgctactcatcaaatatcaaattacattatgaatccacaaaaccaaattgtttgttaatccttaatatgaccttgtctcttccctggctgccaaaaataagaggatgtttggtttgatgcctaatatggccacgtctcatgttatatgtaaatgtatttccgtgtctgcatgattgaattccatgatcgtgcttactcatactttttaggcaataatttgatttagattattgaacaaattattgttatagattatttacaaattaaatattttaagaaataaacagtgatcttgatgatgttgcagaaatttttttttaaaaaaagaaaatatttttctcaaggcgtggagctaacgtattcatatgccaattaaatttgcgtcaagctttttgttattactcgtacttttgctattgtagttggattgacaaattttaaccatgaatcaaattaaacaacccaaagagagatcttgtcctgtgtgccgtggggacaacataaaagagagaaagtaataaggtcaatagttttccaaaattattaatctccctacaatagaaactcaaagtcccatcttacatattttggaccatccaattcaatctgagatttgtacaccatgacattttcttcacattccggtgagctctttgatcttaggaggcccagtccagttaagatatagggttaaggttgaggcggggtagaagaaagaggagagagttcctcaagttttagaaggatggttgtaaaatacaagaacttgatagtaatttatgggcggtggaacgaccaatgttgatagctcagagcacaacgagctaggaggcagtggtgtctttgatggtgaggagtcgtcaaagacaacgggatggggacacctcaccatcatcagcttgagaaataggatagggagggagggtgaggtctgatgaaccccgctggtactgttggcgtattctataattggtgaggcatataacaatatttgtatgttagttgttggggaggaggggtatcgggcggagaggtggcggcgttcggagtgaggagcgagaaaatgagtggttagggttgggcacttcacgaatctcaaagtgatccaacggtcaagaaccccgcaaaatatttaggttttttttttcaaacaggtactcaaagttattttagggaggaagtgtaaggacaaatataaactggccattgacagaaaaataattaaaaaagaagaagaagaaagaggaagaaaagggggaggggggaagagagagaagcagggggcggggcggacatggatccccggcggcgggcggatttgtccgtggggtgggcggatctcccgccggagctcctggaaggaatcatgaagctgatgagccccctggagcgtgtcaccgtccgcctcgtctgctcctcctggcgcacctgcgcccgtgcctccttcccctccgacctcgccttcgaggccccgcgcctcctcctccgccgccctgggcccccccggggacctctcgccttcttcagcctccgccgcgccgagatcctccccttcgccctccccgcccgcctcagcgccgcccgctgctgcggccacatgggcggttggctcgccatggccttggacgacgaccgcgagatcgccctgtgcagcgtcacgtccggcgaatccgtgggcatccctcggccccccgtgttcccggtggcgaaggtggtgctgtcggcgccgcccaccacgcggggatgggtggtggcggtgctggggcggtcgggcacgatcgcgctgctgccaccggacccggagggggagggcg

SEQ ID NO: 33044 - DNA, 13926 bp, Oryza sativa
  unsure (1)..(13926): unsure at all n locations
gggtgcggtggcgggtgtgtatgtacctggtggtggacatgtcggggtcgctggtggtggtgcagagggagtacagcgtgcggcgggacgcggtggaggtggaggtggaggtgtcccggttcgcggcggaggagcgcaagtgggaggcggtggaggagctggcggcgggggaggcgctgttcgtggggtcggtggtgtcggtggcggcgcgggccacggaggggtccgggatcagggggaactgcgtgtacatggcgcggagggaggtggagttgatcgcgccgcacgccatcggcgtctactccctggccgacggggaggcggatgggttggccatctccggcggccactcgctcgccgcggagcctgtctggatcgccccctcgctcgcctgatccagattactccagctgcaacagcaatttatcaatcatgaatcaggaatcgatgagatcgtgttcgatcgtgtgttcgtgccgcctcgcttgcaaacccaacaataattactactccactagctagtagtactacttgagttcacaaccgtgctaggctttgctgtgaacaagtgtgttgatctgatggatgcagcaatttgctgctgttgtcgtcagtctaaatttgtactagtagctgtttgcaatgcaatagagagtgtatcgatgggactatctaattttgcttatagctgctgctgatgcttcatatttcttattgttgttggttcgatttatgttgtcttcttcctcttctgttctccgattgcttctgctctcatcttcttccttgcattccatggcaaaggaaacgaggcacagctcagctactgccaccgtggaaaaaggagcgagaaaaagtgagagcgcgatatgttgatgtttggggcctaatgggctttgtgtttgatatggggccgatgaagttttttttttctgggccgtaacggtggcccatggacattcctctagcagcctagccgcagcgggcgagggttggttggtggaggtggatgggaaacccaagaaaatacgaggacgacggcggcggcgacgattccaacgagaggagaagcgcaaggaggataggcggcggcggcgactgggcgaaagtgatcagagctcgcgaggatgaaggcgacggtgaagggcaggtacgagggcgacaaggccacggccgccgccaccctcgccttcaccccctccgccgccgacctccgcttcaaggcctccgccaccgatgccgccttcgcccgcgggccctccctcgagggcctcatcctcaccctcgagaagcccggctccttcctcctcgacctcaagccccactccaaggtacgggtctactactatttcttcttcttcttcctctcgccgcgcgctatcaatcaatcaatcgatccccatttcctcctcctcctcttcctgcaggatgtgcgcttccaattcatgaactccgcgctgctgctcgaccgccgcgtcagcctcacctacacgcactccaccaccctctccccgggccccgccaagctgcccgcccgcaccgccctcgacggctccctcaccttcgatccggccaacaagctcagcctctcccacacgctcggctcctccggatgccgcgtcaagtactcctacgcgcacggccaagaccgcctcaccaccatcgagccctgcttcgacaccgctaacaacgcctgggacttcgccgtcacccgcaagtttcaaggaggggatgccatcaaggccacctaccaagcctccaccaagctcctcgccctcgactggaccagggactccaagatcggtgcctccttcaaggtcacctcccttttatccttacttcccttgcctatccatgccatcttcaattatctctgtttcgattgccaatgttcaatttcaataccttagttttgaatcagaattacaaaaattgaaaggatcgctgctaggtatggaactgaacatcttgttgtcagtctaggactaatccaaatctgcgctaagtacaggcttattcccattttactactgtaaccattttgctccccactcgatgatgtgcaactgcacaagtacgaacatcatcaactagtgaagtggctgtgcgtatctatccatggaccatgggtggtgcgaaattgttggggactggggacttggggaatgcagaaagatagtttgaatacatcctcctctatcattgctagaaatgtatgcatctcatgctcacttccctttggaagccaaatctagttttcttttttggggctattgcattcttaccctcattttgaagtccaattgtgattttgccctcacttttagggtttgcgtttttgcccctgttttattgaaacgaagcaaagctttacccctagtttggatgatcaatttaacggtgttaagttgagtgtaaaactacatttttgcccttgcttcctattgtatatttccctctacctttggacaacacttgtgaagttacccctagtttgtgtatgaaacttgtaactgttttgaactgacatttcatgaaatgattcaaatctgaactgatttttacaaacttttaccgaaatcaaacaaaattttgcacaccagtttcatcactaacaggatcacaacatttatattacaaacaaatctgggagcagcacgcctcaaccattatcacgctgtttaattcatagcaaaactgtgcaaacatcaagcatgcatgaactcatgaaggaacaatcgacaatgggagttgcacgcgaagtgttaaactgcagatagagtaatgatacagcatccagtgtgtcaacatagcggccatctaaactcaatatcgttgctatctatagcactgaatacagaattactgaattacctatagcactgaatatcagtgtgccaacatggctgatagcatatcagaattacctatagcactgaaaacagcccgtcagcccgtgcttgcaacttcaacttctttgtgtgtgaaatcactccatcatggccatctaaactcaatatcattgctacctggaaaactagacaaccaccatcgcctgttgcttgccagcacgctgaggagccgccgcctggtgctcgcgttgaggggtagtcgccgccgccgtcgcctgctgctcgcgtcgttgtgtgaggagccgccgtctccgcctgctgctcgcctcaccacgccaagagccaccgccaccgcctggtgcttgcatcactgcgtcgaggagccatcctctccgcctactgctcgcctcgccacgccgaggagccaccgccgcctgctgctgctcgcgtcaccgcatcgaggagccttcgtctccgtcgcgcgccaagccggctcgccggagctgccatcggtgccaccgccacgtgatctatctacgatttggggatgggagcagtgggggtgaggagaacatgtaatgttatgatactattactaggggcagattggtaatctaatattttcttaattaatttttctttttcatttctattttttaatccaatattgtgggacccacctaactgccatccatagttgggtcaaacggtgatttcgttttgaagaaacaggggtaaatatgcaaaccctaaaaagtgagggtaaaatcacaattagggttgaaagttggggcatgatcacgattatttctttttaaaacctttctgtactcatccaaacaaatcgtgattcttttcgtgtgaggaacttgagaggaaaatgttagtgtataaaaatataacttttagtgaagaaattcattggaaagatgtttcagtatgtttgtatatgttttcttttctttccatcgtgactcttttcttatatttcagtatgctacttcactatatgtttcacacagtactttctatggttttgcaatggctgtctgatttatcttggtggttctgaaggatttgctatgatcagtttatgaaaaccttcttttgttgcatagagaacaagtgcctgtctgtttattaagctgccaatgttgttctttagagttccttgtgagcaatagttctcaaatatcatagggtcactttaggatggataattctagtaggatctagattggaaggatggggatagagcctgaagaaacatgaggaagcaaaatgggtgagttgacttgaaagaacattgagttgttgatctcacagggatgtatgtggaagatttttggccataaaactgtggtagctctctatactatgtgcttatttatgcatcaagtgaatagagatctaaatatctagaccgtctgttttcactttatacaacgtatattattctaacatctcctaggtcctccaatataaatgtgttgtcaagatggccttttggcttttcataggcgaatataactttaaaatggttagctttatagtcttgtcagttccattgcagaaaagtgacttagatattacataccattttttattgaaaggtcattttgtattcacatttgtcagttctggtccaagttttagaccctcatattaaaccctgggaaagagctgaagtagattggttcgtaagggcatctacaattctccagctcagctgactcatggcctcagccacattggactccagctgaggtggaagagagttaatgcacccaacaaagctttattctttgagccgttgttacatgcagagtcgactcttcacgcgaattagagggagattgaactgtattgtatagccaataaacggtgattagggatggatcccactaaatatactactaaatattggagagtttaacagataaatgcattgtatgtgttagctcatgcatcaacaacccttaatgatatggatgggttttgggccggcttaagagtcagccttcatgacatgccttaactgatactggtacagaagggtgctgactttattctaacttatctaaagaagactatcttcctatatctcagtctcacacagagagaccatgatatgtgccacaatgcaatatcgtaattctgtgaccatattgtgctattgatggcaaagaacaaatatttggctagttatattgatttgttgcctgcttgtttgagttcatttaacaaagaatgtcaatagtactttttgttcaaaaaggtacccatgcaaccctgcttaaatccgcaacaaggcactggtgtgctgtctgactagctccttccgaacattgaaagcaacttgctatgctattttcactatagatgtttgtagaggttgtactcttatagctaccgaccatgtttttcatcttgaccatgttatgcttctctcttcaggtcgcagcgtcatttgatctgtctgaccaaagcaaagcgccaaagctaatagcggagagcacgtggaattacgagatctgattgcctcttctaggaggcaggcaactcctgcttaagaagcacccttgtcatactggttgtcttgtacttgggaactattctttctgggtgcaacaatttcaatacctactgccctttgttcatttttggctgccctatgattggagttgtcatggcgatgctacggcattgacaatgaacaccgattatcttttactatattctctaatgcacatgatatgattgaacaaaatgcctttggtggcgagaattcgagcattggtgtttgctccttgttcagatatacggttgatgttctttccttccttctgggagcttgtaaaacgttgaattagcttgccacatttttgttacatttgtttggacaagacaaggtgggcagaaggcaaaagaaggaagaagctaaagagtggttgttgatgatgttctatacttcttccttatcgtacttatattattaaagagtggttgaaaaggaactatcacttttgttatatttgtgtggacaaaacaaggtgggcataaggtagaagcatcagctagctttggtgggtggtacatatgccgtgtagttaccgtggattggatgactgaatatctatcagtatatgagaaaaggagagacctgtaaacttatacatacattaatgaaaaaagatagaaattttgaccactaaatcatggtggacctaaattataaggggaaatatatgagaaaatatatagtgcaaacctcataatgttgtgtaaacctaaaaattatcgttgaatttgaaaacgatatttgtccatatcaccctgagtaaaacttttcctctcagtatgtttatttttagatccaagagtaattttcaggtttgcactatatattttactagattataatggtataaatcaattgatatgattgtaaaattgtgtatatgaaattgagcactggttagaaatcctttggtcgcccgtatcctccacagtcccacttgaccgtcagaattgaacctggtcctggggcatgcaagagttgaaacttgaaagatcaaagctattgcatcagcaggtgactatgtgattcttcaccacttgtattacaaaaaaatggcatccatttcattctggcggtgaatatgaaattggcaataacatgaccataaagcgaagaccatcaagccaaactgtccataaaagtttgtttctctacaccctggaacccactaaaacagcgcctggttggataactataaatctgatgaaaattcacaaaatccagaagaattgcagggctgtgccggccggtatctcaatttgggactcatcgggttcttgagaaaattattaaggtactgactgactgactcatggagctagctgctgctacactaataagggcatgtttgagggagctttagattctaagaaacagctgtttggtagccagcttctgagaatctggaaaagctctgaaacccagcttctccagcttctggctccttagttcatttttcagaatctgtaactacagattctcagaagctgtggactgtttgggggagcttctagcaagctgcagctaggagaactcccccaaacaagacctaaaactaatcgaatactactacccacttagaaaaagaaaaaaaaactaatactactacaggagtacatttgtgccacaggatcctcaggagaatatatagccactagttatggtctttcgaaaggcatcatcgttactatctctcgtcagcttccaactagagtaactaaagtaactgtatgtatatttgcatcttgtgtgactgcatgtatttgttcggctattctcttgatgacacatgaacatgccaggaaagtttcttagcctttcagccgctctgtatttcatcactcataccagtggcactcctaactcctcatgtcaaatcggagtaaaaactgaggcaggagggaaaaaagacaaatcgaatcacaaggatttcatcatcgatcagtgccagataatagtaccgcatgagattctttcaaaaatctcgttgaaactgcaatggacgttgttgttactcaatctcgtacaaacttatttgtctccgttaacctctacactctaaaagaatactcgaccagaaaaaacatggcttatcctaaaggcattttggtccacaaactaactctgtcggtccgttgtggtggttgatatatatgaatttttctctctaatttatagatattatctgaaaccggtcaaataaaagatgtacgaacggtgtaaaattaagggttggtggagatagcatatcatcttgcgaatcaagcatacacacaaacacttcatttgataggctcaatctcacaatcactatatgcatatataatatcataaaggaagaggaatctacatatcactagctgcaaattctggcgaatgcatgcttcacttatatgttcaaatgaattaagctagctagctaacgacggattaattcatctttatcgatcgaatgttcgtttatgcccatctttgagccaaaagctggagatagttgctgtttaatatcgttcctttagatataccttacaaatatagatatattgttaggcataaaggaaggtttgacgaagtttagccacaatatatatgtattttgctcagatgaaatggatcctggccggccgtgtacatacgtcataggccatgccaaattcgtacgtgatttgctaataatctttttttttcagtatactaaatactaaatttcttaaaggtgctagatttgccggcttcccagcgatttggacagacggcagccaatacggtgtgcacacgttgatttttaataggtgatctggtggttaggcaggttagtggttgtatggcccaaatgcctctctagcccaacacggcctgttcctgcccatcgccagtccggtttgccggccttgtgcgctcgtcgtttccctgtgcgctcatctgtcggtgggtctgccattcagctcgcgacgcgtgtgcttcctgtatgctgggcccggttagcattggccgagccgctatcttcctcagctcctccgctttggtcgtgaatcggtgccaccgcgtgtcggccatcggcgaggctctagcgctcagagtcgctgggccgctcctctctctatccgcccctgtctcgactctcgagctatgatggtggactgctatggcgtacagcggtgacgggattggctgctgctcactgctccactacgcggagagccccatgaccatggccaggcgatggtttgtccatttccctccctttcttctacagagagcgctagttctattctttcttgctcttcctcagctcatctttttttctccgcacggtatcgtcgttgatcgtatcctcccttgtgctatgttgttttcctcctacgccttgctctagattgcgccgttgtggttcgagggttctttcgatcatgcgtgtgcccactgatttttgggttttctgctttctaggctgcactgctggattggggattctctgttggcgttttcacttgggggagggagttgcctccctcgtctactgctcgcaaaggtattttgtgctctctcgtgcactggttaccaccttttattcggtgtgtatgcgatgaggtgattttatcggcgagatatctgctttgttgatttctgatccttattttgcccccttcaattaacaggaaacagttccttcacatatttatgttaattcgctgattccttcatatatttgtgttaattcgttttttttcatcctgctaagttacattctttcataggttgcctctgtttcctttcgtttctgatctctatagatcagtttgttcagtcgctgggatgcctgttcggttgattccatatatgtggggtttctttttttcccctttagattcgacaatagagagatcatgcgaagtgcttctttgcatcccacctctgtatgacaaattctgaattcattagcacatatacatagcaccgagaataaatttgaaaggtggctaggagaaaagaaaattaatccccaaggaaaatggtgtggtaaagcatgccaagaagttagctttgtgcactaggaatcacaagagatgttcttgcactcgtgaagaaggagtgtgatagcccccctcctttgttttccttttttagagcatggttcagtattcctgtagagtaaaggtcctacaaagtaggaagaagccttggcccttgggagggtcaaataacatttacttatgccatccaaagtttagagaaaaaaatgtgaaacgcttagttgtaaagatttgggcctgtcctgttactgaaagctgaatggccaaaaaccgaccagttatattgcagcttgagccaaagctttcttgggaatgtagtttgtttgtattgtaaccacttcttaggtacataaatcggataaaaatttttatgcctgcttaatacacatccattggtgataagctgctcttctgtatttaggatgttttttgctcacttatgttgccccgtggttctttggttttgcggccatggtcttcttcctctgtcagaccttatgccatggtgtgtttcgggcaaactctcgatgtcattatgtctttcgtcttttgtgtttgtttttaacacatctttaggtgtatctatgtttgaacctgcctcctggatttgttcttcatggtttcccaccctgtgtccatgggatatatcgtgctctatgccagtatttagacattacttatctgtatctgtgttttgttccatgtttctgtggtggttcatgcctctctcgtttatgatttgtttttacattgcatgcccattcatatgtatctgcaatgtgtctgtgttttgttggcttcttttcttgctgtacagctgccgcatggagtggtcgagatccctatgcatctgcccgcggaagcgtgcatatggtacttgctgatcttattatagttgcatgtggtgttctcatagccagcgaggctattagcgcacattttccctgttgttcactaattcatagttttgaacgtcaatagatgagtcgtcctcatgttatgctgccaatgagcgatcagtgctcgcggcaagctcatcatgtcccataggtacatatgctcggtatcctcagagttagcgagctcatcaccatgtttattgattgttcttttttgctgattcacaattttgttcggcgatagatgaaccatcctcatcctgtgcttgtgatgaacgcccaatgttcacaggtggttcatcgttctcaataggtatgtacgctcgaagtgatcatcgctatctcattgtatagttccattcctcacccattgcatatttgttctctcatatttcactacaattgttctctcgttgcgacgttgtatgctcggagcatatattcatatgcttatgttcatgtgtttgctcattcattcgtgccagcacaaatttattttgtttccattttctcattctgcctcctcatctgagtgttccacagggagtcatgggccttccctcattcatcctacccactctgccagttagttccatgttgctatttgttttgttgttcggctacctataacctttttctttcttgctattgattgccatgcctatttatgttgtccataggagaccatttctgtccaatagtaccannnnnnnnnnnnnnnnnnnnnnnggaaaaacggcgggcagctaggaaagcatgtgtcattgtacgcaaaggttgttcacctgcttatctaaacccttctttgcggtcaactaggtggatcctcttattgctttcctttctctttgtttcttatttgctatttccgttgccccgttcttgttctgtttgcacagaggctatcatgtattcaccgtcagtgaggttctcatattctataccaaaggactacatggagattcttaaaggtgataacttagtgccaaccttccttcgctctacttttctcactgtttttggactctatatctaccgttggacaaatatatccatgctcccttgcttatgagttgccccattcttgcagctacgtacccagaacgttcttactatggtggtcctgattatcaatgcaatcattgtggtgcgcttttttggtaccaagaaagagtcgttagccagagttcgcatagggctaagaggattgcatacaatttgtgttgccgtggtgggaagatctccttacctgtgcataggcctttccctcctatcctacaatcattgcttcgttttgatggcggcgcccgttccagctctttcatgcgactcatcaggcagtataattcattatttgcattcacataacttggagctaacattgacatgagcataaacactggtcatggcccttatgtcttccgtatcaatggtgtcgtgcatcatagaataggttctttgcttcctgctcctggacggcgcccggagtacgcacagctatacatatatgacaccaccaatgagctgcaaaacagacttaatatttttgaccatgctgacagtgctgcagatgtccctgaccctgctattgtacaagagcttatctctatgcttgaccaatgcaatcctcttgtgcaacagttccggattgctcgagacaagctgctctctccaagtgctcctgaaattgctatcaaactcattgggtcaggtcattctcagggtgatcgttactgccttcccactgcttctaagttggctgcgctcattgttcctggtacatcttctgagatatcgaagtttgatgtcgttgtgcagaagcattcaggtgaattgagtcagctttctcccattcatccagctcttatgtcactgcagtacccacttctcttcccatatggtgatgttggttttcgtgctggcattaagcttagagaggtagatgatcagccgcctgcgagtcgtgatgaggcgtccatgcttgaatattatcggtatgagtgccactaccgaaaggatgagcccaacctatttacttgttgtggtagactttctgatcagctcgctgttaatgctttctcatgtatcgagacatctcgcctcaacttccatactctgagccagaagaaccttcgctctgaaacacattaaggtatatctgatgctgttggtaggggagacactaatggaaaagatgttggtataaaggtaattctgccatcaagtttcattggaggaaggcgatacatggtgcaaaattaccatgattcaatggcgttgtgcggtgcctacggtcctcctcacatattttcaactttcacatgtaatcctaaatggccagaaattgctcaggcgattcgttttgagctaggccagaaaccaaatgatagaagtgatatggtcacacgtgtttaccatatgaagctagatgagtacattacatatattaagaatggacaggcattcggtccaatacaagctggtaagttccatatctcattgattatagctatccagtctttatacacatctctttaccaccacatgtattgcttctgctagctgttcatatcttttttcttgctgttttattttccagttgtatacactgtcgagttccaaaaaaggggattgccgcattctcatacattaacatggctcatgggtcaatctggagatccttcacctgcattcattgatagccttataagtgctgagataccagatataggcactgataaatttgggtttggtcttgttgatgaattcatgatacatggcccatgtggtgagcacaatccacattctccttgcatgaaagatggtaggtgctcaaaggggtatccaaaacaattctgtgatgtgacttccatagatgatgatggctatcctatctatcgatgacgcaacaatggtcgctatgtggtaaagaatggagttaagctggataatcggtgggttgtcccttataatctagctcttctcaagaaatttcaaggtcatatcaatgtggaatggtgcaataaaacgtaccttatcaagtacctttttaagtatgtaaataaaggaagtgattgtactgcgtttgctttcaagcagaaggatttagaggaggcagacactagcagcgccaacaatggtgggatagatgaggttatgcagtacatcaagtctagatatctatcaacttgtgaatcatactggagattatatgggtttgagatacatggaagaactccttctgttgagcggcttgttgtgcacatgcccaatatgcagtttgtgatataccatgaagaggttgaccttgaagaggttatagaagaccctgattcttccagaactatgcttactgaatggtttgttgctaatcaacgacacatctttgccagggatctcacatactgtgagtttccctccaagtttaactgggactccgacaaaaaagtctggacaaaacgtaaaagaggaaccaaaatagggaggttaaggcatattcatccaagtgctggggagccattctaccttagaatgttgctgatggtagctcgaggttgcat

SEQ ID NO: 33045 - DNA, 33975 bp, Oryza sativa
  unsure (1)..(33975): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatcgttgagctatatagcaagcagtagaatcgtacggcgccattcggggttgaacacggcgtcaatgtcgtcccccgaccggtcagcgaccagcgacaggggaaggaacccgtcagcgccgccaccgtcgcctctgcccctctcacgtcggcgcggccggccgcctcgctcccatcggcgggggtgggggcgggcgagcgcggcggcgagcggtcgacgggcgtagcagacaggcggagcagccaggggcagagctagagcgaaatggagggtggtgccacttgcttaatttactctactttagatcgagtttaagcttatgcgggtgcctaagtttacattgaggggggtgcatacatggtaaaaatagataaggtatagctaaaaaattttcttaaccgggttcctgggcaccccccctaatatatactagctccgcccctggaagcagcgatggtcggttagttgtttcatctgccgcggcggcggcgccagcagcacatgcggatccagcttcgccacccactccgctggctctccgcatgccgcccgcatcccgtgctcacccatcgccgcccgctgccggtgaagagaggagagagaaagaagaagagagaagaaaaaaatgtgcagctgatgacatgtgggtcccatgtaatttttttaatttcttttgctgactagaatgccacgtcaccaaaaccgggcaaaaatactgctatgggacctcctttgaacggtttcagtgagtttagaggtacacatttctggttttgtggttaagggacctcgaaaaatctcgcggttaagttaagggacctctggtgaacttattcctatttattaacttacacacccatgaataagtctattgtacattcctcacctcttcgatttggatcgaatcaactctgtcaacagtaaaaactgaatataacgtttctcctatcttcaaaaacaggtacaaatggacttcctcagttgtttctcgatcgagtggctaagatgtaggatatattttttaaaatttgcaataatacagcaaaagcacaagctatacatgcagcttccagaaataaagcagagtaaaaaccttggaaaaatcattaataatataaatatatcgaaaacagttggttaaacagagtagtcaagagtcgatcgatcgatgtacacggagacaaaatcaaagacctctctcatcacttggattaattaatactagtaatatttagagactcttgggcaagcatagaaataattagcaaatgaggatggtgatgcaggaggtgtagaggctaggcagcaagggaggggtggtggtggtcagagttggggatggtctccttgtggagatgaccgtctcccttggggacgatgagaccgaagcctccttccttcctcttgtacaggacgttcatctccccggtcttctcgtctctgaaggcgtagaagttgtggtccacattcactagctgctccatcgcctcctccaccgacagcggcggcatctcgaacaccttggtgcgcaccacctgcattcacagttgcattaatttggttcatgaatgatttgatttatatgcattgatcatgcatcagactgcagaccttggtgagcaccgtgtcctcgtcctcggcgccgacggcctcctccagatccttgagctgggcctgggcgtcgtcgtcgttgttgtcgagcaatgatggcggccagtcggagacggggggcttggtccccttgaggtggcggacgtcggtctccttctccttgatcttcctgagcttcctcttgatgatggaggaggcgaggtcgatgctggcgtaggtggactcggcgtcctcctcggcgcggatgacgccgtggcgcttggtgaagagagtgatctcgcacctgcaaatcttgggacctcggctgagctcgccaccgcgggcggagaggcgcacgtccacctccttcacaagctggctgtgcttcgccactgctctccccgccttctcctcgatgtgctccttcaccttctcattcagctgcaccgccacgccacgcacgtacgcttttcattccattccattcccatctttatttttccacacaacgctctaccgctcctcccaacacattactactttatcatgactctgctactgtagctatcccatataatccctccgtattttaatgtatgacaccattgacttttcgactaacatttgaccattcgttttttttttttgcaaatatgaaaatgtttatgtcatgcttaaaaaatatttgatgacgaatcaagtcataataaaataaataatagatacataattttttttaataagacgaatggtcaaacgttggacaaaaagtgaacggcgtcatacattaaaatatggaggtagtaataagtaataggtccatattactattccgttgcaacgggtatacagttagttttgtaataatttttaatctctctagtataaaatagaattctagtgaagcaaattactactaatataaccaataaagaagaatgtagtttcgttgaattctactagtatttcataaaggtccaattaataaaacaaatactctagttccattaccgaattatatatactccctctgtttcaggttataagattttctagcattacctataatcatatatatgataatgaatctagaatattatcatatatatatatatgtgaatatgagtaatgctagaaaaccttataatatgaaacgaaggaaattccagggaagcaaactagtggtagcagtaggagaggagaaccttgacgttgcggccctgcataatgaggcggaccgaggagaggggcccgtcccacgacatccgcacggacacggcgctgctgcggcggctctcggcggcgagcagcggctgtgggtgggcagcagcaggcagtgcgcggccaaggaaaccggagcggaggggcacggagacggagacagacggagggagctgcagctgcttgacatggtgatggtgatggtgatgggaaggaggcggcgcgagggccattgctgcggtggtggcgggagccattattccccaccactaatagctagagaagaagaacaatgctctgctctcgcagtctcgcttcgctagactactgtttgcttgctcttaataacaagagaagagagaagcttgagatggctggctggctggatctggaacgaattctggatggatgcacaaaacgaacgacgaattatctcccctaccactactactgatgaactactgatgagcagcagcagacaagcgtctaaaagggcggagtaatgtggcgatgtggattgatcttatccagtgtctgtcgacgtaacccaccctctctagatctttccgctcgacgccaagcccgtcgccgttactcgacagggaccaaggacgcaccgcacgctgcacctgcaccttcaccttcaccttcacctgcacgcatcaatgaagttccaaatcgatttccagttgctcctcaacatgcattgcatgcggctcaacttgtacaaacagcctccgcacgtcggcgccgctaccagagagagataccagacaagaaaaactactattcactacacaagcaagcaagaatcatagacaaggaaaatgagtaagctgcggtttagacataaaaatcaggtggtacaggttttacacaactccactcctgcttctcagtcactacatcatcagatatccaatagtttttctcttcttttttttcttttttttttttgtctaacaagcaaggagccgactgtaatttctcctttcatggttgcaacactgcccgccaaaaaaacggttgttgagcaaaaacaacacattgaattcatccttcttgcttcagagcatcccctctttccttcaattcttacttccctgtgatgatgattcatgctaaaatatgtctctaagcgcccatcccaccctttcaacagagctactaactccttggggggctcagaaaccgagcaagcagcaaaacaatccaataaataaaaatcaccagacattttggtaacgaaggggcaagggaaaaaaaaaagactttacagactctggttggccattatcgggaaaagacacctgtctgatccaaaagccagagagatcgatgttggagattcacaatttttttctgctattgttaactccggcagttgtgagaacaaaacacagatggctcgggcattttcacttagctcagcaagaacttgaaaatatcactcagtgatattatgccctccacacgtttgctaccagcttccacaatgaaaacacggcgcacccctaccaacaatataaaatgcaaaaaaaaaatattagtaagttgaacccgaaaagttgctttcaggaagcatatctaggcacagataattaccaggattagctaatcgctccatcactttcaacaaagtgtcagaccggagacacatctgacatctttgcccgttaaagaatccaaagggcgaatttgcatcctgtccaagctgcagagcctgaacataacaacaaaaatgagtaggttcacaccaaaaatcacaccagctcgatggataacatatacacaaattcacgagaaagcctgctttaaacagcattgcactacttattctattatagtatatgtttgtttgaccggtatggaaagtaagagtgataaatggacaaaacacatcaaactacagcctacagcctttgttttagatgtgtgtgcatgctccatgctctgcgtgcaaaaagacacagggctaataaatgccagaaccacaaaggcatgtcctcatagtatatatgtgtgatgcaggtatcgatacagatttccctatcatatacataaatcagtaaagttattattttctaagttaaccagtcttcaagaccaaaagaaactctgcaaaaattattgtacaactgtatcccagctaaaattccagacacaaactaaatcaagacgcattaaatatttactagcatacctgatgaatggtcatctcatctaggcgaatgtgtgtgtacaccttgtcttttgcaagagctgtgatgtcactacataatggaaaaaacacaatgaatacatggaccaaagaatagtatatgactacacaaagaatggtgagtatcaaatgggcaccttctggaatatgtgtcaagcagtgagtcattgtcatccacaattggtattgagctcacaccagctgaatgaaacaattagagtacagagtaattgtaataagacattaatttggcaacaagatagcgtaaataatcgaaagctgtaagagatctcagtggaattagtattaaacttcagtaattgcaccaagaaacagaaatgcaagtactttcccaggcattggttatggtaaaacagacagataacataccttgaaccagcaaattcagggcagcgctaagagatgtgttaggccgcaacatagccaatggacggccattaggatcaccaatttttggaacccaggtacccagaggaattgtgcatacaggttggctcaaaataggtaaattaccttgagaatttttaaaatatctacaaatacctgaaaatgaaatgttgttaagctatcatgtaatatgtttgtgtatagcacacttttcatgcaaatacatagaaacacttacatttcaaaattccagaaagggaagcaagatgcaacaattgtggatatgagccatctggtgatgaggaaaacataattggaacggtagaaacaccgttttgcagtatcttcatagcaatttccctcagggattcataaggggtggcctaaacaatagattcactccagcataagtgcatgagacacatgatcattataaaactaagcatgttataaaatactaggatggaaatgaaaaggaacagttgatgcaaggggttcgatgaaatttcacaccaaacaaattgcagttcactaagtaactcacttgagcatggcaattaaagctaattaagcaaaatatatttcagcatccagtagataacttagttgtaacacaaaaagtaaaatgtgtcatagtgtgccaaaaaatgttatgacaaaaatgtgtgtcatggtgtgccaaaaactgttatgtggtactcacacaacaattgttgacaacaatttgtcaaatgcaaataaatcaaagggtaaaatattatccttagaatgcaatacatgaattctaaaattcactggagtgtaatttggccagtaaatatagatagaagttgatggcagcagtctcaatttgtggtgagtgcatacagatttgcaattggttcacaaacacagtggacaactcacatgaactaaatggtgatttgccctccaagaaccctcgtttctggcataagtttgacgcttggcctccttccacgcagatatagtatgtgtttcaagctgctcttctgtcagattggagccatgagtttccagctgcaatataaacaagatattaaatgctactctgttggaatatgctcacaaattgtttcaagtaacaaatcacatggtcaggattaataatcctttacctggaagcagaaacaattcaaacagcataaaaataaagtatcatgatgcagtcgctactactagcatatttatttctattttctagagtccaccttccaaaagatacgatttcaaatttttggaggttctactaactgaacacttccaattaagggaaaaacagttcaacatgatcactatcttggctgaacttcttgtggtcacccaaacaaagttccatgagatgcatggttactaagtgatacagcagaatcgggattacaagcaggtacattgttcaaatgcatagactcccacattccattaatgaaccagtcgtctttataattcatgtgaaataagcttctaggtcaataacttaatactgtcaaagaatgatattacactgcttcagatttttttaaaaaaaaaaaacaagaattgcgcaatttcgttttgcagggccactaaaagtggcagcatatttgaaatgaacattaaaccatcacttgtaacaataaaaaatatacaatagagaacaacaatgacacataaaaaaataattaaagaatactaacaccaaacagtaagtgacagaataaattacctctctcaatatgagtataaaatccagtgggctcaaaaggccaacaaactggcccctgaatgaatcccatagaggtgccacaggaattccctgcaaggtacactatttatttaatgtatgttcccaaaaccagccaatatttcttgtacttcaatatatatggttaaagaaactatgaaatttccagttatatcaagatgccaaaaataattaaatcagaatcaagatggcagctaagaaagcacagagctgaactttcttataacctatatggaaattgtggagtgcaaacagaatagaacctacttcctccaacctcttctaattgttgtattggatgtctgacacatcaatcatcacccttgacaattacttgctctaatcaaatcttaacaaaaattagaccccattgatgatgtatcgattaataaattaaagtgaatgtttttacatatatagtgctctttcaagcttttaaaggttgaccacatgcattctaggtgatgtgtacaagaggaaggatgcaacattgggttgtacaagaagtgtgaagtaggtgaagtagctgcaacttttaaggcatgaggctgcagtgtttccattttcatgcaatctcagatgaattgaagctgccaatgaaaccaaacattgtacgcaacaacaggccaacatatttactaaaaaggtatgtacctattccactatatttacagatcaaagcaaaatatcactagttcaatgtcagaacaactaatgaaagattggagggaaacaggctacagagcagaagaagaatgaaagattggagggaaactagcagaagaaggcatagtcacctgttcatgaagaatatgaaaagattgcttcacaggcaaattaacgtctagagcaatgacctgaattgtaaatataatgtaataagaataaccattagagcactaaaattcatacaagacgagctcattttccataccttgccagaatctgggagtaaatcatacccagtttgtccattcagaaaatccgctacacgacacctagagatctgtatagctgcctctgaaattctctgaggaccttcctgaataatgccatcagacaaagaaacctgcttgaagaaaacaagaaaagttgtttatattatatttagcttctagaaagaaaggtgaaaaaagcaaaaggcaaaactaaacaaataggaagcattataaacacacatgaccttgttagtgaagataaaaagaaatgtattgcgcacacgaacattttagtgaagataaaaataaatgtatcacacacatgaactttttagtgaagataaaaagaaatgtatcacacacatgaacattgtagtgaagataaaaataaatgtatcacacacatgaactttttagtgaagataaaaagaaatgtatcacacacgtgaactttttagtgaagataaaaagaaatgtatcacacacatgaactttttagtgaagataaaaataaatgtatcacacacatgaactttttagtgaagataaaaataaatgtatcagctactcagcttgtatcgctttcctataaataaattttccaatagaggagagaacatttgtattttgcacacaggtgctgataattacaactccaccccttctcccagcattcaatgatcacactttgctcagtaacaccgaaaagatgtataaattcgcaggtagcatcaaatgcgctgacagatggggcatggggctagatgttattttccaatttgtgtgacctttgtaatgctattaaagtgtgttgtattattgtatctgcccaacatggtatgcttcagaagcatactacccctacattattatcaacccagagataaattgcggcaacaagtataccacagtgtcactgtttgctcgcaactgtgaaaatagcagctatcctatcaagtattttcaaatttcaaaacaagataagtggcacttacagtacgttgaaaattgtcgttgtccacatccatgttcatcctacttccaggtgtactagggctcaatattgtatttatctggtcaaagtccctagtcaagcataaagtgttaaccacaccatagtctcctgttatggtaggttgccgctcatcgtgccgccattccccatccacacaaaacttgtactgaatatcaatgatttaaaagaatgttcacacattagatgttgcatcacaagaacataatttattgggtagcaaagctagtctaagacaactatgataaactttgggataaaaagggcacctgatgaatcccaggggacaaactgcatatggcctgaaaaacggtgggacaaccttcaacaggagacattggcaaatgttctgtccacctaagaaaaattagggccattaggtgtgtaaaaagaacacatggcatgtatttaacaggaaataaaactgaaaaattcatgtttaaacgtatccaagctaatacctaagccaacatactgaaaaattcatgtttaaacgtatccaagctaatacctaagccagcatgccatgcgaggaccctatagtgcatgacgtcaggagacatcatgtatatgttgaccagagaatgcattatacacgtcacagcaacttttaatattgggcaaatgatggtagcagtgaatctgccacccctcgccagctttacaccatattttttactaataatgcctgaagttctttcaatacacgttagaactaacacatattattactttcttatttagtctccaaaataaaaattcaacacagaaagttgtaagatggcctatatacatagcgtaaagctaactagtgttaaaactatgtaaaaaatttaaccgatccacgtaaaagaatatgaaggccatgtgcaattaaaaaggagtcgtgttaacttttctttagaagcgtgtcagcgtatgcatggtttataatcgtcctaaacgaaggcaagggcacatagcaagtaaataaatcatgatgatagcatatccaccatatacaggggagaaaacaaaagaatggaatcaactggtgtatgcacatacgacacagtgacatagtaaatataaagcaggaattgtatcaatgcagtatagttggatgaaatgaaatgaaacaagggcacggcatgcgatggggcgcaagctacatggcgcgctagagctagtacagttgaagaggttttgaagtattcccaaatcagcagtctgatcgctagggtagggtgggagataaacaagagtagcacaagtggaaggtaaagagtggtaataataagataggtatggtataggatatactccatttattagaagataaggtaaaaaaagaagaagaagaagaagaagaagagatgcaaacctggtaaaggagccggtgaggtagaccctcttgccaccgtagggccagacgaagcgcgtggggacgccggaggcaccggtgctgacggcgccggcgtcgtgggcggaatcagcgccgtgggaaaacatctgcgccaggtcagaagggcgaggggaagcagcgaggaggggaagatcaaaatctagatggatagatagaaaaccctaaactagactagaagggggaagaagagaggagaggagggatagccgcgacgggatcccccacgtgaagcaagcgcgcgcgagaggggctccccgcgtgagagcggatcacccgcgtcgggccgcgcagccctcgccggccgtcatcccggaacctctctctatcaaccctacccctacccctaccctaccctaggtagggtgtgtccgtacggaatcggaggcaagcccctaccctaccctaggggggagagatcgaggggcaaaggggggtgaggggcacgggcggtaatggcaggaagggagcggcggcggtggcggtggcggcggcggcgagaggagggagatgcgaatgcggcgaggaggaggagatggagatggggatggaaacgcgaacgcgatgagggaagaggaggaagaggcgatgcgaggcgagccggagcaagagagaaatgaacaagaagggaaaaaaaaaaacaaaggaggcttcccttccgagggttgaaaatgaggggaggcctatctatctacggatcttctgcgcccgcaacacccccatcctgtgtgctctgctgcctgccacctccaataccaccacttgtattctccatccattcgtattagtattgtttttttttccaatcaaaactttcatacagatatttttagttttatatacactataaataaatccaattagttgtttgttatataagttgtgcatgcaacagcagtaaaatgggtcacttatacactgatgataagactatagtagatacgtagcgtgcatgcaagagcggcaaaatcgtctgacatactatttaatacaaaactagaacgtatttaattatacttggcgaaaatagcacctattaaatgcatagtagagcatgttcttctactcaaagataaataatatataggcgggaagggactaataggacaacaaaaacgtgcagaagaatacaaatgacaccgtatattaagaagacgtagccaaacaacatatcaattataacagtactagagcatgtattagaggtataggaaaatgtcttagagaaattgatgacatgatcatttttctttattttgtgcttatttacctggtaccgctaaaagttaggatgatgggaacaaatatgttgagtttactactcactaagtagtatggaagccggtcaaccatgttaagatattcttgtggaaggattgataacttttaaactatcctatgtcattggtaaatgagttttttttacttgagaattggagttagtttgtgtcgacgtaaagtgcaatatgtctattgtaagatactcctatatacacccatatataccttaaggtaaggaacactgttcattcaatacctttcaaggaccatagttaaacaagtagagttttcaattttagtttggttgtttttcatgcctacagagaactaatcaatttatttttttaaaaaaaggaaactaaaattaaaaaccatagacttccaattattagttagccatcattacaaaatacaccactctataaaaaattgcctccaacatagtctaggctctagagatataacaaacatttttctcactttgtttaataatgggttgtcgcttattatcacaagtaaagtaccatttcctaattttaactaaaactaatagaattgataaaagagtaaactttagctaatggagtcaaaatatttaaacatgtattaataggacatactcataactgtgtacgtgcaggaccgtcccagggaatcgagctgagcggctgttcacaatcccaatatctagggtccccaaacaccatcgtgcacgggaggcccaagacccaagtagttaggtcgatcaagcgcttctaggctgctcggcccatggcgcaagtaggcgtgagagtcatggagtattcgcccaacatcgttttgctttcttttctcgaatcttgacgtttgactggactactagctcaccattgtctcgaccgaaatgctctgcaatgttggttcacaccttgcagcctcgcgcctgccaccggtcgtatgaaggtgaggttgcactactatagccataggctctcaccacctgcatgattaagttcttatatagtctcattctatcggccatcatctcatcaggtaaacgtgaactttgttcttataatgtaatttcatttcctaaattccaattttattattttcatcatgtatataatattcaactttcaagccatttgttttctaaaaattggatcagaaaaatgtcactctggttgtgaaaaggtaaaaccatagagaaaataaaaggtgtaatccaatactaggaaggagctataaaataaccatggactaatgtaaattattattattttatcatttaagtttacggctcggctatgatttcacacgggtctccaaatttcaaaggagctatgtcattgtgtatctttgatgttattggggaaaaagaaatattgaatggaaggaatatatgccttcaaacattataatcttctggataacaggactccggtagattatccaattctaataaaattagatcatattaattagtatatggattaataattaggtaattagtatgtattctatttttgagtaatttttgtttttttgatcgtcacggacaatatagaaggaaaaaaaaaggtgagtaacacaatctgatggtggaaatgaagatgggtgagtagtggtgatggtgatcacaagagagagtgttcctcgtttgcatcccatttttgtgggatctcccatgataatgtcggaataggacaaaaaaaataggccggaaatggtgatgcgcatcctaagttgcacggccgtcgatacaaacgaggcaaaaagcttagcaataagattcttccatctcctctcctcttgtccatcttcttcgcactctccgccgcccgccccctgtcatcgtcctcccgcgcgccaacgatggctgctcccatcaccgccgccacatcgcctctctcccctgcgtctcgggttcaggtatactaggtcaccccccagcttcatttcttggctagctacttcttcaatttgtgccgctcttcctttttttttcttttttcaagcaagcttgccccccttttaattgtgttcatattccttacatacacatacaggtgatgtgctcaatgctcaatccaacctcagcttctttctccaggcaaacagcaagcttcccgtccattcggttgcgcccggtcccaagtcgcttccaggccttgtcttgttcggtatgtatgtaatatcactgtcatgttctttgctacctccaccattggaatttgcactctactgtacagtcatgcctaacttctaagctcaatgcaagtgcgtgatgcctccaacagagttggaatgcacatttctgccatgtggataatcaactgaactgcaattactttctgatgctaaatgtagttttgatttccactccagatgttaatatacatgttagttcagtcaaccaatgaaattattgcttcactgcaatctttcttcttctcttatacgttcaccaacaaagtagtttgccgaaaccaccataagaaattctcacacacaccatacaatgccaagaactttcactatgttttgatgtatcatgccatcacctactgcatcttacattccttttacttggtgcaaggggataaagaaaattattggtgatggtaatatagtgttcctcattagttttcctacactgctgccctggtacattactgactatgatgccaatgttttatgttgtatgagtttttttttttagaaaaagaactatgttaccggttaaagatttacagtgacagcatagcaaacaatttatggcaggaggaatggttttgaaaaaaaattcacaatcagttttaagaactagaaagatgcattcgacagtgaaattatcctagcttgcaagagaactgcccactcacgatggctatagaatcggttactcctgatgaattttccaaactgcttggctgcttgcagattttcagtgtgttaccctgctaccttgattgcttagtcctgttcatatttacttaaagcatgcagtatttccactttattgagcctaattttggtcccatgctgtaattgctgtgggtagcagtttatattattacaatatgttcatgaaaatttatgcaggatattttcaaagactctgcttgatgatttattttacattattgaacaggccaaacaagacactattgataaggtttgcgaaatagttaagaatcagttagcagtagatgaaggcactgccgtttctggagaaacaaaattcgtggaccttggtgctgattcacttgacacggtaatcttctggactaatgtaataattcaacactatctaaatcacctggactactttattgattttttttaaaggggactgtaagactcctctcaactagcccttttcttggcaacctcatactttcttgttgaaagtccacagtgatctctgatatttgtcacggctcagattagtattaaaaattattctagtcaacatctctcctggcatgttgttgttgctctcaacaatacatttttcgcagatgcggcaattgtacacctttttatatttagtcattgtataaatgaatttattctccgttcatagtggaatgaagaatcaattccatatctagctttgtgctctcttttcccaggatctagcttattattctcttttatcccaggaatgtggcgcctttttctttcttatgaaaatctcaggaatttagtatttgctgcctgcagccatgatgcctctgattactctttatgtgtgttttgattggttttaggttgaaattgtgatgggccttgaggaggcatttcagattaccgtggacgaatcgagtgcgcaagtgattcagacagtggaggatgctgctgtgcttatcgacaagcttgtggcagagaaggacgcctaattagctgttgccaaagctcagtttgttgtactactacaaaatacaaattgtagtttacaggctatgaatgccgatgaatctcttgttgaatctagtgagtctctgcagggatttgtgcgtgttttgtttgtttcacagattttgaataaaggctgggaatgagtaagtgttctttccctgaccctgaggctgatcgccagagtgtgttccctatgtcacgcaaagaatgctgatatcggccgcagaaacgctgaattttaagttcagagcttctggaggtgaggaattgaagtcttggagcttgggacatctcaaactgcaagtcttttacatttcatctgggatttttccatcccaacatacatatccattcgaaaacaatagtagctcgtgttgctcatcactcacatgacacagagctttccaaaaaccgagctacataacattttaaccaggcgtacgttagaaattagtactagggccgttcgatgtcttccagttcctcttttacctagcttccaggccttcagaactcaaagccatccacatccatgcctgcagtctcggctactgagaggacggctcgggtttcagacagaagtttctcgccatctcttccgtcacatcgctacatgcatatagaatagggtaattaaatggcaaaaactgagagaaaacaatgcacatagaattttctacagcacatatggaggttcccttacctatcaggtgcttcttctttgcttataagcgaagctttcttggacgaaagaagctgcaaaaaaattttatcaccagccggcctaaatttctgacagagctttgttacgaatccattgtattcgtttggttcctataatggaaaacaacacctaagttacaactgagcaagcatgtttaaactatacatgaggtctcgcagcaaaataaggggcatggattacatctaactaccatgcaatcaaatgaaaataaccataggagagattacctgttcaataatgcaggccttccgtaaagcaacaaggcactccagtgccttttggtgattatcccgatcacaggaatcctgtattaaagcggttatgtacttctgcatctcttcaattgccgtctgaacccacgttgagctagatctctgtgtcagcatggcttcaaaatcttgaacaggattatgatcgccaatctccccagccttcttttttggaggatataaagcttccgaaaccccaaccttctctgcagaaggttcttctaataatttagcctgatcgtctgcgccagtataagtcaatctgtcctgtgtccgtgctttctttttctgtgatcagtccaaacagatttatggttccccaaaattacagtatcaagtcaataacacaaatacgttagcaatatttctaaccttggggttctccttcagctcaaatacattgcctaatttttttattagcggtgcttgataatcaatgacatcaggatcaggttcagttatcttctttagacatttgtcgaggggtgggacatttgcatccggctgctttgacttgagatcaaggtacctgtagaatctctaaagggggaagtggcaagtgaaccttagtcaacagaataaagaatatgcacaaaaggagcattaaaagaaaaatgtcaagtgatctagaacctattagtaaacttagaagcaaaacaaatacatacaagaacctttgcagagcatactccaatgaaaaagtgaaaagaagaggaaaaatagcttaaggtatataatatgagaaaaaaatatcagaatatctaaattggttttgataaatagcaatattctgaaggaagaatagcacctccaacatgggattcggagtgaaatcaggcttaaggatctcttcccttccaggtggtgcaagatctaacatctttaccaggttatctgcagcttcctgctgttccttggtaggctgagatgatgatggcaggctgctgaaggaccgaaactgaaactctctgatgtcctcagcaaatggaagtatattgaagtaaaaggaatccagctgcagggaaaaggaaaaaaaaagaattgcttgaacatatgcaatcatcagacgaatcctacaggtataaggtgtgagtaaataaagtacatacaacattttttgctgatgatatgtttggtgtcaatacacccaaagcaacattcccttgaccttgcctccacacgcatcgtaaaattgcaaccttgttcatttcactcattgctctagctaaggcagaaacggcagcaactgcttttgtgtttcctggttccggaacaaaggagaacacatctttcataaaatagtgcctgttaaagtaaaaaaggtggactgtgtcaccgttactaacatctggtcttaaaactgcaatatagtaaagacatttaatattaaacttataaacatgtttacagcaatttatctttacaaattttggaaatgagatactttcagaaaagaaattttatattagcttttgtataagctgaaccccctggcagtccttagggataaacagaagtttgacccagtacagatctgagttctgtaatctatacataaaaacataaactttacgtgcaaggatttatgattgattgatcgaatcagagcactgcattcatgtattgttttcatgcataaaccattcaccaattccagcttgcaacatattcatcccaaggggttttataacatgataaatgataacctacagcttaaactcaaatgcaacaccacataacacgaaacatgtactctttaaacatttatattaggcataattgcaaggatcaggtaatcagctagagcaagaatttattttataatgttttgtttcatagtatcagctcaatctccaatgatataaagtacataaactaactattcatgcttgaatgttcacatggattggtttgctatgtcttcaaacaagttacctcaaacaacttgaaataatcatgaaattaaatgtagaaatggcatcagtgaatacaagaccacaaggtccaaagaacataatcttattccaaataaaaggttgaaggatatgggttaccgagatatgctggatctatctgtaaaacctagaagcttcacacctttctcaggtttgaacttgacagcttcccattcagcggatgatataggaacaacttgtggaccataaagatatcctttaattctttgatctggtggaacgactgtgtctggttctagaacacttttgtactcataatccactttgacttcatgagatgcaaatttatcacttgcaggagccttatcagaatacttcttcaaagtggggaatttctcctcagatgttttcttatagacccacacctgttcacaaagacgtcagaccaaattgcaaactgaaccagaattaatataaatttctctaactgaaaaaaaaaacattacatgaatttaagaaaacaacaccccacctttattttaaagctagagctcacttacaagtcttccctgaagacagtaactggaagtacatttctagtcctgagagcacctaagagtgacgttgggctgtcaacatgaactacctttgttactgacctctctctgaagtggtataataattggtcgttttcatccattacagcattgtgacgaactccagattctctgaaaataatgcagtccatcttgatttcgtgtcttttcatctggtctgcaatagtgtccacctgatccttttttgtcccttggggtggatctcttaatggatgttgtgcatcagtgactagacacatacgctgttttcctttgatatttccaaattttcttatcagcatatccaaaccaacaacaatagcatccaaaacttgccttagtcaaggaattccagtatctgattccgatcaaactcgagaagagtacagagcaagttcaaacaacgctattatgatgtaaaacaaagaaactatatgacttaaagacagggaaaaaaaagaagatgaaacaagcacaaatccataagcaggagctactatatgaagagccggatgctgaatatggatggcagtatcacaacaaagaagtcccccaaaatgcaaacacttaaggataatggactgagaaatactaatttgagctcctacaccatagatatgatctagcaacatgcaaatgcaggcagcagggcaagacaaaaaaaatgcctcataaaatgaaagatcaaataggtgtcgtgtgctgatagtagtagttatggcaaatctagtaacggatgtctagttaacaataactataaaccaaacatcagcatacagtgctacttgtggatacagtcaccaggggaagttccccttggaaggttttgcagagcatttgttgtttcttcatcaacaactttaatatcacgagcaaccaccacatgcttatagcccccaagctccttggcgagttcgttgcttgtttctgcacatataaacataaatcaagcagcccaaggaacttttgaagcaagaaatatgtgacccaaacaatgttcatgcatggttctcaaatttgcagcaaaacaatgcaaacgttggtgtctaagtagatctatcgttcatagcaacttgagaagaagtgtttaactagactagatgtgtgagagaagaaacattaacttgtctgatccttcactgttgttaatcacatacttgtttaatataactatgtctttatccttttccattgtgaatcatatatgcttgttcaatgaagctaataaaaaacaacacagaacatttgaagtgcaaacaaaattttagttaaacatttgcttgcaacaatacctttagttccaaaaaggacaacaccgatctcatcactcctattataaactagctgcagagaggggggaaaaggcaggggggttagcttgaggctgattggttacaagttatgatgaattgcaggtggccaggtagtagcatttgcatctgggaagttaaaatggaaatagtgtgtgcttgccttcttatgcacaagggtggagcagatattctcaacttcttgcagaacgccatgcatggatgggccaacatccaatagcaaaaccaatgcttcctacattaaaaaaaatataattgattggcaataaaaagtgctaccagaaatggtcttgcatattggttttttcttctctttttatttttgtcaaacacgcagaatcacagggacgggggggggggatcagtatcatgggtttgatttctggtttttattttttttttcattagattttggtatcacggtgtgcaagtcgaaaatgtaaaatcaggatacttcctaacaacaagtgcatggtgcagcggaaggagaggaatgcagataggttaatgtgaagatggatgtaaatagatactaaatcacaacaatcgaatgcgaagtaaattattactgtcccaaaaaccctaggaatggggggataaaacctttattttatttgaaggggacggaggaggagggtatagatagggtttaggaagggtggcgttggagttggagtgcaaatcatggaggacgaggaggtgcgaacgagcgagcgaggttaccttgttgcgagccatgagggaattgaaggaggtcgacgacgacgcggctcgaggaggacacggacgcgacgcggtgggccttcaccaagacttccgcactcgatcaccgaccggccgcctcccactctcgcggccgtcgacttccgcgctgccgcttgctgactcgtcggcgccgccaccggccgctttgccggcgcggagagagagagagagaagacgaatggcgacttccgacttggctgcaacactggaacttctaaaaaaaaagaagaaggtaaattggaaccatgccattataattttgcaaagtttgacatatgccatcagtatctcaatgacatgtaggacccacatgagtcaacggcccctgggtcgcgactgcatgtctgaaatcttgcagaattataatggcatggttccaattttctaaaaaaaagggttaattaggtatatgctttgaaatataccattactatttgtgtatttgtaacgatgccactactatactatttgtttacaatcttaaagatgccactaagatgcgtattttatatgtattggataaaaataccctcatcttctacctctctctatctctcatctatcttttacgggcctgttcactttgatgttatttttaacattaccaaattttgataaagttaccaaaaagtgactatatttagtttgctgccaaattttggtaactatataagaaatcctgccaaaattttggcaaaaattttggtaatgccaaaatttggtaaggttttttttggcatcaaagtgaacaggccatacctctctctcctatcttcagcagcggccacaagaatcttgctccgccgccgcgccgccacacttgcgcgccgctgctgctactgccgcgccgccgcgcagtagcagctgctgccgcctctcgccgctcactccgccgccgccgctccaccgctccccgctgcatcgaacaggaagagaagggagaagaagaggaggaaagaagaagaagggcaattttgtccaatcttttcttaaaatatatctaaggggtaaatagtgacatgtctcaaatatgtgtaaaattataatggcatggtaccaaatacttgaatactagtggtatatttcaaaactagtatatttttaatggcatggatctaattaacccaaaaaaacaaagggagggatttactacacaccacacaagaggaatttctctttactaagaccctgtttagatgtgactaaaacttttaagtccatatcacatcagatgtttggacactaattataaatattaaacgtagactattaataaaacacatccactgattcgcgagacgaatctattgagcctaattaatccatgattaacctatgtgatgctacagtaaacattctctaattatggattaattagacttaaaaaatttatctcgtgaattagctttcttttatgtaattagttttgtaagtagtctatatttaatactctaaattagtatctaaatatagggactaaagttaagtccctgcatccaaacaccacctaatagtatctattttgattttaaagaatataaataattttgagatggaaggtttagatacatatatatggtattttcttcgcgccctgaaattttatttattgccctgtttttaaatttggttaagttttgtgctacgaatggaaatttctttttatagtgagattcacccccctcacgcttgcttttgaccctttcttcttttttttcttattaactagcaaaaatgcctttgggttacatgaggtgaagacaatttttgtgattcataaaaactttaccaattgtgatgaaatagaggtgattggagaggagggcgtgatggtgtaggctggttagattgggttaggagaaggaggggttggggacgtacaatcaacttaaacacggataacgtaaaaaaaatttaatgaaaacatctccaagttttatattttcataatataatataattaatgtcttattatagatgtggtgcttgctttggaaggagctcaggcgacgtggtcgccattgctttttttccctcaaaggcacaggttgccttgccatttcatcaaattcaacgatgtatgtaataatcatggtgattactcattttttgcttcatcaaatattcaaattcacttaaagcagagcataccgtagcaatgaccgaaaccaaaagcgcagcagcaatgcagcatattgccaaactgcaatccttccatccatggacacggagagtagtgtaacagtacaaatcatcagtggcaaaatgtattaggattgtacacatacagaatcatccatcccaaagggaataaaaaaacaactgccagcaaataaactgcgagagatatgattacacgacgagaaggatacacacatattccaaagtgatcaaaaaatcatggctcaacgggcggctttagcctgatcaacctccggactctgtccttctccgtgttctccagcagaccctgcatcaacaacgtgcaatatatatatcatcaagctctcaggtactagagtagatcacagaaaatgggggaaacaacttcacacactagaagatcaaccccaagctgtaccttccaaacaatctcatcaaggcacaagcagatcctcccgtatttgtcaaggaagagcctctccgtaggcggtttcccacatacatccttcactgccgatgtgattgcaaatatcacctcggccactacagacaataatcaccaaccatgagtacaattgatgtggaagtagaaggcgttcaaactagattagtaacttttacataaggaaaggaatatcataattcataagcttgacgacactcacgagcaagctcatcatattcatccttgccaacaatgtacaggcagacatccccaatcattgtataaacaatagagacggacctgaaaaaaaacccaatagtaaatagcagcgatagagggaaatgttctatttcagatgagcaaaggatttgtaggagatgacaagcatgattcagaaggacagcatacagtaaaaacaaaactcaaggcaaccatgggatctgattaatgatcagtggatatgctctactacacttactgtataacacatggtcaagcttaaggatgactgaaggaggttaattctacacattcagcatcacgacctgcagttccaggttcattatctactataactggtaagttgtctctccttttcttttggcccctgggcatttttgttgtaattttggaacgtttatttcctcaccaatgtaaccaaatagcagtcctgctgtttcattcagaagatttttttttttaaaaaaaaacagaggagcatcaagttgatgctcagaatggtggcaaactggagagcgaatttaggagatgaatgaatgaatgaattttccgaaaatagatttgtacgggataggaataagattaacattggcacatcagggagcgatcttaacacaatattgctactgggcagttatggccaaaagacatgaaccaggtaatattgatgttaaccagggatcgaataaaaaaaagggcctgaacaattggtaaatcttgaagatccatttggtggtaccaacttactggagaacttaagctagagtagaataatcaatcaatcaatcagtgagctaaaggggaaaagtagatacttgtgagaggcaacgaggagctcctcgttcttggcccccttgaggttgtcggcgccaagcttgacgaggaaagaacgccagtgcagcctttcctccgcgggaacaccatggaagctgcaaacgtttaccaacccgcaagtgataaatcagtttctatcagcggtaagtacggggagtagagatggattagttttggagggaaatggttgaggtggaatttgttggccataggtagcgggggagcgtggaagagatgggcagatctgcctcaggaggcgagatcccccgagaaaaagggctttcttggaggggagaagaagaagatgggggaggtaagtaccgctcgatgaggatgttgccgtcggagttggagaagagcaccgctagtatcatcttgtctcgccttctgcccctctgttctctctctctctccctctcctcttctccggcgacgattcgtccctgtcccgtcccttgctcgattgatcgattcggatttcggaagaagaacccctccgatgaggaggaggagtggttggggctgcatgggacatcatgcatctgtaagaaaagattcttgatgggccgtctctgatgggctgcatgtggactcggcctttttacatttcgacagcccataaattcaaggtgtttttgttttttcttttcttgcaaaactccttcctatggcgccctatctatgaccatccccatggatccacacatgaaaatcaaccaagtacaatttgagaagcgggcggctggcacccagacccagatatgtaataataatttcgtcgtacaaaaaccataaactgtgagctctctctcatcttcagagtgccctcacctcatccctaacaactgtgagtaatctagtaggagtataaataaaagaggtgagaaaaccacactagtactagcttatctgcttatcacttgtccagcttcctacaaactggactagtataaaaaaggcagagaaatgacaattatccggagtgtttgcgcatgtacagcaccatccatccatcctcctcgcaatcctattctttgggagcattttaatttgcagccaaccaaaaccaaacaatgacgagcattttaatgtgacggcacggccgtcgtccctcctgtcctgtctgcaagactgcatgatgcaaccaaccggcgatcatacggcaacatccggcgatgacatggtggtgtgcaaccaggagagcagatcatccctgctgctgatgaagctcccaagctgggagtcgctggcacggaacggcgcccccacctgctcaagatgagaggccaccgcggtcgccagcccctgcgcgaatttgtgggtgctggagccggtgtacacgctaaacgtctgtggcagagcctcctcctcctcgtgttcccggatggtcttcatccagtcgtcgaacgccgtcttggccgcgcctaccgacagcgaccgcaggtccagcgaccactcctcctccttcctcgtatggatcttcgagtacaggccatagtgccgggcgaggcggaacagctccactgccctctcactagggtacccatggttgcggcatatgtcgatcaggcagttgcagtagggccgccgcacctcaggggccgcgctgttcagtatgcccttcagctccaccctcaggtcctccactcccacccgggcatccccgagcatcctgatcagcttcaccagattactcctcaccttctccaggcaagccagaatcacctccgtctcgtccccgctgctcagcgcgaccacggagagcaggcacccgcagagtcggtcatcgggcttgaggcccttggccatcccagcctctagcacgtccaccgcctcctgtatcctccctgcctttcccaggcactggatcacaatggtatagctcatgatgttgggctcgattccgctctccaccatttccgcaaacagctggagtgcgcggtccgcatccccgctgctcccatagatgttgatcatggccgtgtagctccacttgtctggcttcggcacgtcgcccaggtccgggtccttcatctcgctgaagagctgctcggcctcgcccaccagccccacgtcggcacacatgctcagaagcgtgttgcagaggatgttgtcggcgggcagcttcttctcccgcatctgctcccagagctgcagcgcgtcgcgcccccagcgcgccctcccgtagatctttgcgagcgccgtgagcgtgcgcgcgttgggctcgacgccctcggccgtcatttcctcgaacaggttgcgtgccaggcctggcttgccggtcttgcccagcgcctccagcagcgcgttgtagacgaagatgttgggcttgatgcctacctcgcgcatctccttgaagacgaactggatgccgtcgtagtcgccggcctcgccgaacatcttggcgaggacggcgaaagcgacatggtcgggcttccagccgctgccgcgcgcgcggtcgaagagcgcgaggacctcctccttcatgccgagctgcgcgtagacgtcgaggatggcggagtaggtgacctcgtcggggaggacgccgtcggaggcgtacatgcgctcgaaccactcgacggccttgtcgaactggcggcagcggcgggcggcggtgatgagggtggagtaggtgatgttgtcgagggggacaccggaggcgagcatgtcgagggcgaggcgctcggcctggggccactggcgggcggcgcggagggacttgagggcgacattgaagacgatggtgtcaagtgggaaggcgccatcggggagggcgcggagccagcagaggagggagagggacttgcgccaggaggggtggaggtagttgaggaggaggagcgcgtcggaggtggagggcggcgaggccggggggaagaagtcgtggagggtgggggcgaggtcggcagcgtcggggagggcgcggatggcgcggaggagcggctggagaggggcggaggaggggtgggaggaaggggagcggcggcggtggcggcggagggagaggacggtgggcttgggcttggaggggttcacccaggttggctccggcgcgtgctgggtgggcgtgggcttcccgtggaggagcctgcgggacaggggctccagctgctcggcgagcgagggtgacgacgacgacgaagacgaggtggaggcggcacaggagggtttcagcctgggtttgccgccgggcagtttgccgggaggggagaggaagaggaaggccggcgcggcggcggcggcggggagtggcgccatgggtggcaatggcaatggatggatggatgtgatttgcctatcgctttggattgggtttgttttctcagcttaaaacattttctctccttttcttttctttttttcacgcgcgctttgtctcttttcccttcttcgtctgtctgtctaacaaaatatctgcaaaaatatccgcttatactttcggactgaagatgaaaaaatgacttgcgttgattttttttccaaacttatggtgtaaacatattgtgtagattcacttttctcttgggaattttatggtgtaaacaacgacaattacgaggtacaagctaattttagaagttatgacagttcgatatacgagtatgttcagtttgctttattaccacttttaatcctattaaaagtttttaaaacacgttacaaacatatatgctcataacacgcgcacactcatatctaagaacgcacaaacacacatcctacctctatgatcacctccaagaaactgtaatgacatatcttaagattggctaagccaccacgaacgtctcggtatttcttaagattgatgaagctaccatgagcgtatcgttgtcgacgggtacgtcgtctactatatatgtgataaataaataatcgtaaatacgagtacccatgtccgtatagaattcgaacttggatgggtttgttccaccattagtaacttaatgggttgagctatgcccacttcgccaatcctattaaattttgatgttgctaaacattggttacaaactaaacatattcatgtaccaaaatttggtaattcttatcataaaacagatggtcaacctaaaaacaaggaaaattttgctaaaatgataaacatcacaaaaacatatcacggctgaaaaacacttttaaaatttgataatttgctagagaacattttcgattcaattgaaaagagaaattcttcgaaaatatgagaatgacgggccgaaagtttctagtctgagaataccatgaagatagaatatgacgtattgctatataaagtaatggcaaatttagagttatataatttttaattttttaatcatataagaaaaaatgcccgtgcgttacaacgggtgaagtttattttaatcttattattattatatggtttagttaagatgaaattcactattggagttcccttggatatatattttttttagaaaatcatgagttgcagttaggagtccgatcatctcagcttagcatttgagttttttaaatagaattcttatatgattccttctgtattaccaaaagtgaacaatcttaaaaaccgactcaaatacggatatatatttccaaaagcaaacaaacttaaaaccgactcatacacgaatgacataccaaaataccggcaaaaacatcttcaatttttataatagtagagatttgcttcctgtagtccaactcaatgttttcatttccttatgtttatgtttctattatataggtaaattgagggtgatatggcatgtctatgtggtgattttggtggcaccaagtgctatgttaaaccacgtgatatgacttgtttgaacactataaaatattaagaactaaaatgatccaagagcaaaactttagggaacatattggctattctccctaaacgtttggcaaactgtagcgtaatctggtgtaaaagaaaaaatgaactgtagcgtgattttgctatatatcactcgaaagatttctttcttatctctcactcgattttctcacttaaatttacagtgtattttcttgtaagttacagtgtaatttataaaacttatattgtaacttttgtatgttacagtgtaatttttgaatctttacatgtaagttttgaaatttataatggatttggtctttttctttaaagatatggtaatattaatgtccattatgatgttttttagttactttttgtcttttactctaaagattaaaaatctgtatgatacgatcataaaaatcttttgaaagatatatagatactcccatagcaacccggcccatcaatatctttattacatcaaagtacacgatcgaggttttttgtttattcaaagtagggacccagttcagtacaaacagaaagtatgatagatcctttctacctaattgaagtggcatggaaaatttacccggcacccggccagtgatatatggagggattgtttgatcgatggatgagcacgcatgatatgatttacacacatctttgctaaagcttgtgtaccttgtaattactaattgtttatgtagcaagacacatgtacattagccgtatactcaggcaactgtagcgtacaatgaagcaaacctcatatacaacaaacctttacatcaaagtagacgagatttgtttgtttattcaaaggtactcctatataaaccttactccaataaaaacggaaagtagtatgcatgatagatcctttttacctactaataattgaagtggcatgaatagtttactcggcagcaaccaaccaaccagggagattgattgattgattaatcagcaggcatgataagatgagaaattaagtcgtagtaataatcttgacagcgtccaagatgttcttgccctggagcttgctggagacgacgagcctgacgtagtcctccacgctgatgctccggtagcgcgcctcgccgcctcccaccatctcctccagtggtccgtacgtcgacccgaacgtggcgttgtggaacgccgccacggacacccgctcctgcgccgcgtccaccaccacccggtgctcgatgctcttgtacctgccgttcgtcaccatctcgaccacgtcgccgacgttcgccaccagtgcgccggggatggggtcgacggggatccagtcgtcgcccctcctgatctgcagccccttcaccgggctcacctgcagcagcagcgtcagccccacggcgtccgagtgcggcgacacgcccaggaccctgtccctctccttggccgggcatggcgggtagtagttcatccgcatggactgcgccgcggcgagccttgtcatcttgtcggcgtcgcgcaggcccaggttgcgcgccatggctcggaggagctcggtggccacccgctgcgtctcgagggagtagcggtccatggagcggcggaaggtggaggatgtctccggtggccagaagcggagatcgcggtagctgggcggctgcgtggtgaggaagtagaggtcggaccagtccagcgtctggtcctccgacgtgacgaacgcctggccgtagccctcgatccattccggctgctgcgcgaacgccgccttgtcggccagcgggaggttgaagaaggccatgacgtcgcgcttcatctcctccaccgtctcgtcggcgattccgtggttgatcacctggaagaaaccccactcctcgcaggcgtgcctcagcttggcggcctcctcatggtgatcgatgagcctggcaaagtcaacgacaggtatcatagccatggcatggtggtcgtcggcgggcagggacaggtggtgcgggcgaagatagcggcggaggagggtgggcgtgaggtggtccgggcgggcggcgaggtcttgcacgttgggcaccggcagcgagccacccagattccttggcttcttctcccaacactccattgattatttcttcttcctcgatctctactccaagaggtcttcaactaacttcggggctatactaatactatacatatactgctacgtggtcgcaaattaagtcacacaaattgactcagctatcagctagctggtcaccctcacataaacgtcggacgaatccgtcttaaaaatgcactccctaacttctcttaatccttatcttataaatcatctcttactgctttatggtctctgaatgaataagatcatttttgtctctcctgtttgtctctcaaaacaagttgcaaatgattgaagttggtaaaagtagtggataaatgcagttgtctagcaaatctgataatagtattaggatttcataaagtgagggtgttttaatctttttgttttatattggtttttttggcattgatgaaaaattaattttttttaggacggatgtattttttgagccgttttccgtataatcatgacatcttcttgccgaagctcctagatccagtgacgcgatgcaattatgcaaataaagtggattcggacataaagagctcatatgatatcctacacaacaatcttttagcgggttcaattttggtatcaatgcggatgacggaaatgatacagagtcaaaacagatacggcttaagaatggatcaaaattatcgtataaaacatacatacataaacagagcaattttatgtttcttgagaaggtaccatgaggtattaaaaatttacacagttgaattgctcacataaacaatatagaacaaaaagaagccgacagataggctcccaaactcacgatagagtcttcaagttaaaaataatagataagccatttgaatggaacatgatgatacatgtatcgggtgatggtacatcttttcttccaaatagccctttcttgaatgacccacataagaaatcggatattcgaccgtgggattttggtaatatgccatatgtcattggcaaaaacatccggcttcctagactagcctgagggcacctggtaatttatacaaacttctttgataccgaccaagaacatgagtaagtattatccttcgaaaggctcaaacctgtatacacgatcatgttccttttcgctcccgagcacactgcacacccggacacaccccgtttacactcacagcccttggtaaatcctagatctgtggtcggatgctaacgcttaccatatctttactttagtcaaactcggagcggatcggtccataaacaatttgctctttgctctgttttcaccatccacattagcttctactagacgtgcttgtgggggccacttccagtccttcacctcgtctatgttatttttattagtcgataagtttatttctggttgacttagtgggagcctgagagtaacataacatgttttatggcctaaaatttctactaataataacgggattgttatatggcattcgaatgaaacttggggatgaaatcttacagatttctattaataataatgagcttatcgacaacttgcttctatggctgcatttataggccaatcatagtgaatccggtgaattcaaacaaagttctgaaatgaataaaatttctatgcataaacttttgggataatgtctcgtgatgggttggacccatgtgggctagaccgaacatgtttggcgcacccaagctatgtgaacactcgcccattagatctactcatttgcatggagatatattggtcgaggggaagtgagaataaagatgagggtattgctagtgggcgggtgatcgcttccctctcctcctagcgatcacccgtcctttg

SEQ ID NO: 33046 - DNA, 3899 bp, Oryza sativa
tgcatataatgtttaggtggtaaagcatgcatcacactctagcaatgtttggctaataggaaatggaaatgatttccaacccaccaaaaggcatctttcaatcctaaccattcattctcactcttttatttaatcctaatgcttcattcatttcccaatctcaatcccaccccctatttcctattatccaaacacaccctctgaatacacataaatttattctccactagtaataatatattgatggagatgcaagcacaaagttgtcatacgtaccgtataaataccaaatactccaatattggcgcaggtacgtggccagatgcaacattggctcatacatatatatttaggccaatatgcatggatcaatataaggtccgcatcgatcgatcatgtttttttttttacttttatgtgaaaaaaaatatttaaccatgaaagcttaagcaattgcgtgcaccatcaccggccgtcgtcgatcgatcgatcatgcctggtttcggtttcctctgcaaacatatataatccatcgataattaataaatcaatctacgtatatgcatatatgttaataataattagctaggaaattactctatacaggagtatatatatttgaatgaataaatagaattaagaaggaaggaaggaaggaagtgaggtatgtatcggtacttgttagtattattgttgttgttgccgttggggagggcttcgccggcggcgtgggagtggtcgtcgtcgatggtggtgacgtcgtgttggaggtggtcgtagtggcgcctgacgtcgtcggccgtcttgccgccgccgaccgccgtggcgatgagctcccaccggttgggattgtcgctgtcgtacgtcgccagcgcctgctcgaacctcgcgttttcactctcgctccacgacgccgccattgatcgatcgatcgatcgatctctgttgcttgcttgctagcttaattaccttggaattatgaagaacagtagtgctgctgctatagctagtcagtagtcagtgttgcatggacgggatggccggctgtttttatagcttagatatatccaattaggatatattaattacctaaatttgtctgcgctaattgcagttatgtattcatgaatcagaatgtcgtagcactagctagtcatataattaaattaaatgcaaatagctttatatattagcatatatatgaatgtcagtagtaccaattattgttggagatccaataatgtgaggggtacgctcggttaataaacaaagagaagaaaataaaactatgtatgcatcgcatcgagaggctggccgggcacacaacaaggaacggaaatgggtttttttgggccaaaatatgttttcgctgggtccagtcactatgacagccggcttaagtcagataccaacgaaaatatatcttcgttagcggctaccatatgacagtactttttccgttcctgtataactcaatgtagaatatgatatgacctattttaatataacgaatctatatgaaaatttatccaacttcattgtgcatggataacaatcctagattaaactattttggaacgaaaaaaatacaaatcaagaaatgaagcaaatacatactcctttcataaaaaaacaaatatagaattagatatgatacattattctggacaaagttatattcagattcgtagtactataatatgttacatctaatactaactataatatgttacatctaatactaggttgattttttatggaacggatgaagtactctatatcactagacagcacagctacctacctactaggaatagcgccattctcttctatatatgctctttaattttcaacagctatctaagctagtatagtgatgaatcagactagatgactacttatgtgaattatgtagcattcgatctctaccgaagcatgttttgataaacttaacgctctttgaaatgttgtatatgaaaacacaaaaataaaaaaaaacatagaaattaattggaacggcatgtttctcttatcctaatcctacataaacgaaaaagataagagagagaaggggagccttccgatagcatcacagaaaacaaaaggaagaagagaaaagtttccaacagatatgacgtcttcttatttatatatatgaaattaattaagatacacacacacaccatcctccgaaacatttcttaccatttcctatgaattaaatgattccatacttaaaaatttcatagaaaactgaatcctccaaaatttctatggcaatccttcatttcaaagggaccctataaagtgttaataatccattcgtttgtttgtaattttcgcctctccttttaaacagaaacgttcagacttaagagaagagcgcgcatatttgtccgcaaaactctcatcagtaaataacgagccggattgaagttaatttctttatttttcaccacgccaattcatcccttcttgatagtacactgtttacacatgaaaagaaatggttccaacaaaacttgcaatgcagaggcattaaaattagagtgctaactagctaaatcaatcgtcatgtgttgagttttttttataaaaatgttcatcttcatctccaactcgatgtcagtgctattatatgttgcattgctatatatactagagcgggttcgcgcgctgcgccgcgcggtttataaccgattcgtgttatttgatcagtaccgatgtaacaattgatggaaaacggctttttaagttggctgtttaggtcgtatttagttggctatttaggtcgtgcagcagtaagcattggatctctctgttgttatcgtgggctgatcgggctaacatatcaaggagctataggcttttgtgcttatgtttgacgttgggctcttaaaggtgtgcaagagtataaatagtgggctgctggtgggcttcaggatgcaaggccttttttagctaaggatggatgtcctagggcaacgtgttgtgctgtcattgcatatgttttgttggggctggtatatatgtaggagtgctggctgtttttttaacgctgaatcgatgcggcggcggcgctgctgatcttagcggtttagccaaaggacatttagctagcatggacgaacctgtgcaaggtatgtatgcatatacagcgattaaccctgtggattgaggtgtgctctttactaatttgtggtgatagtttggctcggtctttaatctgctcgatataatggaaatggggatgggtgtttttttagtggcacgattatttttaagttaatctgtcttggcttggaagcctatagaatggccaatagtattttacagtttgcaaggtggctgtgtaggctgttaattgaacgatgacctcaatctatttgagctctctagaataggtcatgtctcttttaaaaaaatacagatgattgatgtggtagggatttgaatgcctgttatttcatttggtgatctggtaaaaagagatggttatatttatatgtacctgtgtagggaaattttaggaataaggggaaaggaaaggggatggacctatgatgctgctattcttattgactctgtttttgttatggtataacagaacaacgccaccttgtgcacatcaggtcgaaaatgttgttgtctgagatccttagaagcataggcgctaatgaggcacgttataattgtcatgctgtcactgatgggtatgttggctctgctgaggcatctgtttatggtgtaagaggaggtgaagagccatttcttgttcgtgcacatggcatcccagctataaggccatgtgatgcggaagaaagtgccgcacatgcactaattgctgttatcaagaaagagtgcagagtggagatcgaagatacgaactgggctgcagg

SEQ ID NO: 33047 - DNA, 3296 bp, Oryza sativa
attcctgcagcccggtaatactggagtagcgttatagcacgattgactgatgtacagatgtgaatgttctggtgttctgaaatggtttggatgtctgcactgatgaaaagcattgctgagaagaattgcgcctggtcggatgctctgcacataaaaagggaaaaaaaaaagaagaaatctatgtctgcagcctatgcaacagctttttttttttacctctaataggacagtgtatgctggagaacaactatccggtataagataatcgatacatggtctgcaaccacctggatagacatgcgtaggtacaatggtttcatatataagaaacaacagaagtggtgattctatggcacaaatgtaagcagattgctcaggaaggaagtagtataagcggaatagatatagtactattaataagactatgtcttatcacttgcagtgatatttgttagaacgtgcatatattacagacaccaaacattgctgatactaattcatttatcatttggctagctattaggggtagtgagcccgtaacaggtaaaactaatatcgattggtctaatggcttgcgcaaaagaacatttctcttttctatgttggcactgcaaaatagattgaccaaagtattttagctttgcttcaatcagggagagaagtatgcgcgttgccatgccaggtgcaaaaggtcacttcgctctggggatatcacatgggaggctcaagtcctgaaacgaagaatgtaaagcagagtcacatttttgctataacaaatgaggaggcaagaaatacatagttgcttgagtatagttggtcacattttggcagctctggtggcagcttgtctacgaacagtgtgtgcacaacagaaggcttgcgacgatcatgttcatcaggagatgagctacaaatggaagttgtttgagtcatgaggaaaaagagaagaaatcaaagtaaaacatgaaattttccattggcactaaccctccatggccaagattctcatcagccatagaagatttacgttttttatctagatgtgctatagctatgacctgataaagtattaatggttaggaaggtctgacaaagacatatgcatataattgatgtgagtataaaatatattgctagcctgtggagtaggtggtgttgcctcatgctgatcaccatggctgtcccttgtgtcctatacaaaaaggatataatctaagaaattatggtaacttagatgtaacaggtcacatatccttataagacaacacaattagattatacctttgtatctggaagcacaaacggcgtagaaggtggcatagattgagtagaagacaaaacgatggcatgtggttcaactgcattagctgatgttgagccatgtccagaagagcccatgcaagtatcatggctgggtagacaaattgcatggcttggatctgggtggggtagcataagggaatccacctggtaggatacccgatttctttgcaatgagccacgtgacacactagttctaatgacatattgtctgccaaaaattgctttgatctctggtggtactatatctcgtgctccatgaacagatgcaaccaggttaagaacaggcctgccaatcaattgttcaccgatttctccaaagaaggtaaactcagcagctttggcttgatcgtttgccaaatccgatggatcgatacccatgataactactctgtacctattatagaaggcagttcagacagttctcaatacacatggattgaattgtagcatatagattggtttatcatgtaaaatacttgagaaaagctacatgtgtgcatatgataagagcaccttgtttctattgcatcagtgctgcatctcgggcatttatatgcgtttccttctctagctgtgcctctcttataggtgctgcatgctatataccaccaaggctcagcaggaaccaagtccctgatgattatattgacaacatagctattgccctggttgacatgcgaaaaatggaacaagtaaaggatggcgctaataacatatgatggaaataatgatcactagtagcgctgaggtaggttatattaccaaggcctcatggggattaaggtcacaaatatcagaaactttgacatttatagcttccttttgaccgaagttagcctctatcatcctgaccacctgtgggttaccgtgaaggcttcaaatgtgaaagaagttagtgctctggtttgtaggttagggaaaagcattgatctacatgacacataaggtagcgaaaaaatatgttgaataaagtagaaggatgtctatgtgtatgaaaagagcagagctaagtggcacctgcttatgagggagattgtttcctggattggtgcgttaggataccatctacagacagtgctaccctgtagggctagctggcctgtcaaagacgaaagaacacatcatgtgagttagaacagtgaaaatatgcaaatgagataggagggataatagaacaggaatttatttcttacggtctcgaaatttaacagttaaaccaacaaataacatgacaacatgtccattgtctgcttgctgctgcaagttttcagcgtggaattgtgtagcatggggaccccataacgccacgacgacagtttctctgcaagcacataaaagaactaagaagtggaaaataatgcagatgactttttaaccatccatatttgctactaatcaagatgccagagaatgttcgtctagaaaaaaaaggagaaacatatatgtttccaagaaatcgatgatgcacatgaaaaaagcaataatgatctatccgtgcataggttgctcattttggatggtagctttcactcacccagaacagaaatatgtttggaataggtaacgtatcgatacgcacataccttccattggttatatggtcattaagcacagctttcataacacctgcataagaaacagtctgcactggcccgatggctgtcattatgcctatagcatctacatgggaatatgagggaggaaaactgtatatgagtaaatgagggcagcaagctagaaatggagaagattaataagcaataatatagattgatctgggccaaggagacttacctgaaataatatctttcttgtaagcccgagctctgagttcatcaaaagaaagaattttgcaggcataagatgggaacgtggatggtggtccagtatcttctgtaacggttgtgtgagcagtgaactttgccatcaacagtcgatcaacaggcctatactgggggcgtgcctcggcgact

SEQ ID NO: 33048 - DNA, 5400 bp, Oryza sativa
aggctcattagctgtggtgaactccgagaaccgggttgcccgcactcgtacgcgccaacggtgtgattcctgtgtgacatcctttaggagactgtaatccatctgcagggcatagaaaacacatcatgcaggttagaggggaattatacaaacaatgttctgcatgatatgaaggcgcaaagctgtaattgctgaagggactatggtggagcatataagttttttagttttggagctgagaattattttcagtgcagggcattttaataaatcatgtctaaaagcagctgatagtaacaagagagaaatatggaaattaagaaagaagaatcgataagcacgcatgaaaggcactggaacaagcaagtgatcaaacaggaacaacacatatacgaacacaagctggcagtaaaggctaaacaaaagggaacaacaaaataggaaagctgcaccgacaaatgggatcacagaacaaagagcttcacaaaagagccatcacagtgctgcagagatagccacaataaaactaatctacagcaacgataatatttcgttgtagacgatgttcttggtggtggaacaaggatttccatcatcatcttctatcaataacttgagtccttcctttgatgtagctcgcgaaacagcaacatatagctatccatgtgtgaagatagggttcttgaggtatacaccaacatttcctaatgtctgcccttggcatttgtttattatcattgcataacatagtctgataggaaattgcctgcgctggagcgtgaaaggccacttcggactatttccacttaggacaatccgtggaatacagaccagctggccaatatttgtcccagtcatgattttgccctcaaaaataaaatcaccaagtcgagtaaccagtaatcttgtcccattgcaaaggccaagtgattggttgatgttgcgaagtaggacaactgctgaaccaattttcagggatatgtgatgttccgggaagttgtttatggatatcgagtttagaaattctatgggatacaacagatcaaaatccgcagctttctcaagtgtatttgcaatagtgtcgctgctaagatagtcctttgcttctccaggtactttggcaagcatcatatcattaacctcatcaacaactgcatttactagacagactattgcgcgctgagcaagatatgggatgcagtcatagttggtctgaaaatctgggtagacagcatcaattatagctgtaatcttgtcaccatgtggagtaagcaacaattcctcaggtatctgtatctatgtctgtcacaccccaaagttctttcccaagcctaaattgaagttataaatggtctcaagagaatacttgtgtaaagcaagagtaaaccttaataaattaatgcaaataataatcggaactgacatgtggaacttttgagttctacatgtcgaaattcgctaacaagatttttagtgaattttcagagccctagaaataattttaaccaattaaaattgagcaagcaatattttaattccagggaaaatccttttcttcctttttctttttctttttcccccttttcttttcgagtgggccgccggcccattctccttcctcctctcccctccgctgggccggccgcctacctcctcccacccgggacgccgacaggtgggccctacctgtcgggcccgtctcctacctcgcaaccgccatcgccgcacccactcctccgctttccccgcgccccacgccgcgtcgcccgtgcccacgccacgtcgccgccccctctccccgcgtcttccggccgcgcctgcgcacgagaggggcgggattcgattttgaatcgccccccaccttctctctctcctcccccacgtcgccggcgaaatcggggcgcctcccggccacgtccgcctccccctccacctataaaatgctccccatgcccttctctctcgttttccgctctcaccgctccatcccgtgccccctaccgagctcgcgccgccgccgcttgcgccgccgcccgccgccgcactccggccgtgtgctgccgccgctagagccgtcgccgcgctaagccaccgccacccctagcttcgccgccgcaagacctttcccggccgccgctttgcgtcgccggaatcccaccgaaaccccatctccctcgtgtcgccagttagttctctctcccctccgactccggccggcgtggatggtcgccgtgagggtttccctctgtcttaattcctcctctctttttccctaggtgtcgccgtcgcttgtccgcacctcggcatcgccggtcttcgccgcctccctcgttttccaccgccggccgttgccgcccctccggtgaggtctccctccccttcctttccttccctttttttcccgtgcgccgccgccctcttcgtgcgctcgccgtcgcgttcggtcgtcgccgctcgcgccgccgcctgccgtccgtgccgccgtttgccgtcgccggcggtcgcatgcgcgcgccgccgctttgccatggccggctggtcggcttgatgccgggcctggccggtacatcggcccgtggagctggggccgtggggcccgcttgccagccgtgccccccttgagccgctgccgagtggggcccgcgtgccggcgccccttttccctctctcccgagccgctgaccggtgggccccgcatgtcggcgcccccccttgatgacgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgcgtagaatccactaaaaatggttttgttctctgtttcagtagtcttatagcctgtttgtattgtttgctttgtatgtcgcctagattccggttcttccgacgctccggtgtacttcgagatagtcgccgaggttcctccagctgcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgagaggggactgcccatcgcccgctggggacgggggtgaaacctgaggtgtggtgtgcttggctagagggggttatgcgaagggtcctatcacggcctctttccggtatgtcgtggtggcatgtcggcgcacggaaacgtgtcgtggggctgtcttgtgggtacaattgtacacctctgatcagagtaaaactattcgaatagccgtgcccgcggttatgggcggtcaaccagattcaccgtgattagactcaccctagtttagtcttttgaaattagatagtataggtggatggttgggcctgtcgcaacgtggtatagcgttggacagtggatgattaatattgattaattattacgactgttttcttctttaaacttctgtttataaatactcgctttatgcaaatgaaccactctagctctcctttgataattccctgcatcatacccctattccggtatgacttgctgagtacagtgggtagtactcagtcttgctctatttttcccaaccccagagtatgagtatgtgtcagatggaggtttctccgaggagtaggcttcgtccgtgccgttgaggatgcctgtggagtggtgttcccgctgcagttctagtcaaggcttagctcctgttgtctttcgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaatgtcttttcaacctcaccctgtcgtctatccattggaacacgtccctcaccaatgtcaagaacccatttagcgaactctgctagctcatccttggcttgctgcgagagcgatggattatgtagcctcatgttaatggtgaggtgtaagacttcaacatggttccacaatgcagatttaaccaaggaagcaggcaccacatcagctcttgtaccttgctgaatcactggcaagacctgcctaaaatcaccaccaagcaaaattgctttacctccaaatggcttatgcgcattacttgcatcatcagtggactgaatatcccgaagagttctatccagcacctcgaagcatagcttgtttgtcataggcacctcatcccatataatcaatgatgccttcttaataagatctccaagtattgtacctctacgaacaccacacatggactgatcatgtatatctataggtattcgaaagcgtgaatgagctgtccttccaccaggcatgagcagagctgcgactccagaagaagcaactgcaagaacgatctcgcctcttgacctcagccttgccataatagcattccacaagaatgtcttttctgttccaccatgtctagatataaagaaaatacatttttccttatgagctagcctgtcaaagaccttgtcatatatcttcttctggtcatcattcaagctggcatacatggacatagactcttcatggaggctgtcttggttgaaactaagctcttctaaaataagcctatttcctgcactggtatccgaacattcagctggtgtcgggagatcgaatgatgagattaataagccattatttgagaaaatgccatccaattctttgagcaaggtgttctgtaacataacatccggaatagctctacgctgtactccaagagctttggttagcttgtaagcaaaatcatctgccatatacttccagtatttatcaaacaaaaccctaacatcacctacatcacaatgtgctagaacagtcatgaataggttccgggctgcaggaat

SEQ ID NO: 33049 - DNA, 670 bp, Oryza sativa
atgcgcatgctggtacttaatgcagcgagtttagctgaagcgggtcaaccatttcatcgtgaagcttaccttgcaagacttttgtgcgctgaaaaatctatgaaaatcggtacggatggtgtacagatcctaggtggtcatggttttaccaaagaacaccctgttgaacgttggtatcgtgatttgcgtgctactgcaatcttacattctggcttacatgcttaattgatcattcgaggatattacaatgaatttacaaaatcctaaaaaattcaaaatgatggtcgatcaggcacatgaagttgctttgaatgtgttgcgcccaatttcaagaaagtatgacaaagccgaacatgcctatccaaaagaattggacatgttggcatcattaattgatggcatgaatgaaggtggtgaaggaataaatgcaggtgctgctgttggcaaacgtggagaaactgagtcaggtaacaaaaacggcaataatatgtcgactgcactcggtattatcgaaatgtgctatggcgatacgggtttattgttaagtatgccccgccaaggcttgggtaactctgctattgcggcagtagcaaatgacgagcaacttgaacgttttaaagggacatgggctgccatggcaattactgaaccaggttgtggttcggactca

SEQ ID NO: 33050 - DNA, 678 bp, Oryza sativa
attcctgcagcccgcattgaaactacgctctaactacattgtaactacgatctatactcaactatgtgtcgaaacatgaattcggcaataataaaagggggtagcgtacgagacttaaaagtggatggatgcagagacaaaggatttagacaggttcaggccctctcaatgagaggtaataccctacttctatttggggatttgaatccgctgggtgaattatagatctgacgatctagttgtctcatgccccctagagggcctcctgctcaccttatataggatggggggcaggattacaagatagaaaccttatccaatacggtatcggtttcctaaatctactttacaatcttatcaaaccaggactttaggccgttccgtaatatacaaggaaacgtaatacccaagtcataatctgttacatattccatatatataagttatcccctataactagtcggataaccatgccgtgtgggtatggggtacccataatctccacagtagcccctgagaccttcacaatcgaaaagataatcttctctcgaactagattactccaaagccgagtgcttcaatcatctttgccatggtctcccgagtacttttaccaaatctgaagactgttaagggctgaaaaataaagtcaggtgcatcgactagatgcacctaata

SEQ ID NO: 33051 - DNA, 9014 bp, Oryza sativa
attgggcacataatcacgcgcacttttgcctaagcaaaaagatgcctaagtccctaaaagaacgtgacaggccacacctgaaaatatgggctgcagacatattaggtctaggccaaaaaatatgccttcgacaccctttaaaggatgacgcatgtaacatgctcctgagtaataaatctttcgggtgaatagaccaagtgtaactcatatgaatagcttctgatctgagtgattatcctttatgggatactccaaaatagatataacaattgaattccgactagcgcaagtattcggttgataacccttacggggaataataaatagtccagtctttgagcatagaaaatagacccatgatcatcaaattcatgttgcatgtatccggacaagtccaaattgaaggtatgatacttgtgtttgaggtagtaagcccctgagtatatagcttgtccttctgtcgtagtcacaattgtccattgatggtagctgacgcggttggcatagagacaagacgaccaatttagagataatattgcccaccagaggtggcaaaaatattggtagtagtgaagatagtgataccaatcaaaagtgatgaagttgcatagccgtggaggcgaagaaaccagtcggcaacagtcaggtcagccagcaatgaatatgaagcgcccagcgataaagttgtgtagccatggcagcgaaataatcagtcggtgacagacgatgcagctggtgaagaagatgaagatgcccattagtggcgacataataagccatccatgaaggcgaggataccggtcggtggtgacgaaagcaagccgatggtgaagatgtagacacgcatcaaaggcgatgacgaaatccaccaatcatgaagatgaagaaaatagtcggcgacgacaaatgcaaccgatagtaatgatgataagtagcaatcatagatgatcaaatataatgacgaagttgcccatcaatagcagtagagtgggctatgttgaagaggcttgacaggatgttgatgaagataacgatgtcggtgatccagtcgatagcaaccgtgaaagtgaaataataagtcggcgaagacatagttatccattagcaacagagttgatgtcagggccgatgaagcagaggtgttggtgatgatgtcagtgacaataatccatcaaattgatgttatagctgttgcagatgcttcacttgaaggaaagtagatgatgttgtccaactcgtcgaaactgagctgattggttgataactctgctctaaagcaaagacgaagataatgactcctggaattgacttgttggctgattaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagattggaacaccacttgttgtaataaaataacacggcatcatatttggtgacgtatgccaaggtgttgaaactcttgtagtcgtcatggttggtgaagtagcaaagcttgcgaagtagaggcaatagagtttgccgatgccgaagataataaaaatgaagttgctccaccatagtgacaaagttgcatagccgtgatgaagtgaacatgagttggcggcaacagaagcaaaccggtagtgaagacgcgcaattgtgaagataaaagcaccagtcggcggcgacataaccagtcgacgacggaagacgatgatgtccatcagtagtggtagctgtataaaccagacgtagaagcgagggcactagtcagcagcagacgagacgaccggcgatgaagacgataaggccaatcaacactagcagaatcatgcagccatggaagtgaagaaaccagtcggcagcagacgtaggcagcttgtgttgaagatgctgatgcctattagcggtgacggcgatgtagccagccgtgaagaagatagcatcagttagcgtcataacaggccagccgtgcaggcggtgacaccagtcggcgacggatgaggcagccggtcggtgaagcggccggtcggtgaagacgtagatgcccaacaaaggcggcataataggccagccgtgcaggcggaaacaccagtcggcggcggacgaggcgaccggtcggtgaagacgtagacgcccaacaacggcggtaataagccagccgtgtaggcgaaaacaccagtcggcggcggacgacgcggccgatcggtgaagacgtagacgcccaatagcggcggcataataggccagccgtgcaggcggaaacaccagttggtggtgcacggcggaaacaccagtcggcggcggacgaggcggccggtcggtgaagacgtagacgcccaacaacgatgacataataggctagccgtgcaagcggaaacaccagtcggcggtggacgaggcggccggtcggtgaagacgtagacgcccaacaacggtggcataaaaggccagccgtgcaggcgaaaacaccagtcggcggcgaaggaggcggccggtcggtaaagacgtagacgcccaacaacagcggcataataagccagccatgcaggcggaaacaccagtcggcggtggacgaggcggccggtcggtgaagacgtagacgcgcaacaacggtgacataataggcctgccgtgcaggcggaaacaccagctggcggcggatgaggcggccgatcggtgaagacgtagacgcccaacaacggtgacataataggccagccgtgcaggcggaaacaccagttggcacaagccggtggtgatgttctgactgatccattcctggagcgtaagagataagcttaaagccatgaatcccttttatacatatctggatctggatcctgcagaacaaacatataggatgagtagtatctgatataaatataatactcgagaaaaattcaagtattttaaaatatttataaatatgtatttcttctcttgtcaattttgatttccccgagcaaatgactcattacgtttaaacactctgcccgactagtcatagccaccaagcaccgggagtcggcctaagcacttcccaaacatgcatatgagtgacatgagttcgtcattaatggaacaaagtttcacgggtcggagtttactactcgggtacttttgcaattattaagagcagaaaataaattatcttatctctatacttttgatttattccgaataatacttagcaccttgcattattcggtccatccaacaagcccccgggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaaataaatgatgacttagctttgtcgtatttcctcggtgacagcaaaagtagccgatgtgggaacgaagcagtccatcaatggtgacaaaaacaccagtcggcgccagtggaaccaagccagtggtgtagatgatggagcccattaatggcggcgaagtccgccaaccgtataggcgaaaacaccagtaagtggcggcagaggcaggccggcggtataataggctagctgtgcaggcggaaacactagtcggcagcggtgaaggccagccggtcggtgaagacgtagacgcccatgtacggtggtgtgaccaaccaaccgtataggcgaggacaccagtcgacggacacccaacaacggcagcatataataggccagccgtgcaggcggaaacaccagtcagcggcgacgaaggcaagccggttggtgaagatgtggatgcccaacaacggcggcatagtaggccaaccgtgtaggcggagacaccagtcggcggcggcgaaggcaggccggcggtgaagtcgtagatgcccaacagcggcggcataataggccagccgtgcaggcggagacactagtcggcggcgacgaaggcaagccggtcggtgaagacgtggatgcccaacaacggcggcataataggccagccgtgtaggcggagacaccagtcagcggcggcgaaggcaggccggcggtgaagtcgtagatgcccaacagcggcggcataataggccagccgtgcaggcggtgacaccagtcggcggcaacgaaggcaagccggtcggtgaagacgtagacgcccaacaacgacggcgtgaccaaccaaccgtataggcgaggctgatttgcatgtagattcgtctctctgattttgttgacattatgggcttggtgcagctaaccggccttagaggttgcgtgtggcatgagcaaacgctacatcggtagtcgagccacgcactatgtcctggtgtacccctctcggcaacatggtagcagtgggaagcattgcaccgacggccgtacatgcaataaaaaatcatgagaagattagtatacgttagtaattaatctaaatatataaattacaaggaggttaggaaccggcagcacagccaaatcccatcactcattaaggaacgattttttgatctcgattgccatcctgtgcatgcgaccaaccatcgctccagtatacatgcaaaacaaacagatatagtttgattagccttaaaatattacacgcttaattgtgtaatgcatatatcaagctagggtttgatattaacccgtgcatatcagttgatcaacacatgcacgtgaagcactcagtcgctgttgatcccatggacatgaattgtccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaatgatattaattggagatcgaatcgatgaaattgccgagattgatcccttcgactggattgaatccgagacgaaaaagacatgcttgatgaatccggcgatgtcggagattggttccatcacacttgtgataggaaactcgacgaacccctacctggcgcgccaactgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccaggtgaattatagatctgacgatctagttgtctcatgccccctagagggcctcctgcccaccttatataggatgggtggcaggattacaagatagaaaccttattcaatacggtattggtttcctaaatctactttacaatcttatcaaaccagggctttaggccgttccgtaatatacaaggaaacgtaatacccaagtcataatctgttacatattccatatatataagttatccactataactagtcggataaccatgccgtgtgggtatggggtacccataatctccacactatggtttggttgtctagcacagagattgatgtgatattcacaaggggtttttttttacatatatatatatatatatatgccttgggctaggtatttttgaaggctcaatatttttgtagtcaatagaaagaggcagtcctcacgccctcttattgggaggggaaaaaagtactaattccatgtctgcgcgtttgggctcgcatcgcaggcatgcaggaatcagccggtcgtccgtcgtctcggcgagaagaaccggttcgttgttttgcttgccgttgcttcttatgatcggttcgatcaccaaaggcagaacccttgcttgatactgtacaacgcctgctagcttagctgccggcctgccgcatgcagcattgccgccccaagaaacaccggaaaacacatagccagaccaccaaaaacgttcgtgacattccgccgcgggcatcgcggcggtgcgcggcaggcatatgcagccggggcatcatggggcatggggccgcgcgggccggcatatctcctcgccccgaaccatccgcgccgcgcgggcaattactcggttcatttttgccacgatccgcgcgcgcatcggtcggcatgggccgcgcgcgcggcgcgcgcaagcggcaacacggcaacgccgcccaccatgtcaagttggccgctcgcccgctcgacctcacgcgtatgcttcggcgcaacatgtccaattgtccgtgtacccgtcgtgtctgcttcctgatcgttacggcgtgcagcgggcgccggtcgatcaagtcgagattcgcggttgagtccgtgccgttgatctgtgttttcggtagagcacggtggtatccatgggaagaggaggaatcacgttgtacttgagtggccagattgcttgacatggtttgggccttttaagctggttgtgcttaggtaggacctctgggctgaaagggaggtgtaactaaacgggcttgcccgtggcaccaaccccacgtttttggagtcttggacttttgtttggcttgggctgagtggacgcgggatgcacgtgggctgcctctcgcaattgacctccgccagctgcgacgccacctacggaggcgcttccaccttgcagcgaagagtgtaagtggatcgatccacgaaaccattaaataaggctcggtttgattcagcttaagattattataatctaaattattaggagtaagctggaacaaacaagtagattattatgctagattattataatatataagtcagattactataatccaataatctcctttagaggagctttttccagattattgagtggctaaagacccattacccttagatgcctctaataatccaaataaacaaacaactcgtagcttatttttatgtcagcttattataatacagcttagagtaatctgatttaataatctagattacaataatcttaagctgaaacagacaggacctaagtggataaatcattaagtggattcgtggatcagctcgtttgcttgtggcattccatgtagactgagaatagagaggcagtggcggagccactttacgggcaggttgggtgaccgctcggactctatcgtcatcgtcttcattgtcaatagctgccaaaacatataaaaattaatcgatcacgggaaacactaacagtcgcctgaacttgacgacgctacatataaaaattaatcaatcacggaaacactaatagtcacctgaacttgacgacgccgctgactccgtcactgggcccatcgatgcttgtcaatgacctgtgactccaacctccgactcacaaccacaagttccccgatcagaaccgggacaagagggggacaagaggcataggggatggacttagacagcagcgcgagtaacaggagcaacgaccagaaaagcccgtgcttgattattttgagcacatgcttcttcagtaaagaggaatcagacgattcaagtggaatttttttgtaacgtatcaataagatagagctatgctgcgggttgtctcaggtcctaaataaacgcggacacttaaaaaatctgttgggtaggcggattcgcatctcttacaacccacacaatcttcggttcttggtgcggaagcaatttgcttggctttacatccatcccaaggtatcatttgtaatacatttattggacaagctcgtgcacattgagtgcatcctatacatgtatcataaatttttacggaatgtgacattagatctataattttttcctttcaacataaagattttcgacctggtcataatgaaattagttttcgttttttttataaggagtgtgggggtagtcatggccatctaggcgtgtaggatagcgttgttgtgggtgatgggctgattggggcaagggctcacgggtagagtttacaaaaccgtacgtgcggttatcatttgcgataaccttttcagtttttaaaaccacggaataactcgtggtacctgcgcggttcagctggctcgctagcttgtggactagcctgagttagcttatcttaataacgagctaaaatgctatcttggctcattacaagatggaaatgagtcgacttgagtcgagcaaactaaccaaacacgaatttttgcccggccatatgtgcaggtcatattttatccaggcacttagcattgtctagatcctcttggagattctgcagctaagagatgaaggttcgtctccactacgacacaatgacacataacttatgactctgaagtctggagcatgattcttgtgggagatgataaatcacttattcatgcgttcaaaatgacatcctcaatagcgtgatgacaaagaagtacctttttttttctttataatgggcagagaagtacttgatcctagaaaggcaaaagcacatgtaggtgggtaaagtacaaatattctaacaattgagaatttgtaagtagaggctctaatatactgtcctacttggaatatgatacagagaaaatatcacaaattttttataggagtagctagctggatgataaggtccattgcatcattccaattgtggcaatgttgaaatgactaggcaactggtcaattataaagggatagtttaggactttctgcaacttgcccctcattatgcagttgtttatagaatgagcaattatactgtctgctaagctctatcccaatttccctgttctgctctcctacttttgtaaccgaaaccaattttcccttgttatttaagttattcttcagacgactcacgtgtagatcaaaatgtcaacatggggctacgatgtcgaaagatatattaacatggaacaactcaatacaaa

SEQ ID NO: 33052 - DNA, 14622 bp, Oryza sativa
gactcaaagaatatgaccccatgtttttcatgaggcaagacaatgggattgactacacgctgtacaacaatacaacctatgcaacttactactatattatccacgtaataacctacagcctacaaattgaaatattcaaaaaacatccaattgaactttgactaaagtttctatagcttctgatccatgccaaaaacgacggatcctgcatgacatcaagaaaacaaatcagtaagttttttccttcgcgaaaacgcaaaaggattgtacgtcaatcagtaagttaaaagtatgatacggcaagtattttcactgtctgaattctcggttgtgtagagactagagagttgtcacttgtcagttaatttacctaacgttggcagtaggatggtgagagctgcaaccccgacaattttcaggggcgttccggcgatcaccatgtccttgatgctgatgtagcccgtgctgaagccgacgacgttgcccggcgagccggtgggcagcaggtaggacagctgcgcgccgacggcgccggggaccatgaggaggagcgggtgcacgccgatggacttgcccagctcggcgagcagcgggagcaccagcgtggcggtcgcgtcgtcggaggtgaactcggtgatggcgccgctgaagacgcacgccacgggcgcgatggccagcgccggcgcgccgcggaggaagccgagcccctcggagaggatgtcggtcaggccgctcgccctgaagccgtcggcgatggcgaagccggcgccgaggaggaggatgatgttccactgcagcctccggcacttgccccagtccatgagcttctcgccgtcgttcttgccgctcgggattatgaacagcagcgtcgccatcatgatctgcattgcgagccaagttgttgtcccgtgagatcatgtgacaaatcgtctctgagaaaacaaatcagaatttgttcgatccttggtgcgcttacagtgacagttccatccccaacttcgccgtggaagagtgatccccacccaggaatatcatctgtcaggctcctcgtcatccataggacaatcaaaccctgcaagaatcaattatggatacattaaaattttgtcacactataacgaacccctccatgatcgcgtcataataacgaacctgcacaaaattagttgagaagggcccaccagtgatgatgtggcaaattttaaaattttgggaactaaaatttcaggcatctcttggagaagggggtgttttataggccaaattagtttttggctgtccccaatataggatttttggggctttaattttagccctttgttggagatgctctaaccgaacactgtttccaggttgagataattgctataaccccagaaatggaaacggaacttaccccaaaaacggctagaaccatcttctctgcaaaagccataggacctgtcacaaatcaagatggacaaccgaatcagaatccattatggcaataattatcatggcactgatatttcaatgagtgccactgttatggagaaaaagaccaaaacgaggtccatttcagagttacccaggtttcaggaaatattggccgagaagctgtcagagtttcagagataaccccagaataacattgaccacgccattgatgagcactggccattgccgtgaagtaacaaacaaacagagcaagaacgagaacctaccaagcaagctgagctccctcctgagatggctcctgtccaggtaagctgagagcgccctcccggtgttcttggagcagtacaggacgcagagcgtggcccagagcgcgacgaagaggacgagcgccaatgggagcccgaacgacatccacgagctgaaggtgatgggcggctgctccgggaagtaggtggaccacatccccaccaggatgatgttcacgccggtgcccgtcagcgtcgccatcccgccgatcgccgacgcgtacacgacgccgagcaccaccgccttggagaaccgctgcacctcccgcgcgtccgcggcgctgctcgccgaggacgacgccccgtcgacgcgcgggaaccgctgcaggatccccgtcgccaccggcatcatcatcacggtgcacggtgtgttgtggatccacatgctgatgaacatggtggtgccgcagattcccagcagcagcagcggcggcttcaccgggtcgccgcagaacagcgacgtgatctgcaacaaagttcgcgggttttccttggattgttagttgcacggttcggacgaacgggcttggtaaagacgggctcgcggcgcggatcacgtacgttgagagcgaggcggcggtggatgttgtagtgctcgatggcgagcgcgaggatgaagctgccgaggacgagggagatgacgtcgtccatgtaggccttggcgacggcgtcggaggaggagatgccgaacacggggaagaggaacagcggcgccatggacgcgacggcgagcggcacggcgtcggtaatccaccacaggaacacccaggcgagcaccccgagcatgttgcgcgcggcgcggtggccgccgaggtcgacgaggccgcagatcagcgcgcacgccacggggcccgacgcgaccgccaggtacttgttggcgagcagcgacctcagcgcggcgcaggagcgccggcccgccgcgccgtcgtcgtcgtgcagcgggagcagcggcctcgtcacgtcctccgacgagctctcccagtggctgcgcctcggatccatggccggttacaaatttaacaaaaatcgttacgcgattcgcctcttccgcccgccgcgttcgacgacgactgattggttttgcgttctcgtcttctccagctgcagcgtcccaaaaagcttggcgcttttatagccggcgcgggaacagaaacagagaaactgtttgtaaaactgaaaagtacttgttgcgaacttgcggttatcaggttgtgatcaaatgatcatcgatcattcgtggcgcgtcgaatcaaggcgccacgtcagatattatttaaccaggaaaagccaaattagtaacatggaaatttttcatggctatccaacgaccagtagggagcattaatgaccttttttaattaacaagtcagcatccagataagcacggtcagcagtacaaacccgcggataagactccagccatcgactgctgatgtgtcctccgccatgctcgtgcccccatcttgaaccagcccttgagtggacgaagagctggccgaccgcggttggttggtcggacggagacggggcgacccgccgacgcacgcacggccgtctcacggcgtcgagcagctgcaattgatcacgtactactacggcgcccgggtcttatccggacatgtcgacacgatccatcggctcagacgacacggacgcttccttgcactcgctctcgcggaatcatctctagctgctgctatccacgcacgtcttgacgtgggcacacggccgcccacgccgcgcggtggcgcgcgggcgatctgcatcggcggcaccgagtgtacgagcgcgagcaacggaacagcgttggtttggttggcagcggcatgtgcacgcgtcgcggtcgcggtcgcgagggggtggcgcctccctgagatgcacccgcgcgcgcttgcggcggcgtttaatcgttttgtgtttctcgcgtgctcgcgcggcggttacaaataatttccacggttcggggggctcgaaagcgatcgatcgatctcctccgctactacgatcgatcgagcattatttgttgggcggctggtggatgcattcgcggcaagatgcacctgcacatgaggagggaggggggatcgcggcgtgtcgtggcccggaagcccaccgaagcagcaggggacgtatctctttcccgatcggtgcaggctgtctcgctataatttgttttgggtccattgcttcgttccgttacttcccctggtcgtagtagatggataatgtcatcaggtacgtacgtgtctgccatcgaacaacttactctggctggggatgagatacggatcctgttgttgcgtgagggatctcgagttacgctcctacaagcgagaggcaaatggtcactgcttactggctaaagcagtttaagcgaaaaaaaaggtctaattactggctgagagggagaaccgggaatattgactcctgctgattcatatcgtcatatcgagctcgagtcatgtagctagccgtacacgttataagcttgacttgttcagtactactctattcgcacacataaattcaggcacatgcatgcacacggctagctcacattcttctgtcgcattcctagctgcttccgtagcgcatgacgtcaaacctatagcagccgggtccggcgccgtctattgcttctctctgttcgcaatttcgcaggcgattcgatccaaaagttggttccaaccgagtcgaaacagggacagaaggtaccaaatcttccttttaacaacacgacctgtctgctaaatgaatattcggcctcaatgattgaatgtcgatctgcctctggcttgcaatcgtgtcgaaaccaacacttcgaaaataacgtctcgtggccgcgtagccgctagcttagcttgggatcgatgacgacacagagtggaacacgcgaagatttacacgaaaggcgcgcctgcctcgcattacacgtaagtagacgggacgccacacgtagacacaatcatcgttagtccgattacgcgaggacaggacacgagtaccgagtatacgtatataggagtacgacgtacgtaggtctcgattgatcggtcggcggcgacaatcatcatccagggcagccgcgatcggtggacgacgagtccgaatcgcatttctgtgcgcgcgccccggatgcggcctgcccggggtcgcgccgcgcgccgtgcacacgcgcgcgtaaaccgtttgatgatcgctgcctgcgagcaatcgagcaggagatgagcaggtttgctacgggagcgatagctcgagattccaaccaaatttcgggcgaaatcgcggctgccacgtgacgtgactagctaaggcgaggtttgcgataggatgagcacgagatcagccgatcgaccgtttcacggtaacgggtttattaaccggtgactagtcttttctcgtacgtgtgtgtggtcttcagattccgtgttagaaatcacatactatgttgcttatgtttggtgacggcctgactgaccaatgatcacaaccacacgttttttatttctgtattttcaatgtctgtcatgatcaaaccccttccgtgtggaaattctgtgtcttgtactcttgtttgttctagagaaaaagaaaaaaaaaactttgtgagctagaaccgagagagagagagagaggaagatcagaagttcagaacatcttatcggagcgtcttcatttcattggattgtgttaggccgaatcagtaaaggcccaatccgtcaccaggttggatttgtgaggttttccatacctgaagccgaaaaggaccaattagactcagttcaaaggaaaaagtttactttaagtctctcaatttgtcacacaagtttgaaatttggacagtgattttggctgacgtggcgcctatgtgaatggtttaacttgttcattgtcccacttgacgttgacgtggcactacaattgagattaaaaaattaaaataaaatatatgggcccaaaagccagtcaaataaaacaaaatttataatgggacccagatgtcggtgggtcccacttcctccaccttgcccctctctcctctccatcccctcctcctccctttgcttccaaattccaagtgagtgtgcggcgacggcggccggcatgcaaggcagcagcggcaaatgaggtgagtcccgtcaaacatcctttacatggaccaaaataaacaacccatataaggcccatattacacgtcgatgatgtattctgtttctcaggcccaacaaaggacagtcttggacgtcgtaattttttttttccaaacgaaccgcatagggaagtttcgggcgttataataattttccaaacgagccgcataagagagtacgatattttatatatattgatagagtaagaaaaaattataaaaccatagcccaaacgaactacactctacgcgcctacatcgcaaactgtcggagcaaggaactcctctagtgggaaggctagacacccttccttgagagttcggccagagtgcaagcatccgtgctcatgcttaggtcgtgcgagagtacatggacacatgatttatacaggttcggatcgctgggaagcataatactctactcctatggttctaggactatatgatggagtttacaatgagttattggtgttgttttaagtgggagagtatcaacccttcttcactataatgtggctagaatctaacttaatcagaatgaatcaaactgattgaaccggaattagaaaaaaaaattctcaatggcatggatcctcctttcatacatcaaggggattttacatcgtccatgcatacaataaaaaacggaccccaactccgcaggagatggtaagcttagtcttgtcgctgtccctccaagcaagctaaccggatgtaacatgttcacctatcatctatgtaacatcctggtccaattagaatttatcttgtgtgacccatgagagctgtgtgcgcatgtttagtaccaccttactggtttagcaagggtggaaccaacttataaggcttcttccctccaaccatacaactctcgggttaacccttttacacgaatcgagtatgaaagtgtaagtgggcccacacgtcagatgggctggttacgcggttctagagagagtgttgttacaacctaacaagtggagcagggtagatgaagtcttcgtcccaactgccaatgggccctctcgttagccactaaggctgataaagggtgggccacatcgggtgagcaaggagcatgcgtcgcgtcgcccaccttttctccagggcaacgtgggcaagcgaggggatgcaattatgatagggcaaggctacacacatgaccgaatcaaatctccttgatgatgtagattcatctagagagacatcaggcctcgatgccaacctcgggtccctatcctacttgcagtggtttcgtgaacggaagctagcttggccccgagctaatgttgacatcgagtcaccttctttggcacttgggtccctacattagtccttgccttgaccatcgtgtgccccgtagtgccccaagcagctgatggagtgggaagccttgtttccacttatccgacacaagcacacaaacaataatcaggagcatgacatcccaacacactcaactcaagcacacattgttaaacaataatcaggagcatgacatcccaatacactcaacttcatctatgcctttgggtttatcgggaagaggacgagacagaagaatgaatctgctatctctcgcgaggcgtgcaaaaatgtggtcatcttgtgatggcaagggcgttgcgacaagaggagaatccatctaaggtggctaatggaccttcaaaaaaacacctctagggaggttgcaccgccggaaaacatgggttatttttccccatcttgcgcgcctggcgatgtttttttttctaattatcttgtataatctaggttatagtacaaaaacatacagtataaattttgaaagttatgttgcaaaatttactatgtaattacaatattactgtacgtaatctataatgtaaaaaatgtacaatttttctttttataaaatatgacgttgtaaacataaaaaaatgtgacatcataaatatagtcccatacggcaaacaagcaaaataccatgatatgccaactttcaagataaatttcactggtgtgaagtgaatggttccaaatcaaatcatatatttgcctgcttttaaaaatgctacatatacaaactatctaaaactaaggttaatactaaaaaattattgcagtacttataaatcagacacattgaaaaatttcatggggctcggtgggacatgctacgtagaaagggttgcttgtttctggtttagaaaagataaagtttgtgtttctccatatccggataccaacaaaaagaacagggtagggtactgcacctctggttggccatcttcttgatcgttgtgcgcaactaaccccctgatcaaatcttattttttggaaggggtctgcacttccccgctaccggagaatcgccactccgacggccaactttgaagataaatttcacaggtgtcaagtgaatggttccaaatcaaatcatatctttgtctgcttttaaaaataccacgatatgccaacttcttgacactttgaccgttaatactaaaaaattattaccagtactacttctaaaatggacacatttaaaaatttcgtcaacataacatgataaaaattttaatcgaagtcgtgcattagagttctataaaaacaaatcttgcattagacacagtgaaagtccaaaaggacttgtttatgaacttgtggagtaagtacatgatttttagtcattgggccgaagatttgaagcacctgcctaattgaaaagcaagcagcaaccttatgccggatatgtacacaaagtgatcgctatttgtttggaagagaaaaaaaacaaataaataaaacaacctcgtatcatgagagaaagaactattccattttttttcccttcgttcagagcatatgtcgacatgtcgtgtcgtcccatggttgcaccctactactctaagcccagcgccaccagcgcctgagacttccagtgcttggccttctcgaagccattgatgctgaactcgaagtcgttgatggtcatgtcgatctcctcctcggtgttcatgacgaagggccccagctgcgccacgggctcgccgatgggctcgccggcgatgagcaggaaccggagcggcttgtccgacctgttccacacctcgacgccgtcgccctggccgagcagcagcaggtggtgcgccccggccttgtcgccgccgccgccgccgaacacgccctccccctccagcacgtacgcgaacgcgttccacgtcgcgcacaccggctgccgcgccgccgcgtgggggcggaccgtgaagtccaggtacatggtcggcgtccgcgtgcgcaccggcgaccgggcgcccatcgactgcccggcgatcacccgcaccgtcacgccgtccgacgtcgtgctcgcgatgtccttgctctgtatctcctggtaccccggctcgatcctgcacgcaccacacgcgtgtcaaaccaccatgccaatgcagcgacacgacatccgagagtggggaaaaaaaacgaaggagatgacaaggacgggtcgtgacgcacatcttgttgtgggaggagaggttgacccagagctggaggcccctggaggtgccgggccccgccggcatctccgagtgcacgatgccgcgtccggccgtcatccactgcacgtcgccggccttgatcgtgccacggtggccctcgaagtcctcgtgcgtcacggctccctgaaaaacacccaccattcacgtcagttccaataagaacacggtcaatgcactggcctaagtagcacgtagattctgagtttaaatttttataggagtgaatttcagattaagttgtttaggctaagttcccaatttaaatggtttcatattttctgttggatgtaaagaccggattaaaaatactcctctctttttttttaaaaaaaaaagaacacggtcaatgcaaaaccaaactatcaaggccatcgtacgtcttcctgtagaaattgtttctttctatttcattttacacggcttggcttgactgatgttgggtttaggcgaagatatatattactaatcgatctgccaatgatgagttcaaggtgtgaagcagagttttgagcgcggaaaagtatatgcgacgcgaggtggttgacgtaggaaggctaccaaccaaaggcagagcaaggcaacagggcccgtttggatgggttagattcttcaatttgacggaaagaaacgttctgaatttgctaaaaactactactccgtatcagcctatcaggtttgcgttgttgacaaatgaaacgcgtttaattcgtttctgctgatccgtgtgatgtggttgtcaaaagacgctgctgtctgtacgtatcactggggattaagcaaggaattttcatggccgctctatatgcagttggatgttctactaccgacgaacagaatgtgaactgtggtaaaagactctgcctacctcgagcatgtaagtgacggtctcgaaacctctgtgtggatggtcagggaacccagccggagcagacactgcacaggattcgatcaagaagacgatcaaaaaatgcaaatctctatcactctaaaccagatgatcaaaaccgagccagaagcaattcactcacctgagaactcgtccaggacgaggaacggatcgaagtacctcagctcaaacctcccgatgctccggcgaacgacggcgccgacgccctcgtgctgcggccgcgccaggaacttccgcaccacctgccggggcttctccatcgacgtcgtcatatatagtactaccagttaccacctttgccgtcgccggcgaacgatcgacttgatcagaaattcagaattcaagaacacctcgacgaccctttcttcttcctccgacctcccttgccggcgatgcctatggtttgtagtagggtatggtggtttggtttggggcctattttcttcctctttatatagcggcaacacacctcgattccgttacgccccgatacgccgccgccgctgctgctgctgctgcttcccggggtcaaaagcgacagatggtttcttggcgttttttcctctctccgctacggggaaatatatataaaagctcgccgcatagctcgcgctctcaacagaaaaagtgtttcctttcgaaacgctgtgccagctgctgcagctgttgcggccggcggcggtcacgctgacgccatgcgcacgcaagccgctagccctagcgcccccgtcgcgctcgggctctgcatacgtgtgccttgtgacagcgtcgcatcagcacgcgggggtggacgggtggtgacaggtgagtgaatggaagaccgaatggtgattgggtgatcagcgaactaacgcctcgctatcaaaacgccacgtttactggcttactgccgtgatggttcagctgcttttcatcttatttaccgaattattaaaacagatataactcattattgaaacaaattgtttttctgttgcattatttagactgtttgatttaagttatttatactaaattaattttataatattcaatttgtatctacaaccaagtcaatcatccgccgtaataatcctaatccgcccagtaatttaagtcaaaggagtcttttatttagtagtaactctatcgtggtgtttgagatatattaaaatgaagatgaagtcagcataagacgagaaagtcattttgatattttaaagtagaaagttttgtaagaaatatcatttagcagtttaaaaaacgtgctaaaaattgagaaaaaatgggtgaaaatggagcggattcggacggatggccttcataccatatcctaaaccatattttttaagcggattcggagcgggtgcggatagtgtacggatgcggatgcgaatgcggagcggattgtttcggatgtcggaaatggtgcggagctggtgtggaatcggttcggaaacggattaaatttatcgggtgttacatgtatatgcaatcaatacaacatcgagttagcaatacaaggaacaataatacaatagttaataaatgacccattgtaataattatgtacttaagtgctgaacaacataaatacattatgtctataatataaaaatatagctacgcaagtgtgacacgagacaatgaaagccttaggctaataaatctaggttaattgataaattaggtcattggatgaaccaacttatattatatgcaatatatagagtggttacatttgttgataattttggattatctgacaaacggcctatcggataatccgatagaaatgtcggataatccacattcgctggatttctaaaagtgcataccatatcctcgtttcggactgattcgcccctagatcataaaatctactatcttaataaaggaatagggactataaattaccacatggtaaaaattaagggcccctttgaatcaaaggaattatgaagaattttcataggattgaaatcctataagaaattttcctatgtagctctttgatttaaagaattgaagtttcccaaatcctacaaaattcctatggaatggcttattgcatataggttttagaagaaacttagcaagaggtccaacctcttggtaaaaatcctttgagtatatctctcttatccgattcatgtgtttttcatgtgatccaatcaaacaaacattgttgtgtttttcctatgttttgcaatcctctattttatacttgcatttctatcataattctatgttttttctattcctccgttttttcattcttacgattcaaatgggccaaaaaggagttttcattttgcgggcgtgaggttaattaatttttagtatttgggaggaaacggggcagagaagacaagatcatggccctgaggtatttttaccttccaagcgacggctccatgatcctcaattcagttcatggctctgacgtcgaaaggtaagatttttcacttggctgcaggctggtgataacatgacgtcaatgtgagctcactccctctccctctgacctctcacctctcttcgccttcgtggtgctttcgcctaatcaccatgtgcctatgatacgtatcatccacaaagccaagcgttgacctcgtggataccgtcctgatcaaatcattaaaaatcccattaatgagcaagttctaaacgccaagttctgtagtactaatgcgcaggccggccggtgaaatatctaactgaattgtgcagggtccattacatctttttttttataaagcttatgacctaattgagccttaaagtggggaacagaaactataattagtagccggtagaacccttcttttctggccaccaaacggccccgcccacagattaattagtcatgtctacttcctttacaacatcctggtgaacttaatctacgggcagagaaaaaagcagccatgaaaagacaccgattaggagatatctcggaggattttgattggaacgtgtacaaatatcgccacaccgtcaagaggcaagagcccacaatcttgtgctgtacacaaaatcaatattttgactgcagattgccccattttttgaactcaaaataaaaaaacagcttggaaggtgatcgcaaacatgcctcgatgtgacgccatctgccggaccatgacgaaatggagtggacaattggcaaattggcaaagaaactagctttcctggagacgaaaatgaaatgtaattcggtgggcaaagttgatcaaagtatatagtacgtgttcttatcagcttacccgataggcaaagagtcttgacgtatccatgagtcatgcctacgttctcagcttcttatgcttggatgcaagaccaaatagaagaaattaaattggtacttgcagagaaaaataatgcgaaaggagagaggagaatcgtaaccacccaacaagtcactttcattcagggagtcccacatactcctcatatcttgttttggatcaataagcaccctgcaagtagtttccttgtgttatcttgtctcctctggcaattttatcatttcacctttttttatcctatcatttgtggccattttattttccaacctgacacatgactctgtttgtactttgtgtaagtgctggtagcctggcatggctggattccagcccctacctctgttggaacagttaaccaaaagcccatgtaatagggaataatttatacgaaaacatcaagatatctataatacgaaagggttatatgtaaattttagtaccaccttactagttttagaagagagtaacaccactttaaaaaagattatctcttcttactacttgagctatgtgtgtgagagagaactagagaaacacacgagctcatttgtttgcctcgccttctgggatgcaggtgcaagtatatagaacctgcatgaatggttcatcaaaattggttttagttgcttgtatggacgtaagttccttttgcaattttatttactacattggagtagtgaaaaatctggatcagttacatgtgacttgattacatttcctgatttctctttaaataccgagtcatggtctccacataaatttacggtaaaaaaactagggtttgccttcatatgtactacaccatcacacgtcgtctgctccattatgctaacaagtgtgtactagcgatcgggagagcaggtctttggaatcatcgtattcgtgatactgcaacgggagagcgcaaataaggttttttgagagcatgggacgcaattggtcactgatggctgctcatccaccgcgatttgtctacatcatcacaagagcg

SEQ ID NO: 33053 - DNA, 8992 bp, Oryza sativa
aattcctgcagcccctatgttcatattcatgtatataagtgaacttatgagacaaaggaagtattctagttaatctatacgatgtcatcttttatttatagaacaacctatatatgcttatactatcaacggccttatcctcgagcaccatctgtatcaaggctgcatattcacaaacttcactattgatcgatcacctccacactatctgcttgggagcatgcgatcaaaaaattgtcaaaaccggaatttttagcaatgccaaacaaatttgatttccactagtttaattggtgtcgagttttttttgtcacattctatttagattggctctctacttcattttgtggataaaccttacatgtctgctctttgacaacatgtttctaatttgtttggtatccatgtgtaactataaccctacaccttattgttgctaggcgtgccaacattaattgttaggtgcaccgatgcttgctaatatctgatgctggtgtacgtaggatgagtatgaaaaccaccatggatgaatgcaggcttgcaagtgtggaaatgtaggaaaatggaggtagtggcaagacccaaggtcccaagaaagagtaattttatggttcttgagaaggtaccataaggtaccaaaaatttaatgtaaaatttagtacatcatatttcctagctactaaattacaatagaaaaaatggtaccttattatacctcctaaatacctccttaaggaatgtaaaattactctccaagaaaaccacctataggatatagttgaaccaaatatacactagagggacgtcgaatgaacaatataatctctagaggtttttagattttctcctatcatgaaaatgatgaggtgaaacatcaatatctactaatcatatgtctttcttctgccaaaacatggcgatatagtgactaattagcttacttaaaagggtaacagctagcagtgttatttttttagagacaaagacattatgtatgccacttttgccactttatgattggagttaagcttgatccgtaatactccctccttcccacgccgttgacatttttaaacatgtttgactgttcgtcttattcaaaaacatttgtgaaatgtgtaaaactatatgtatacataaaaagtatatttaacaataaatcaaatgatagaaaaagaattaataattacttaatttttttaaataagacgaacagtcaaacatttttaaaaaagtcaatggcgtcaaacattttaggatggagggagtatacacatggcggttccggacatagctatttcgagttgttggttttgagtgatgcgggattgaaagcgttggtgagggcatgagcatcactgcatcagcacgtcatgcatatgtgaggatattaggcagccaacaaagttttttttttgtcatttgtcaaaaaccccctataatcttgtggattgtggattttgaaccacaaaacgcacagcaaatcctacaattaaaagttttcaaggttttagccccaatttcccatcgaataccatttagcaattcctttttttatgccatttcctgaaagcactctggacaaatttattactccactcataaaaagaaccactacctccgttcaattagaacattggttagtttaatttgaactaactaatttttaactaataaagtatgaactaacaagcgtcaaacaaaaagaaaaggaggaaatattattttaggttaaagatttatctcaaaaaaactatgtttttagaacgggttcagtagacctctatagtacaaccttaatttccttctcgttttagacattgaaccaatagtatctactcctcctcatttttttttcatgtcccccttttatctctttaatagcatctccaacagcatctctaaattcaactctacaaatgcctatttagccagtttgctaaagagttggagagtcaaatttgtatttcactccaacagtctctcggttaccttctccaattttaatactgggttccacatgccaatctctgtcattcttcatctctcttcacgtcattccatttccccactcttttcctttccccacccacccgctggtggatgcgcaggtgatggcgtggcggctgctgctgctgctcgaggcaagggggctcacagcgatgattggcggcagcggcagcggtgatgtagatggcgccgcaccgctctaggaggcccccggcccacgcagtgtccgcgtggaacccctcagccgcgccgactacggcctccatgtcacgggcaacgtccggcgggagcttctggaggtccgcgaacaaagggtcatcctcctcgccatcaccaccgccgtcagcatgggaggaatcgattgggacttgcgattcgtcttcctcattgtgtgcgtcacgatttcgccttttgcggtggcaacggcttgtgcgtgaaccgtgacacagcgatgacaacgatgactgccgcggcggacgatggctagacgacgacagccgcggcgggtggtggcccagacattggtggcgcgctcgtggccgacgtgctctccaattcgcccccggccgatgcgctcaagttgctgccttgctggtgggtggacgacagagagaggaaggattagactaggagtggtggtgggacccacctttggccagtggaggaagctggctacatttggtcagctggaggagcaatttggcatccgaatctggatggagagtctgttggagcttgttttttctctatattggttaaattttaacttggagagccaaatagacattctattggagatgctctaataagggcatggtaatctcttttagccccttgcttaattagtctttgactaggtaatagcggagcaagatcaaatgagtataacacagataacaatattatggttgttggtcgtgtactcctgttggtagattagactgtctgtttaactaaagaaccgacaagaagattaaacatgataacagaggaagaaaaccttgataaatcgtaattcagaaactgaatcgtgaattagtagttaggatataagaggttgctcataattgttttttgtgacttgtgagcccatccatcaatcacccaggagagaaactaatttcctgcctgtgacgaaacatggaatggaaagccacgaacattgtggcttttaggataaacacgcatgacgcccaaacacctcatgtttagccgtctttgccgccttgacgccgacggccgatatctttgtgtggagccggatcggagtgacggcgagcgtcatgcatcaatgcgcacattccattcctggttacactttcatcaaatcaaatcctctccttgatcaccgccggcatgtacgtacgtgtcggccttacctcacgcctgcgatcgattctgcgatgccttaataccttctcgtgtcctttgctgctgcaagctagcctggcatactaccgcgctggaaagccgtcgggatcggccggaccacacccgatcggtttcggcgacggcgacgattcggcaccgtatatccgcgcagatcgatcgatggaatcgacgctgggaatgggcaaagcgcgagggtgaacgaaaggtaagacgtactcgagctcgagttacggttggttggttggtttggtactttggtttccgcccgcccgcccgccgcccgcacgcacccgcagcgtcacgttgcgtcgccgtcgcgcgggcagcgtctgtgcggcgcccacgcagacgcggcttcgtggacggacgcgaggtgcgcgcgagcggctactgccgcggtaaaacggtgggttgcccctgggtgccgtctcgggccgcgtgaggagaaggttgggctgcggtttgtggttttggggcctttgacgaggggagacgagctcgcgggctgcagctcgaaggagattttttgtgcgggaatgctaggggtacgccggatggaccggagaaggcaaagtcgcagactgcacgtactacgtggggatggtggggaggtgaaaccgctagaaatgtggagatcgcgggccgttaatgggctgggtcgattgtcctcaatttgtgggtgggctccttgttgcggaatgctaaagtttcaggcgaaagtgtcgttaaaatcttgggctcagggcctgttcactttgaaaccattttcaaccttatcaaattttggtaaagttaaaaaaaaagtggctacatttagtttgctgtcaaattttggtaactatataagaaatcctaccaaaattttggcaagttgccaaaagttttttatttggcatcaaaatgaacaggcccttggtttggtttttatttggttccagagttttcccttttagaaaattttatatttagttactcaattatagtgttggtctgatcgttgtctctcaactatgaaatcgttcactttttgattcattaacgctcaaaatcttctacatatcatccttgtgtctatacctggatggttttttgatgactcctgctttttgaatccacatggattagtaacgaggacatcaacatagtgataaataattaaaaaaagaaatagtaagaaaaaaattgaaggaaatactacaatctacatttcaaccctgtcccaattccttcttttccccatatcttattttaaattgctaggatgccccgtggcaccacgttacgggaaaaaccacgtttgcttaggatctacggtaaaatatgaatggttttgagtgttaagagatgacttcgtatttaagtgaaaaaaaatcaaggctatagttgaacgagtactaaatgtggacttttctctctatttttgcttttatgtattagaacaaaaactttatctttgacctttttttcggctgaaaagctactggcctgtaaaccacgatggtaaaaggctagctaaaaatattaagttgaaatgttaaatttgtagctttcgatatgaagcatttacgcattaatttatttgttgcttaaggatgtaaagcctttcgcaatactataaatatatgatgtagccctattttatctagtagcaagttagaagttaattagggactcgtacaaatatatgttttcgtttcgtccattcaacaaaaatgttgttacgagatcacattttattcttgtgaaattacctacaatcttggtctaaacacattttttaagtagattagaagctctaaaactttttaaaagaaaaacttatttagtaaaatcagacgactaaacaacatcataatataggggacccctttcacactgtatataacataaatacagctctatggcgtatgacgtaagcggataagttagacgacttattaggtagaaccttcactatggggaaccaactgttttttttaatgaacgagtttgactgtcctacacgagacgaaaactaaaaacatattcttagccatcgataaggcatcacatcgaggtatctccttacctaccgccgtgaacgatgaagggagacactacccaaatcgcactaacctgcgttcttttcacatatgaaatgatctctctcattccgggtaaaacatataaacgcgtagcacaccaccccctttctctcttaaacggcgagaagatggcaacggggtttcagttaatggacccgtcctttcaggaattcgtcacttgctcaatcgtacaaatgtggtccgtttaggttgatgccttgagacaaaatgtacttgattagcgattgatgtgaggcaagcaagcgaaaaatgctcactggaatatatcgtagagaaatctcctaacagcatctccagcagaaacactaaatataacccctaaacagattttgggtgttgagactaaaaaaactcaatccagcagagcccctatcaaggatcctaaattaggtaggcacccaaataacctttcctagcccccagtctcaggggctctactgcacagcccctatccacggttggaaaagcgcgggagccgcccgacgtggtcttggtccgccggcacctctcctacccagtgctcatccccggccggtgcggctcctccctgcctaccgtgtcatccctcaggtgcattcctctacccgacgctccttcccggccgacgcgtctgctgtacctggagtctcctctagcctgcaccctctgcctgaactcgatgaaaaacatggcccagtggccgagtcatgcgatggcgtcgaggcactggatgattcaagtgttgttgcaggctgcgaaattgagaaagtagtagcagggtagcactagcagctgcgattgtgggacttagaagaatgggtaaagtgatacatgcgatgtgctatgcagttttttttgttgctttgcttggttgttgcttcgtgagagaagtagctggtctattggtggatgagaagacgggaaaaatcaacacatgtgagaaaatgcatggaagcgccacaacagcagaagctcgtttcacccgagctatgaatacgtgctactaggatttgtatttccattttatttttttaaaagaatcgaatttgaattgtgaatttaaatatggttggattattatggttttatactaggagtagcgtagagtatagaactatagatttgtactttaaagtatatgttaaaatagaagatgaaatgaaataaagggcgagaaaagggattgctgctggagttaaaggtattttttaggtatttagaaaataggggaagcccccattaaatttttaggggctgtaaaataggagctattgctggagatgctctaagatccttcctcgaaaaaaaagtaatctcctaagatcgatttaggatcaatttaatgccgttatgttgataaactttgagatatcatttccatcatttcattttctttggattgcatctcattaaactactctctctgtttcatattataaaccgttttacctttttcttagtcaaacattttaaaatttgattaagtttgtagaaaaatataccaatatttctaatacaaaacaaacataatattaaaatatatccaatattaaatttaatgaaactactttggtatcgtggatgttgctaattttttttataaacttggtcaaacttgtaaaactttgactaagattaagaaaaaaatcaaatgacttataatataaaatagagggagtaacatggtatgagataccacaccatattagagaaagaaaacaataatatccaaaattgagagatgccactcattccatttcaaattataaacatttccgataaaattatactaaattattacttttgtcactaacaatctctcatttaattttgctcagtaccataatctcaacaatatttttattttttaaccatctatcatttaatatatggtattataatttttttaataactactcccccatatcataatataacaacctatccgattatatgttgctatgttatgggatcaatgaaatataatacttaaacaaaaaagtatgaattacctcccgaactatcgcggtcgtccgaattaccccctgaaccataaaccggatattcttcacccccaactatgcaaaccggacgaattacccccctcgactcaatccgcggtggttttggtctacgtggcatacacgtggcatcctagtcagcgtttttctaataaaaaattagtgaaacccgcctatcatactctcccacctgtctctcttccccactttcctctcaatctctctctcttcccctattcctctcaatctctctctgtctcatatgtacgacgagttggtggccggcgctagatgcggcggcggggaaggaggggggggcgaatagcgccgtcgccctcgcgcaccaccgggagcatgctccagctccacgcgcgccacgggcacgtccgccgcccgcgcccgcagctgcctccgcagtcacctccgttccgccgcctgcccctgtgcgtcgcgcccgtagtcgcctctgctcggctatcgccgcgataccgccgcccgccccagtgctccgcgcccgccgccgccgtccaccgtccgccgcctgccctcgtgctccgcgcccgcagccgccgtccgccgtccgtcgccgccccgtgcgccgcgccggccaccaactcgctggccacatctgatacagagagagattgagaggaagagggaaagattgagagattaagaggaaagtggggaagagagaggtgggagagtatgacaggcaggtcccaccatttttttattagaaaaatgctgactgggatgccacgtgtatgccacgtagaccaaaactaccgcggattgggtcgagggaggggggtaattcatctggtttgtatagttgggggtgaagaatgtccgattttgtggtttagggggtaattcggacgaccgtgatagttcgggagggtaattcgtactttttccatacttaaaacctataaatagttatatttaggaacagggagtatatggtatatgccagcacagattagattacagaaggataataataataatctctatgctgtgaggggccaacggattaaaaagcacgacgaatccagcgggcaacgagccgatgactggttcgcgcgcgcgcggcggtgagccggtgacgacacacggcgccgctggacgcgacgcgatgcggggcaaaccaacccacgcggcggtaaagcgtgcagaaaacgccccagagaaaaaaaaaaggtagaaaaaaacaaaacggcaaaagcaatcgaaggagagaatggcaaggtgagctccttggttgtttcacactcccaacctcctcgtcccccttcccctcgttttcccccaaattccgctcctaaaccctccctctcctctcactccggccgcgattctcccgccgccccggcgatggtcccgatctaagcatgtccgacgccgacggcttcggttgcgagcaccgccgacccttcaagcgccggcgcgacgggcccgatcatgccctcctcccggtgt

SEQ ID NO: 33054 - DNA, 3281 bp, Oryza sativa
ttgtggcggccgccgcgtccgcctccgcctccgcgggggggggtttctcctgcggggcccacttcttcgtgcgggccaccgactcgaggaccgtgtcgatgcacgcggcgtggggggacaccgtgggcgccgtgctcgcgcacctcgccgaccgggggtacggccgcgacctccgcctcgtctacgccgggaggcagctcgcgccggagaccgccctcgccgacctccgcctcccgccggactccacgctgcacctcctctcccgcctccgctccaccccctacccggacgcgtggcagctcgcttcctacatcgcctccaccgccgccgccgccaagtccgaccccgcccacaccagctccgccgccaacatcaacgagctcgtcaaggagttcatcctctgcgcgcaccgagccaacatgcggcagcgccatgatcgcgactcccccctcttcgatgcccaacccacgggggaccacgcggcgcagtacctcgagattttccgccaggcgggcgcccccttcgcgctggttcgcctctacgccgctaatccctcctccgcctcccaccatcacgcggagaacgccatcaaatgcttcctcaccatggatccttcggccttgccacccgacgtgctgccggtcatggcgccggtgctgcttgaattttgcgggttgctctctttttctgtgggcaagagggatgaactctatatatcatcccgttctatgcttgcaacagtgctcagcttgccttctgggcttcccccttgcatcaagtcaccttccaagctgatcgagcaggtccttccgtttgctgaagaaatagtgggagtggttatggacgaacttgcatcactggatatgactgtgtcatccaaaaaccttgaagacctctcaaatttctttaaagtgctgcgccagcaggcactccgttgggttcccaatggggggccattgcccaagaatctgtataacagtgagcgtgggcataatgacacgtgggtgtggaagttgcacgaaatgtcaatgaacttattgaacagggtggatgagtgcttgaagaggttggaaatggatctgtccttgtcatcggagaacagaggggtcaatataagtcaatctcgatgggttgcccggtcacatatgctggtcatgctgacacaactagattttatatcgatgatttatgaggatttggcacataacctacggcttgtgttgctggcacacagagatcctctcaatgccctcgtgcgctgttccaagaggaatgagcatctccactggcttgtgaagcataaagacctcctttgctttgaatcaagaaggaatttagtcttgatgatgctacctgagggaaaggatgaatacggggagcttcatgagatgttgattgatcggcaacacttattggacgagtcctttgaatacattatacaggccagacccagtgagcttcgcagtgggctatttatggagtttaagaatgaggaagcgacaggccctggagttctgagggaatggttctgcatggtgtgtcaagctcttttcagcccgcagcaagttctcttctcgccttgtcctagtgatcgacagaggttcttcttgaacggaagtaagtttcctcatccccagtattaaattatcacttaagaccctgttcttatgttatggcactatgatcatacatcttgaaagaaaaatcctgaatcgaataagctaatgatgacttgagggtggatccagtaattggcatgcatggtataatagaaaacaaaatatcttggctagtatttctttttgaacttaagttggcctagtattagtaaaggcttacctttgcttgtctacttggttcagcacctctttttgttttttcttttgataaaacttggttcaatactgcactaatgagatgctgccactttttatttgcgaatttatactacgatgctatgacaagctgttttccacttgtatgttctggcacttagtaatctggaatgcaatgtgtcattggcaccgcacattatacacacaaattttggtggactggagaaattttgtttgagcaaccattgctaatctccagttatataagtagccaaccacacaccagagcagttcctgccagggcatcgagaaccacccattctggtggtgtgaattgtcatggctgtttctctgtagactgttggtgcccagacctatgtggaagttggtactcaccatacctgtggaaaactttgctttgtagatttccttccattgcaagtctgtagtgaagtttaacgtgcatggaatgagaaatagtgaatcattagttggtcagctgcaatatatgctcattcctcattgagactttccaaacagtccaacatatcaaggctatgctaacagttttgtggatatcatccttgccaactggatcagaaagttccgatgaacaaccttcaagatgaaaagtatcaccgcagttgttggaaattgtgtcacactgttaaaggagctctgggaaatgcagtgagcctgtgacacagctgcacaaccatagacttccccaatgtgtctcttatgtgcacaagggacaaatggaataggtacatagatattaagatgagtttctattttatgctgctaacgaaaatgctaatttccaacttttggtctacaagctgataaataaaagctggcttatttgataagcctaagcttggccagagaggtaacgtgacactgttaggttgaaagtgaggcatgcttcatgcaaaaaggaggataagtccttgctggcacaatatgcaattagtatgttatcttgaaaagttctatgagaataccataatttttagcttggcagtttattctagctgtagctgtttgagccattttcacttttcttaattatatttaattgattcttatatattcattattcatgatacagctgatgtctacaagtatgttcactgaatgtctgaatctcttctaatttttttatgcttattgtatgttgcagcatctgctgtggatccactgcacctgaaatacttcatattttcaggacgaataattggattagcattgatgcatagagttcaagtagggatcacattggaccgcacattattcttgcatcttgctgggagaagtattaaattggaagatatttctgctgcagaccctgtcatgtatgcaagctgtaaaagaattttagagatggatgctgctgttgttgatggtcttgaactaacattttcccgagatgttcatgaatta

SEQ ID NO: 33055 - DNA, 1816 bp, Oryza sativa
acctgtaagatttcaaacggcgccaaaaatattaagccactttgtcctgtagtcttgttcaggttatattgtgggatcatgtggagtcttattatggtcttttttgttcacaaatgccatatcttgaaatttgaacctgtaggcatcaaatggaataaaaaatgttattactttctgaaaagtaaatgaaactaaggttaaatcttgtttgtctctttggtgttttaacattgaagctgtttcaacgtgatccttgtatttgtcactgttttgatgacaactgtttgtgttttttttttctttcactttactggtccggcgctgttgtatacctataagttgaggtcaatcgatgatatcctatgctgggttttctgtcaagtctcagttaaccatagacgtgggtttttctctaccttacagcaccaatattattttatcttctaggagctgtacaacaaccactctttccaatttcatggaacttctgttacttgatacaattgttgttgctcctttgtgtgaaatgctgagaacaatgaaacaattttcttaacttagttccgcatcaatctggggttccataacccagagcttgtgctgctgccaatattagctatggagtaccatattaaatacagtggaatgagtaggtaataaagtatagtggcaactattgcactttgtcatcgtttttacactgaggcctggtttagttcccaacttttttttcaaacttccaacttccatcacatcaaaactttcttacaaacataaacttccaacttttccgtcacatcattccaatttcaatcaaacttccaattttggtgtgaactaaacacaccctgacataaaatcaaatacgctccttaaatcttgcatgcacttttctagaatttcaatagaaacttactttgtagacttatctagcataaccatacacttatctagcataaccattgtgtgtttccgattgatttggtgtatgcttgataagaattaagaaaacttgtttattcacactgcaggctgttgagagcttgtcaattgagcaacagaggcagctgctgttcttttggacttcagttaaatatttaccctcagatggttttggtgggctggcctcaaaactgtacatatataaggtatctgagtcagctgaccgtctcccatcgtcacatacctgcttttaccggctctgcctgcctgcttatccatccttgaaagtgacgagaaaccagctgcagaagatcacacaagagcatgtgagctgtagctttggcacatggtagatgccgcccttatggtaatccaatatggtaaattctgtacatacccaagttagtgtcgatttacctgcctcaattgaagctagaaattaaaagcaataggctatcttttgtttgttttgtacatatttaaagtgttctgggccatttaatctagttaggcataatcagaagagagcaggttcctttcattctccctcttttgaaccaggcttccatttttcatatactttctggagaagtgtggtgggagcatttgcatcgtgctatgctcacaagctctggaagccagttaaggcttaaaccatgtcataaaggtaattgcaacgtgtagtagccatgtggcttggtgttcctggtggagctgaaattctgcatagagtcgagtagagttaaagtgatcatctgtttgtgaatctggacaaaatcggtcactgaaactttgaaggtatgcgactctgctaatgtgaagttaaaactcggatatgctttgctgtttagtaccagcaggcagcaaaaatttt

SEQ ID NO: 33056 - DNA, 7953 bp, Oryza sativa
  unsure (1)..(7953): unsure at all n locations
ttcctgcagccctggaatcggatgcctagttgatgtgtattcacacctttcaaatgttttgcatctgtgagagaaattccataccaaatcccgctgaaactctggcaaatttccacgggatgcttgtgcacggttgcacctacagtttctccacctttgcgagccgccgatggagagatcattgctgcactctaatcatctatcctctgattcattttgatttcactcatcttcctcccctcttcaacattttgtacaaccaatgaaatgcagttacttggcagcgctgaaacacaaatgccgaatagttttgatatgacgcaattgcctcataattctgacatgacacttgcattgatccccctgtgatttcttctgtggaacctttgagaggtgaatctgaatcatttctatcctcaatgaaattggcagagctcctgcatttccccctaaaaaaaaaacacttgcattgatcaccttagcttatcacagagcaagagctgattgcatgggattaatgtacaaacatcatgatgccatccttaaataggtactccaccgtactaaagtaaatcaactcctaactataggtatgcccaaagctagaatttaattccttttggacggaaggagtagggttcacgatcaagggcccctttgattcatgaacccggaaatgagctattcttgtgaaaacccaataaaattcccatatttcaaataaggcccatttttatatgtggagaaaatcataggattttttggatttcaatcctatataaaaaaagtaggaagtcgtttatttcccaatcattttcattgaaattcgtaggatatcctaagactttggagaaaagtttaaagaagcttcaacatgtctcttatccgattaatgcatttttcatgttgtctactcaaacaatcattcttgtatgttttgagcttatccttcctatttctctatttttttcaatcccgtgtttaaaaagagacctaaacatgaagtatttatggagctcgatttatcttaagatatcatacgcatacactgccaccattgctggtcgcttcgctttcgacatttcggtaggttcaccgacggcgagaaatgattgacacatgcacatcaacggatgagatcgggcacacaaagcacagtgataatgtactctcagaacgtgacacacccatatatacacgacgaaccgatcaaaacaacaacacacaagacggtaggttcaccgacggcgagaaatggttggcacacggccatgaacggctgagatcgcacacacatagagacagacaatgtactctcagaaacgcacccattacacgatgaaaaccaatcaaacacgaaaaaaaaaaagcacaaaagaccgacaaacaacgcctgcgacgacggaggcatgtgggggccagagaggggcaccgcgtcactgacgctgggccccaccgccctcgatgacaaactcttttatttagccccacgtcacgcgtacccacacacacctacggagtcgagtactaccactccagctcactcaactcatcactcgctacacgcacacgtacgtacaactccggcgagtcgccggcggcggcggcgcgcgcgggccatgcatgtactccacggtgtacgacgacggcgagccagccttccccggcatgcactcactcgctggccttctcggcctccggctccgcgaccggcgccgcctcctccaccttcacctcctcggcggccggcgccggcgccgcctcctcctccttcacctcctcggccacctgcgccgccggctcggcctccttggcctccgcctcggcggcggcggcgggctctggcgccacctcctccttggcaggctcggcctccggctcggccggctcgggctcggcctccttcacctcctccgccgccggctcggccgcagctggctccgcctccttggtctccgccacctcggcctcggcgggcgccgcctcctcggccacagcctcggccggcgccgccggcgtctcctccttcggcgcctccacctcggcggcggcggccgccggcgtcgcctccactggcgcctcctcggccagcacggtggtcggggtctcaacctacacatcgatccgcgcgacgagatcagcacaacacgatgatcaatcaacaagatcacataattttcacatattttcctagcctaatcaataattaaccattttcaatgatgattaacaagcagatcaacgagctaattaattacctctacggtggccattgatgtcgatgaggtgtgcttactaatacaccaagaaaaaagtatatatgtgtgtgtatagtagagtggtcagctagaggagcaagagagctaaactgatcaagtgtccagctcagtttgtgtgtgtggagctttgcactgaggtggagggctatatatagtgccctcacaagggtcagaatgggaaaaacacaccatgcccaaaggattaaaataattcaggattaagctcaacttgtaactcccatccatctcatgcaaattcgtgatcaggaatctttggtacatgtactacatgtcatgcaagaatgcaaccaaaagttggccatgagtcatggcacatggaaagtgtccaaaagggtgcaacagtgcagggagtgctgtttgtttatttatttcactatattttcactaacatttgtgtgatggatcagagggatcatatcatcacagatccatataaatggcatgcatacacacacagtcactcggtacagagttgtcacagatggatcgatcagtgtgcccaagaaaagggccaagtgagagctggccaaccagctagcctggccacagtggcagcaagttggagatatagcttttgagttgtacccaggtttatctttccgacggacggtcggatcccgactctatgaatttgacaaattttgactaaattttgctcgaaagtagcagttcagttttgaatttattaaaaaaacatttggaaattgcatcaaaatatgcttttatcctgcgttgaaaccttaaaattccacggttttcagcttgtttatgtcgaaactatgaatcctagttgtactcccctgctcctaaatataagtatttcttgctatatagttgtgcataggtagaaatgcttttgtttatggacggagagggtactaactaagctgtttgtgctcagtgcatgcagggcttttaggtgtacatctcagtgttcctgcacgttctgcctgcgccccaaatcagtctgagattcgatcgagatctttaaaaattttgatcgtgtaaaaattttgatcggggagacgattgaattgattagggtttgttttgtacgagattaattagtggtggcatgaacagagacggtattgtcgggttagcgtgaggacaatgcaattggaaccagtgaatgtgcccctgaacagtggctgatgtgatttggggaattcagcttagctcacaaggtggccacctataggttgatggatatactttttagtgggttagataagatctttaattctgtttgttctgagatatggttgttattctactcaatgccttgtttgggacatgcctgataattttacaagaatcatatattgtttcatgtggcatcaaagtcttccttttcttttcattttcaagataatggaaataacttgtgcgtgatgttttgctgaagtaaatgttattaaaacgagaccaagaatgacgcgagaagtattaaaaccgatcaactatacttatttactcagagggttcattatttcttttgagtacatttttttaaacgaatcagcgagccaccaatttcattgaatagagaaggagtaaactctacagtcttctaagtacattttgaaattccccatttgatcaacactattacaactagcatcctgtgcctggttaagtggttgcatgtgtgatgcttgagagttcatcagccacaataattacagcaaatggagacctctataaactttggagttcgtcctctttgctttagacgcctttattgaaaagctagcatagaaatatgcaaagacgattgtacaacacctcaggagtagttgtccgtagatcaactttgtcttgcaaaaataaagagaaaggcaagagggatatcatcagcaagacagcgagatcagagccgtctgcagtagcactacattgccgtgggggcacaatgccacagcattgtcaccggcaaacaagcatatctagtaatgcataatggtgatgcataatgttagctgctcaaggtgtttcatctactatgccttttttctttctctcaatcgatcggcacagctcctgccataagtgttcaagaaggaaaaatgatgtttcacaaaaaaaaaaggggaggctaaataccctttgatttcatacataccaaaatccagatcacgatttcgcttaacttatctaagatgatgcgcggttctcttgcgtaatctctgaaaaaagaaaaaaaagaagaaagagataaatctttgtacacggtgatttcaaatgttcaacaggaactcctcttccactgtactagtaaaatttttcaaattgattcgttcagaagtcctagctagtggttgcagagaatactgaagctgggggcagctttcttctccctgaaaaaaaaaagaagaagaaaaaccctgctgtctctgtgtcgttttcgttgctttaaaccgtccatttgagatgttgatcgagttgatgaatgaagtgtacaatgatgagcagctttcgggggtagagtccacaccgatcgtccaacattgcccagtaggatggcctgtttggtgccaaatcactcgaggaaaatgaaaatatcgacttggccggctgtcggtgtgggcccccacgtgccacatccagccggatcccccgtggcatcgcctctctttcggccgccttttctgctaggatgagctaatttgtgagaccctcattgattgctaggctagattgagagcgaatttccgctaaaaataatatttgtgtttgatcatgaggagactaaactgcactttgcgtgttgtgttgcgattcatgttttagtttgcaccaggtttaaatggtactttcactttgcaccaatgaccaacctaggacgatataggatataattttcatcagttcaaggtcaatcatgatttatcaaaccgtttgaaataggactaactctgtaactcatagtttaacggttaccacgataatagcacggttactgtaggatatactgtggtttgaaaaactaaaaaggttagcacacattataactgtgtgataaccgtacgattttgtaaaccctgagctcgatcaattcgaggataattggtgatagctctgccacctccaatttaattctcttgagcaaccttgatgctacgcatggattacttccgttttttttaacaaaaaaaatggttttgttgtgtgctactttagagacattagttattgattacctagagtaaaagcatcaccaaccgttattctatttcatttccaaaactgattttgagggtttttagtataaaagtcatatccaacatatttccaaaagccttgcactagttttggagttcccatctctatatatttcgttacgtggatttaagggtgagagagtgactcccaatccctcgttcgccttttctctctcctttccgcatgagggctgaaatttctgttgggagcatgtgggttactgtgaacncnnnccggcgcgtggaaggaaaataacagaaaagaaggtccacttttttaaatttttagaggaatgagttttttcactttctatttttagtttaggaaatccaaaattaaatttcgggaatagattattgctaatctgttggtgatgctaagagttaaatgaaaaggtttacaaaccatgaagtgtagatgaaagattacattcaaaccgtttgattttttgaagaacatatactactatatgacaatgccttgttttcatccttttgctgccgcgccacattggtggccatgaaattgcttgccacaaagaacagtgaggcataattggagcccatgacccggaagcagatactgacgtggcggcatagctagggtcggtggaaagggccccacttcacagtgctcctgaattgatttgctcgggtgttgcccttgtgaatgacgtgtaatgctgccaatatacgtgcgtccaggtcatcctgcctctacctccaattactatagcggccctaccagtaatttgtaatttgttcatctgcagaagcgacgaggaaaattttatggtagagttacaagcctcacagtatattcaccaacagtattttaatatcattccctatcctgtaatttttgattttttttaatcaaaaatcggttttacatgattccctaatctcattcccaatattttttattccctgtcctacaattatagtctagggacaaacttcagctccaatcggagtaatttcctaggagtctcaccttttagttattaaaaagctaattttagccaatctcctgagagataaaaaatttaatccctcaaattctgtttaggttctaaaattttatggatggaattttgggacacggttggtgatgctctaatataaaatatatatattccttaattcctatatgtaaagttagaaatgaatcacatacaaatagaaagatttatggtagattggttattgatactgccaactaaccatttatgtaaggcagcgtagtcacttcccctctatggttgtggcggtgacaccatgcctcactgctccacctccttgctgtttattgctaagtgctaacccgcccttctaatcttagaatctcatgaaaatcattgtcgacaggttatatccgtaaacggtatttgtatagtatgagaataattgaaaccaaggtatacgcgagatcaaaataaaagagataggacaagttcatgccccttaactgacaggtactccctccattaaatatgtatgacgtcgttgactttttaccaatattttaccattcgtcttatttaattttttttaaatataaaaatgtttacatcattcttaaagaacatttgataataaatcaagttataataaaataaatgataattacataattttttttaacaagacgaatgatcaaacgtatatcaaaaagtcgacaacgtcatacaataaaatatagagggagtaatagccatactcctgttggctaaagccggtgttacttttatatatcagtatcacacgaatacaatatttgggatgacctaatctagtttctatcggcctggtggcatcgagcttttgcacatactcaacggctggtgtagtcttctttctctgacataaacttggcgagattggatgtagtctagatccctcatgtcggtctctgtggcttctacattgggtttgtctagatctgtattggcttgtcttctgtcggtgtgttccctctcatcctagtgggtcttgtattaatagtgaaaatcatctttctatccaagtagaattcgtagaaatagaacatgatacaggttaaggaaaccttttctttcccgataaggactctaacactttcacaacttctattccgggaagataattttcttttctatccgctttatttccttaattaaaggatattttcttgtatactactgtatatggtatttctatttaccgcgaacctgtatataggaggtatgctttatcctcgacactaccgtattgcactactcttaactcttctcatctactagctagcataataaattcaatcaagagttgagatgtattttcctatgtttgccttttctctagacatcgggtgaagtcaacacaactatatatacgacgtacttgctcggatgcaattaagggcctgtttggcacagcttcagctc

SEQ ID NO: 33057 - DNA, 5867 bp, Oryza sativa
gagttagttgggaacgggtgaaattcacgaaaactctcagagcagcacaactaaaggaagagaaaataatagaattacaaagcatttcaaaatgttcagggcattcgccatcattggacaaattccacgaggaaacagaacaaaaacagaaacaagagcacagtgttcatcccgcacatctcaaacatcttattgggagtaaaacagatgcagtattctagggttcgaggtgacctgaggcgcgcagatcactcggcctgggcctccccggaggccagctcctgctgctggaggcgctcgagcgccttctggtgcgcccaggtctcgagggtgaggtcgggcttggcgttgagcccgacgccgaggatgacgacggtgaggaacgaggtgacgtagcagggcaactcccagtcctcccacttccgcgactcccccgccggcggcggcggccggttgaataggtagcccttgggctgctcctcgtgccccggggtcgtccaccgcccgcccccctccccgtgcccgccgccgccgcggacgcgcgccccgccgcgcagccgcgcccgcagcatcccccccgctgccgacgagatcgcccgcatcgaagcccccccggttggtgcgcgcgcccgcgtggtggtggtggtggtggagatcggagagaggtcgccgccgatttgggggagaaaggggaagagttgctcagctacgcggagacaatgcagaggtgaggagttgcaaaatgggctgggctttggtcaagtacattgggccgggctgaaaaggtcgggttaataatcattatgggccggatttggaggtttggactcttcttctcgattttgaagctcccaatgtttcgcttgggtttacgcttataagctactccctccgttccatattataagacttttttggtcttatctagattgattcattgattaatgtactccctccatcctaaaatatttgacgccgttgacttctttaaaaatgtttaaccattcgtcttattcaaaaaaaattaagtaattattaattcttttcctatcatttgatttatcgttaaatatacttttatgtatacatatagttttacacatttcataaacatttttgaataagatgaatggtcaaacatgtttaaaaaaaagtcaacggtgtcaaacatttagggaatgagagagtatatattttgtatatatgcctagatttattaacatccatattaatttggataatgctagaaagtcttacattgtgaaacggaggaagtaaattttaatttttagaactttattttagagttgattttgtggttttttttcatcgtagtttattttacaacattttcttatgaagaacacgtacataaaatttactaacaaattatttttaaattgctataataagcagttcgcataagcataagtataagcgaaaaaatgagatcttttttgtatgcaaggttggaattagtagttatctcctaattccagaaaatttgaactgtttggaacgaaggatttttgaaaattttgacatcctgacagcagctatggagaaattttttattttcttgggaaaatttgcagttcagcgggaccaagatctggaactaaaatgacgaaactccatggaacttgatgtgtttttttttcaaaaaaaacttgatgtgtttgcgcttaccatggagaatgcacagcgcagctgactcactgaactcaacatcgctttatggagtaagcaaggtaacaggcaaacaagaagttggaacagaaatatgaacagacaagaacattaaaattcgaaatccagatcagaatgacagcataggtttattatagacaattgagattgaatttgattgtatctgattcagtcagttcagtactcagaaatcaattcagcagccattctcgcccattcgctgaagcttacagggagttgggacttgaggatttttattgactggtaagaaccttatgccattcaagcgatgattatcaacatggtaagaccattgcctttcatgtgatctttatttacacgtttcagaaaagaatcaccactcagattgtgatacagatacttgtacaaatgtgatgttcagtaggcttgctcttccattacctactgacagccagcgattgccagtcatggaatgacagcttgtcgactgtcgatggctggaagaggagaggatcaacatcccagcctttgaggcttcctcttgaccatctcatcctcacattgtcgatctcaaggccagagatgtgctccagcatcataccaccggttcggtgcttcaccatcttttggcatccaggcctgtaatcatacagccctcccgagtagtttgtccatctcttgtaggttaggtcgacattcttgaacttcaggttgcgaagcagcccgtgcttcgatccagccaagaatactccgttttctgataccgatgagatgttgatgaactgaatgtctgaaatggtgccttctttggaatctgggtgccttggacatgtggtgatgtagatcggttcagctctcccccaccataaaggatggtagtacctggtgctcattttgatgtttgagaacaccacatcgctcacatttcctgcaggaatgaaaactccagtttagaagaggcttaaagcaaatctcatttctagaccaaagaccttaatggtgcagtttttacttgatgaaaattcacaatagaaatatttcagcatacaggataggttcgctgctgtataaaaatttcatggtgctaaagcaatttataaattctatataaacacggggtacaaatgcagcataaggttcagttttcctaaaaaaatgtccgtgaaaacaatctaatatattttaattgctgcggaaatcttatagcttgctagagaaaatagtaagtactacctaatatcacagaatggcaatacacacaacagcaagtacaggtcagtacctccatctctaatctgcatcccaagtcctctatgtgaatcaactattgtaatgttgtcaaataccagcttcttgaagtcaaagaagctagcgctgccaaacttgatagcgcaagatttagtccgtatccagcagtttgttgccgtcaagttgtaaacaggacctgtggttgatttggggcatatcgcatcgtctccggtgtctatgtggcaatgagtgatggccgtgttgtttgaatcctcaatgtcgatgccgtcgttgttgggagtgtcaaaatccccatatatcgacacattgtggatcattgtattgtcacacctgacaatatgcagactgcagggaatgcaagtgcatatagcctgttaactttccctgaatacctcatcactacacaaatgctgtgtaatttttgctaatcagatgatatctagggcagtggagtacaaattagccggatttatcatctttaggatgaaatgacaagggaaatgttgtcatgttttggctgttctactacgaattgagcaatggatttgaggtatcaagaaatgctcaccaccagtaggcaggctggttgagggtgatgtcgtggatcgtgacgtccttggagtcgatgaatccgacgagccgcgggcggcactcgtcgccctcgcagtcgccggtggcgttccagctcaccatgatgttcttctgcgggttgggggtgaccacgaatgccccgccctggccgttgatctcgccgccgccggtgaccccggcgccggtggtgttctcggcgaggacgacgtaccagcggcgggactcgggagggtagtccgcctgcctggtcccgcccagcagccgcgccccgggggcgacgtcgagcaccacccgcgagcggaggtggacggtcgccgtcaggtagtcccccggcgccgggaggaggacgcgcccgccccccgccgccgcgcacgcgtcgacggccgcctggatggcccccgtgtcgtaccgcgcgccgtcgcccgccgcgccgtagtccgcgacggagaagacgcgcgcggccgccgcgaacggcagcagaagggacgagacggcgagcggaagcagcagcagcagcggggacgccattgtgacgttgactcgctcgccaagaagcactctctcttctcttctactcgagctgcacaggattcgcttgggaattttgtcagttggatcggggtttcatcgtgtcgccgccgtggcgcggacgatcggagcgagaggcagggagttcgttgcgaggggaatggatgatgagatggataagctggagtggtagctgcagctttcgtgctggactctcactcgaggatgatggataatgggattcatggatcaatcatactacctgatctcaaaatgtagatcacaggtgttcttggttgcctgtacaagtttgagagttgtggcacgaggttgcacggaaccagatcctctgaagttgggaaaactactcccttcattctaaaaaaagacaacatattacaacgaatctggatacagaggttgtcttttttaaaaaaaacagagagagtacgtcagtagcccatcgatcgaccgtttctcaaatatggaacgctcccaagaaaaatccaatgttgtccttgctcgcacgctagcgaacatgatagtgactgcgagcgatggcatcattggcttttttttttggagcattccatactcggaggacaatgaattgatacaccactgccctctaacatagtttttctaacatcagagaatgcggtgccaaggttgcacaggttggatgggtcgtggatagggctggaaaaaaggatgatggcactttagctcgcacagctcggcttgtttgggtttgttaacaagtcaaaactaaagtttaacctactcgtaaatctcaacttaactcatcccccatccactcattgtcacaccactccacttggtcataggcctaaatatttagactgactttagatgattatatgaaagtatgaaattaatggtgcatttgctaaatttgtgatgatttaatacttatattgtatgcaaacatttgtaactttgaaatgatgttggttcgaactgagcgaggcttttggctcgtaggataacgagccgagctgaactggcttgatatggagccctagttgtgggtgaaatgaccagtcatccgtgctttgaatggtatgagtttctgtagtagcaactcaccgagacagaaaacacaattggtgatattataaacttgaaaaattgatttatttttaaaaaatgtcgatatagatggttttgaaaaaaaaataccatttagcaatatgggaaaacatgcttataataaaagagtgaatagcttccctgtagcacaatcctcataaattggagattctgccctcctcatcaacaatcctctctttctttctcccctttttctttccccaacttgcgggatcggtggttggtaatcttgagatgcttgcagatgtcgaggtgctttcggagcagacgctcgatgccggtaaggaggtagatgacgttaaggtacattcaagaggccatctcgatggagcaggcgagcatgttgcagtataaaaatttatcgtcggcgcccttatcgatcccttattgtcgccatcgcatcctcgtaagagccctacccggagagacgacggagccctggaagcggcaaggttggaggacctcatcccctccccatcgataccctaagcatcaccatcggtgttgagggagatggggtgtggagctctgggtggacaacaagcggtggccggtgaggccaaaacagcaagggtggcagagcttggggaatcctacatcgactctgacttcccaccttgccgccccgccactgccgttatggagaagaggga

SEQ ID NO: 33058 - DNA, 3929 bp, Oryza sativa
ccaccactatcccttcctcttcggctcacgctcccgtccccaataacctccgctttcgtcagctccattcttgcaggcgtctctcctcggctccgctcgcttcggacagtccgaaggctaaggtgcggattttacttcattatcctctgcaatttgtgactaatttgagttactactatcttccaatttatctgctctcccgggtgaggggaatggtttgggtgcattggcacttgctgaattcaattgtgcatataatgcattattttccaccagcttagggttgtagtcttgtgaattcgggcatgggaatggcctggtagcacgaaatctcggcttcgcggccaagacaggaacttaaataatcttaatgagaatagttttctagtgattcgctgctgcccatgccctcgaatgctcgggatttgggagggcaatttctccctgtagcacatcctgagaagttcacgaggataatatggattctctacgcaagtgtgacaaagaaaaggaggacaaattgcttttgttctagcaagtgtgcgcttatgatttagcatgcccatccttcccattgttttgtcgaatctcagcagaaagtggtcgattgctagaggttggagacattcagtcttttatgctcactaataactatctgccacacatttatttcctggatatgtcaacgatgaaactattttttgtgctgaaaaataatttaatcctcttcaattgatactaatgttgacatcaatcatatctatcataggtccgttgtgtcatggtggatcttctacttcattgtggtggtggcttgctttatttgattttcgtaagaattatctcatgttccactaattcttaattttggtcatcgaaacatgtttttcagcttatacttggtggcgcggtgctgcctgaagcagatggctatctacacacctactgtctgtttacaacgctgtacttatagcttgtattctcagtcttgtcagttacaaggagggctgacacagggcatggcattatggaagtattctcgttcacaagcagtcggttatcatgtaaagatcagattagttggtttgcctcctaagatgaacataaaatcactgcgaacatgttttgccagttcggggaaacagttgtgtggcagacaacctgcgagggataatattctaaagctaaagcttgatgagccctcacgtcagaagttgtatagtattctctgggattcaagaagcataggacacaaagttggagctacaggcactggacttttcctaagttttgcagttcctgcgaaggcaaatgctgagggtcctgtggacaataatactgatagcccccaaactactgaatcgtccactagttatgctcatgggaaaaaagtttgcacggattattctgttactggtgagacagtgtgcgtgtttttctaattactatacaatatgcatttggttaaagcatgcatcgtctgctcacttgtgtttgattcacatggtaaccctcaagcattcctggagatggaaagtgcttgttccgatctgtggctcatggtgcatgtattaagtcaagtaagcgacctgatgatgatctccagagaaagatggctgatgacttaagagcaatggtatgcttgtaatgttctgctgatgtactactgttgatccattctgttcttagatactaaatgttgctctggaagcaacgcaaccatttctggtgaatttatcatgtaaaagatctatttaaatggtgtcactgttaggtcgccgatgaatttatcaagagacgggcagagactgaatggttagttctacctgtcctcattattctgttagttactctgcatctaaatattgttgagttacgcattcttatgcttcgctatgacattaattcacaggtttgttgagggggacttcgatgcatatgtctctcggattaggaagccacatgtgtggggaggtgaaccagaactgttaatggcttcgcatgttcttcggtgagaattagccatgatgtttggagttattttactctcaccatttcaaatgcagtatacatttgtgcagtaacctgttagaatacttatgccctcttggtcatatttatatagggttgatggttagttggtttgcttttaatccattttaggattcctgggataagtttgtccacttatactgtcttgtttgtttgtttttttttgtcatgttatgactgttaagcatcttccttttttttttgcggggatcttcctttttttttttcaaaacacaactcccaaaagtcattaatattccattttgttaggctttgaccaaagtttattaatgtagctcaacagcaatagtggatagtttcatatatgtgtagtcttgttgtattgtccttctgaaaacgggaagtaacaaaagctctaatatgccgttaccaatgtggccaggatgccaattactgtgtacatgcatgataaggaagctggtggtttaatagcaattgcagaatatggtcaggagtacgggaaagaagatccaattcaagttctttttcatggttttggccattatgacgctctacagataccaggaaagggtggtccaaggtcaaggctgtaacatttggagctcagattccaaacagtaagttttgaaccaacctttgtttccctttcttttcccagtacgcttgctgtccaaatgtaaccagaatctaccctcaacaaatttaaaatgctgcgatgttccaagttccaaccgctgaatccatctcttcttctattttggttgcactagcctcccttgtagtacatgtcaaaaagaaacttgcatgtatgcaccctggctggctgcaagcagcttgagtttgcttaccctgcaaacctctctgccgcgtgagccggccggtggccacaaggcgacgccgtctttggtcaaggctgtgaggtatccggccaccggcctacccacctgagccgcggtcgtcgtcgtcgtggtggtggtggtggttggcttgcactggtgctagaatgctagatcctatagcctcatgctgttgtgtcaaccgggagggaagcttagcgctggctggcgatctcaatcttgcgccatgcttgcctgcccgggccggtgtttccccgtacggctccggcttcacttccctcacatctatgcagtacgggggccctgcagttacgtgggcagctaccacctcttgtgcattgaaaggccaataaaaactggacttggcatctgctactcaggtctgggctggttgtctaactctcatgtgtttatgtgggcattcagttcagatcagagatcagattggagtcctccctgtcccccaaagaagtagagggctttcacctaactaaatttgtgcaagagccatgcactagcgtccaagtaattaagagagaaaaaatggttatttgagtgtaaaaaaaaagattatactcccactgttccataatgtaaaatgttttggtttgtccaaagtcaaacttcaagtatgacaaagtttatagaaaaaaaatagcaacatttccaacacgaaacatatgtcttttaaaaatatatattaaaatgttgatttaataaaactaatttagtactgaaaatgttgttatgttttattataaagttaattaaaattagataagtttgacttagaacaaaactagaacatccattatggagcgaagggagtattatctaaggtgggtgttagaatctgataccgggttgtgaaaatattattatttggacagcaaaatattgagaccaccacactaactaattgaattccttttgcaaaataaatatccatgcaacctttacacataattccgttatctttgtcttttcatcctttcatgctcctgtagtgatacgccctgaccaaaggtgccaataatg

SEQ ID NO: 33059 - DNA, 705 bp, Oryza sativa
ctgcagcccttgtaccaggctggatctgttatcctcttttgtggacagagtaaattcggacaagaagctactagcactgtcgattttgttgtgaatcaatctgatttcaccattcagacgctaaggaatgttaccgattacttatcgcttgcaaagacaatcagtgtggcagcactctatcttccttcagatgtacaagggcaaattgacaatttgaaagtggacttaaataaagcggctgatactatatcccaaaagacatcagaaaactacagaaggataagaaaagttctccataacttgtacgtttcaaactattcttgccatgtttacctctggtttcttgactttgaaagtcactgactgaataatagttcatgtgactatatagtatatttatctgtgggcctatatcttttcttcaaaatgacggcactgtgttgctaagaagcgtaatcaaaattcaaaatggttattatggcattgcattcatttatgctagcacattattagtaatgctatgccttcaactgaaaatttgaattcctgttttactacaggtcagttgctttgatttgcatagctgcgttgatgcctgttcttgcattcttgggatatggtaagaatttcattctgttagtcaaactgatgccctttttgttggttttgttatctcagatgtgttaacactcactacttgaacaa

SEQ ID NO: 33060 - DNA, 736 bp, Oryza sativa
gcctctggcttaacacttggcctcctcttgatgctttttgcggaccgcccccaaagggaggaggtgtccgagctgccatcagggtcaaggatcaccccagtagactgctctccatgacgagctcagtctctatggtcattcagactagtatagcaattgcctgtaatagttaggaaaagaagaaggtgaagcactggggcaaagccccattttgcagtggagatgatctaggtggatgagtgcttccttccgtggtatacatggtatgtttcagggaatagttgtaaaggctaatgcctaatggcaaacaaaatttgggcaaaaccccactatgatatgaagagcaatgttctgtatcccctatgattgttcagctggacatgtttctttcttatgtacatgtcttgttctgtgtgtttccatattctgttggtgggggggacattccttgtacactagatcagcctgatgtctatgctggaggttggaacagattttgcaaccatgtcaattgatgcagttgagcaagcgggaggttttcagaaaaaaaaatgcacaattttcagctctggtcgtaagggttgtacttgcacagcagtaaacttacagcaattctaatgtcctttttttaaaaaataataataataatggttacatcttcggcctctgttagcaggcgcacaaccaaattcggatgtccttttgtcgtaatattactagtatttgcttcattgct

SEQ ID NO: 33061 - DNA, 711 bp, Oryza sativa
attcctgcagcccccaaaaaaaaactattcatatactggtaaggcatacgggtatcagtagtacatctcttgaacatgagcttcattgttgtcttgactctgaatatttgacggcgggataactacgtgcatggatttgttttagggtgtttttttaatagccgaataattcgtgataattattcgagggtaaaaaataattgattaaacataattgaaactaatttcgtaagaaattcatatatactaacaaagttttctgtgaaaatattactatttagaagttcgggaagcgtgccgttaaatagaatggtttcattccttataaaagaacatcaccttagtgggattgaatcggatgtaatttactctgaaaagtttcatgggcattattttgttgtttgtgtgaatttcacacaaactctaccactccatggtgacatcgacaacaaataacaatagatctatttttgcggggttgtcggtgaggtcaagggggcgtcgggggtgatctcgccgcgcctcttcgacgccgtcctccgcccactgcggcgtcgcctccgtgcgcacgctccccgtcgctgccggcgccggggccgctcccctcctccctcgtgctcctcgccaaggtctccatcgcctacttctcgtgagccacgggtgccgctgtccttgcccgctgctcctgccgcctccttgccggtgagcgta

SEQ ID NO: 33062 - DNA, 8264 bp, Oryza sativa
tcctgcagccctgtgctgctccagctgcaaaggcaacacaacaccggcaagggaagcgtgcgataccatgaggagccggctaggtatcatgcctcttcacgttgacaacagggacgcaggacgctatatttttattttgtcgtgtgttttaattatcccgtgacatcacttttccacggtatcccgtggctagctgccctcaaaatgaaaggcacaatgagacaaagacaaataaaaaaaaggttcacgattataccataattaaacagagaccacaaatatagatcagagggaccgcataaaacaaagaggagacctactgaatttattctagcgcatgatagtgtttttaagcaaggaattcagttgatattttttgtttagtaagataaagaaataaatattccgaccactagatctacattctacggtgtattatgaccattttagtagcaataacactgccaggtggttagtggttaacctgggctttctgccgatttttttttcaagtagtcctgattttcacattttgtttgtactgtttgaccactcgtcttattcaaaaaacttgtgcaaatatataaaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagcccagtgagcagcgattgctgcgacggtgagctggagtggtcacgttgccgccggcggccagccggccggccaccgtgtgtcctgtttggttctcgccgttgcacggctatcacaccggcggcgcatgacaagtgagaaccgcgtgtagttttgtttaatcaccggctaaagagagccgcctaatccgattctgtgacgctggtggtgacctactaggctaccaccaccgacagcctctgcctggaatgaccagggtcggggattcccagagaccactgaccagtacgttcacctcatgatccaagtgaataatttcgaattcttcgtttcctactccctccgtccattttaatagcaattataagttttttattcaactgtaattattcatcttattttaaaaaaattataattagtatttttttattagatgataaaacataaacaatactttactttacatatgacttatacttttaaattttttaaaataatttttaaataagttgaacgattaaagttggacacgaaaactatatctatatttaaaatgggatggagggaatatcttttccattatcactgctttttattaacggtcattatcactgctttaattgttgccttgcaagggaatgttttgctttcttatttatcgttagcacgttttctaatctcataaacaatactccctccgtttcatattataagacttgttagcattgactacatttatataaatgttaatgaatctactatgggtacgctggtacaaggatctacgtaatacgacatcaagtaggcagaaaacaaatattataccggttcaggccccttgataggtaatagccctaatccaattgatatgagattatatgatggaaaccacagattacaagggggatagtggaactcgacgataccgacgagatcgtagtcgagttgattcgactagatcacccggcgacttggctcctgtaggctccggcttcgtaggctgtggtggttgccttgattatgagattcgatgccttaggtcctcccggggggtcccttttatatcgcaggtcaactggtctccaagtaggactcggagacatcggacccagcacgatacaatgacgacccagttctgtccgagtaggactccttccatttgtgaactccatgatgaatttccttaacgtatgccaaaaatgtccgtatacgcatatgtataccatatcgatatgtgacgtatatcgaaaggtagagggtataccttacccgtaaccctgacagtagcccccgacttctgcttaaatgaactcgtgtaaccgatcgtgacttctgatgtcgaggttgttgttgttctcggtgtgaggaccgagggataaggagtgatcgacaacgccctgtgaagctcaatggtcatgagtgaatttaaattgaagtccaaaaaactactgcgcgtaatggacccagaaatttccggcggtaatctctctcctttccttggaattcgcaccatcggaagtgcgactatttaagggagttttgcggatccaatttgaagtccgccggttgtgaaaaaactctccagcctccaagcgtccctcgtcttctccgcttccgcaaaaaccctagctagctcgtctcggtcctttctccggcgaaccccggcggcaatggacctcgacaagtctacctccaccagtgcgtcgctgaagaagctataggaggatggcgctcttcccggtcgcgggaccatggagagagaagcaggaggtactgaaccccagcctgtcctgggtcgcatggttgcgatcgaggactatattctttatggttttcttcctccgccttctgaatttcttctcttggtcttgaatttctacagccttttcttgctccatttgaaccccaattccatcgccttcctcagtatcttttcgcatctttgtgaggcctacattggggtagagccgtttcttgacctcttccgtttttactatgagttgcgctggatggaaccaaaaaaggtgtccggatgtgtcggtttccgacttcgggatggcctgaagtcgcgatacatccccttccagtgcccttcatctcgcagcaaatggcgggggaggtggttctatcttcagatagaagattcggatccggtcttcattgtttctaaggagcaaccagccaagatttcatcttggactgccaaacccgccttgaccccatccctcaaatctttcgtcgatatcattgatgacctccgagaacgggggttgtcggggtatgaagtcactaccgacttcattggtaggcggatccagctgctctaggcttgagcccacccagcctttgactattctaggccggaggacgcgacccgggtttctcctcggggtattttttttgtagttgaattgactcccttatgtgcgtgttcctcctgacttatcgaattctggtctcgatctataggcttgaacagcgcaaccgtgaagcgtcgcgtcggccaattgatgatcagcggcccgacaacgacgagcaacgtccccgtccccctttgcgagaagggggcagtcgaacgcgaagctgccatcaatgtaagtgtactcagcggcccttttgcattttacttccgggatcacattgtgacttcatgaagcgtaggctctccctctgactgatatcatcgggccgctcgtggatcatcaggcggcggcgtcgctgaaggaggacgtcgccaaggaggcgtccgatgttgctgccgctgctgccacaacgagtggtggcaacgtcactgatggccttgtcaggacgtccagaaaggtgtcaggttcgagtggctctcgtctggacgcacgccgtgctagatcatccggttcgatgttgtccttgcggtacacgtgtcgaacctcgatcccatcgaaccttttttccagtttcctgacttctgcgagatacgtagataactcggggctagagcacttgtaatctttatgcacctggttcgtgactagttcggaatcccctttcacgactagtcgcttgactccgagtgcagctgcagctcttatcccggtgagtagtccttcgtattcggctgtgttattggtcgccctgaagttgaggtgaattgcatgcttgaattgatctcccgaaggtgacgtcaagatgaatcatgtccctgctccttggctgttgagtgcgccgtcgaacaccattgtccacgtttcgttgttgatttggttgtctgacctattatcaggcatagtccaatcggctacgaagtcggcgagtacctgggacttgatggttgttcgtggcacaaagtggacatcaaactggcttagctcgactacccattttgcaatgcggccgacaacgtctttgtttctcacgacttcaccgagagggaaggaggatacaactgtgaccttgtgggcttggaagtagtggcgtagctttcttgatgtcatgattaccgcgtagagcagttttcggatctgtgtatatcttgtctttgcgtcgtggagagcttcgctgacgtagtagactggtcgttgcaccttctctctctcgacaacaatgacagtgctaacggaatatggcgtggcggcgatatagagaaataattcttcattaggttggggggcaacaagtacaggtggatttgataggtagcgcttgagtgcaatgaatgcctcttcggcttcctgtgtccatacaaatttgtcttgcttcttcagcagagcgaagaaaggttgtcctcactctctcacctagcgatgaacttgcttagtgccgccatgcatccggttagcttctgtacttcctttagtcttgtaggcgacttcatgttttcgattgccttgatcttttcgggatttgcttctattcctctgccagagacgaggaaaccgagcagcttgcccaatggtactccgaacgtgcacttctctggattgagcatgaggcgatatcgtcggaggttgccgaaaacatctgtatacgcgtatgtataccatatcgatatgtgacgtatatcgaagggtagagggtataccttacccgtaaccctgacaatatgaaacgaaggaagtacatattttagaatatatatatatatatatatatatatatatatatatatatatatatgaaggttttttggaaaataaataaatatatttttcaagtgtataacatttattactcaattaatcatatcctaattacttccatccgaaaggctaaagcaatttgcagcctaagtcaaagctaaaatttaaaattttaaacttaattttaaattattataggtgctttttaattttaatttctgaacttaatttgaaatcactaattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagctattcatttgatgtcctatcacttgttcaatgttatgaagtttatgacatggggcttcttagcgttttactctgggtgcagtgtaagttatttatcttctctgaacttgtactgcacttgtagtacattttcttgatctcttcagttacagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctcagggtgaggctaacagcaatgaagataccagagccaaaagagtctcaagggttccaaagaagctagtgaagaaagattcaaaggaaaacagcccacgctcaggcagaattaattccaatcgccaagtgcagactaagctgcaatatatatcgtcaaacaatttgcagagcaaatctccaaagccaaacaaaacatctgatggtgctaaaaccattgagataacaaagccagatacagtgacagttccttcttgtccttcatctgaggtgtctgaggagatggatgataaacccattgagaatatagtgacggatgataaatccattgaggatgtagctgatgataaggccactgagggcacggcctcttatgataaggccactgaaggaaaagctgctgatgatacgaccgttgaggacaacaccactgatgaaaggagcattgagagtggcactgatgataggaccattgcgggtatagcagctgatgttaaatctagtgaagaggcaaaggagattgatatattggatgaagccccaaattgtgatcagagtactgctactgacgaggaaatagctgatactgaagaaagcatagcttatgat

SEQ ID NO: 33063 - DNA, 8072 bp, Oryza sativa
attcctgcagccctgaagaaagcatagcttatgatggtaaatcagctgcatatgaaaagagtgaggaattagaatctaaatgtgaaaggttggagcaggaacttcgagaagttgctgcccttgagatttctctttattcagtagtgccagagcacggttgttcatcgcataaattgcacacaccagctcggcgtctgtccaggctatatgttcatgcatcaaagttttggtcctctgataagaaagcttctgtcacaaagaacttcgtttctgggcttgtccttgttgcaaagtcttgtggaaatgatgtttcaaggtaaagtatctgtaattggatatagtatgtaactctgtgtagcttatatttccgcataccatcatttttaaaataaatctttatgtaggttgacattctggctatcaaacaccgttgtcctaagagagatcattgcacaaacatttggcattacacgccaaccaagtcttgctatgaaggctttcagcacaaatgttaatgcaaagatgctcggtaagaactcttcaccaacgcggcggaaaaacaactacagtggcaagcatgctagacctgctatctggccattacctgatgattggcgggaaactggtacactcgtggctgcactggagaagattgaatcatggatcttttctcggattgttgagtcagtgtggtggcaggtaaaacctttcttatgctttctcggcactttttaggaaattgagtacattttattctctgtaaaactaggatagcagacagctttttcgattcattttgttgtcaattttctgaaggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatgttaatggaccaaatgcttcttcagatcggaaattggtcccgatggttgcaagataagtttggcatggttgctgctgcccctgagaagcatggtcaagcaggagatgagagtgatgacagaagtggtgctgctgatttttattctttcaagctgctcaacgagttaagtgatcttctgatgctcccaaaggacatgcttcttgaaaagtccatcaggaaggaggtcagtattcatgcttagtcactccaactcttaagttggaacatatattcaggttcagtgctgcagttaaaattttgtcattctgtttaggtctgcccttctattggcattccactggtaacaaggatactctgcaacttcactcctgacgagttctgtcctgaacctgttcctggaatggttttagaggagctgaatgccgaggtacgacgtctatttgctaaatgatattattgcattgtagcattacaaagtccaaatacaatcttgctcaccatatgtaatgactaaccaagatacttctatagtttcactctacaccttctcaatcagtgttggttgctaaattttcacacagagcttgctggagcgcttcacggagaaagatgtgatcaccacattcccctgcgtcgcggctcctgttgtctactgccccccttcaccggaggatgtcgcggagaaagtagcagacgcaggcgggaacgcggagccggacctgagggcctccatggtgcagaggagagggtacaccagcgacgacgacctggacgacctgggcaaccccctggcgtccctgtacgacaggagctctccaccctcaccctgcaacggggcctctcgttcgactacacggcaaggtggctctatgtcgaacgcgagatacgagctcctgagagaagtatatggtcggagaggcctggtttgagtaaccagtgaaagtgtggaacggaagacgaaaagagagcctcttggtcttgggttgcagatttgctgtgaggtgaacaaggggttggaaattggtcgggaaggaactgctttgcaacagacgctgaatgaacgaacagcacttggatatcctcatggcaaaatgctagagtgtttagaacccatccccccattcttctcatgtatatttgcattttgattctgttgaagtgattggttcactcttggcaaaaggggataaatttatttgttggtggtagtgaggagaaattttagtgagtggtcagagtgagcgtgacttctgcgtcagccatcgttcgatgggccgcctaactgatcacaaataggaataagttcaactggcgtccctcaactttacagtttacatcgatttttttttgacatcccttatcctctgccttgtttcactgatgtggcatcatagtcagcaaaaataaaataaaataaaatatagagcccacataccgcatctctttctttcctttttctcttctcttctctcgagcgggcgtggcgtcagatggggggagaggccgtcagcggcggccggcaaagcgagcgcgacggcgggcagagctggcgcagcgggcgggctctgttgccgatgttgtgctcgtcttgcatggagatcccctcgcgacttcgtggcggcgggtgagcgcggcgggcgacccatggatcgagctagtactacgtgctatggcccctacctctgaattatgctgctgctagagcttaggtgggtatcgaagaactggacactgcagatagctttttattgataatattaacttgtggcaaatgacgatcaagcgtatagcaatgagtgagagcgaagagttggtaagctaatgctactgctcttgatttggagcacacactatacggttgcgttgtattaaaccgcaacccaccccccaccccaccccccggggccagccacacccctacccctacccccacaccacaccacaccacactagcacatccctgtccccctcaattcccgtaatggtgttactaacggtactatcaatttctactgagtaattgttttactggtagtagtgtttgaatcgtcgtatacatacatgtgttggtcccacaccgtaactaaccactaatcaatttcccccccttttttttttggatctacagaggcaggaagccggctcggcagctgtggcatcaggaagcggaggcggcggcgacggcgatggcgtgctacagggaggaggcggcgtgctggatctaatgggttaggcggcaagaacgggcatgtccatgtctggcgaggaggcgaggacggtttcgctctcgtttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtggtctagggtgctgcgatgtcgtcttgccgtggtctccattcggtttgttctccatactattttaattggacatagtttttttgagtaattggacatagtttttttgagtgctcagactgttgtgggatctattcaataagctgtaatgacttgttgtctttccaattgctgaaatcttggaggttttttttcggttaatttggctgaataacaatgttatgcgatgctgtttgtgctttgattcttcaggtactaattagagatattggagccattgtttaattactttacgagcagttcaggtactttactagcaattcaagtgacaaatttggttcactaatctagttctagcagtacaaacaatttcagcttttcctagttttagagttttgattctggcatgaattgtatggggaatatgattaattcctgcacactttaggatgaaggtctggtctcatttcacttgagcagttcttgcacttcttttctttcaattgcgggaatgttcagatcattttttgcttaaagtacctgattcgttcttagtttgtgtgtttgttggcctaaatctttcttccaattgcacagctctggaactcttgctgaacagaatagcatgaatgattctagtgtagggaagttcttatttttattttttgttggatcatggaattcagcactaattatagactaacagtgttcttgagttttcaggcatatctctgataggctagtgttatatggttattatggggctcatgagttttgaattttggtcacgattttcaggactgcaaaatatgcagtgagatgtgtaaactctgagatatgtcatatttttacagcatgtgtacagtattcgtcgtagttttctgaattagtactgcatgtcctgtgagatgtgtaaactctgagatatgtgatatttttacagcatgtgtacagtattcgtcgtatttttctgaaattagtactgcatgtcctgattctgaattttcggatagatgaaaactcaaaaagctcgatcgaatagcagttttctaaatttttgttgttcaaaggagcacatcaattgaattctttttttctgaacttctgactagatatgttcgctgttgaacatacccttttttctctgtatatttttgacagaacagacatcttcagactaagactaaggtctaaattttactgaaatgattaacttctaatttttgcaggcatcagcatctacagtgtgcactcttgcaggtggatgcacatcttgatggtatggtggttggtatttgctctgctgaagatgtacatgttctaatttttttggttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggattgtgctttttttttgggtaccgggtgtatatgtgtttgtaacgatgatggcacgatcaattgtaaaaacaaagtccattatacccgtattcgtgcagtaaaatatttactaccttatatatcaggcccaatcaactactaagtaacttttttactccctccatgattggataatcccaatacatatcaataattttttttattccatgaatatgttgcttcttatctattagtaaatcatttactcatgggcgagtctctattagtaacgcatgtactcattgccaatatgagatgtggctagcaaacgatattcttatctgttagtaactcattgtgggccaagtctctgttagtaatgcatttactcatgggccaataagggaagtgccaaacaaatgttactcttatctgttagtaactcatttactaatgggctttgtctctgatagtaactcatttactcgagaatagtaactcgattacttatcaaaaacatactaatagtaaatgaattactaaagtcacacatattattgttggtggctgggctagcaaaaggtgcgggattgatacatcattcaatttttacgtatagtaaatatgttacttatcgtatattgcgccacaaacaatcatttagtaattaatttactatacgttatttctaaaaggtgcagggtgagggatgtggggtgggtgcagctgggggggtaggagggagggtgggggttgggggttgtgaggggagtagtttagttataacgcaccctaggtgccgtttagcacatccctatatatatatagacatcggccgctgggacaagcatccaccagagcttgtccgccgggtgaggtagcccaggttgttgatggtggcatcactccgccactccatgccatgacaaaaatcgtcagggctccagcggcagctcagggctcaggtagcggcgcgaggagcgcaaacaacggtgtgaatcctgctggagcgctgccgcaacgagctctgccgcctcatgcttccgcggccatgccgctctcctccgaacagaagtgggagagagagaggaggaaggttagagaagaggggaaatagagagagaggatgatatgggtctcactgcatatttttatttttatccgaacacacgctgatatgtgggtcccatgttttttctgactttatcaatgtcacgtagacgccgccacgtcaaccaaactgtcttggactttctttgcaccggttttaagaattaagggactcgtcatattgcggttcagggacgaatttcggatttggcgacaaattgagggacgtacaatgaacttattccttgtggcggagtcccttcctccgatccggccggcccgacctgtgatccgacgcagctgaagcacgcgggcgcgctgcccgccaaaccggtccacgggccacaacgtcacgcgcgagtactctccgtgcagcccgcgcgtcgtccatcccgcgatacgatcctctcgcgtggcgcgcgcgatatccccccgaatcaccgccaaacctgcactggttctctcgcgtggcacgcgcgcgttgatccaaacccgttgttgtacgtggtttgcggccggcagcttgcggccgccctgcgcaagcgcacacacattatgcatgcgacgcgcgcgatcggtgacgagtcgacgacgactccgcgggagttgacgataagagatcgccgcccgcaggtaggcatgcgcgtcaccatcgggggcggtcgtaactttgtccatcctcgcgtaggcaaacaacatggcaagcaagcaggacgtgtttgtgaattggctggcacaaataaaagcaagccactttacgtactcctccagctgttacgtaaaggacggacgccgcggtatctccgtgtactgtgttgtaaggccctctttgattttgtaaaaagaaaaacaaaaaaaaacatagtgattttttttttaaaaaaaagtttgagtcctactttattttcttatctggtccttataaaatggctcgagagaaataaatgtgaggaaagttaacacatgatatggctaactttatgggaaattttctttgaacctttttctctcctctagtttctttcttttgtttcctcacgaccaggagcggatctacagtgttatgacctgtctcagacggcaccgacgtctttcgacaagctatgcttaaattgcttgtctatatattataacactatatt

SEQ ID NO: 33064 - DNA, 6439 bp, Oryza sativa
ctcatagttttgggtgctcaaaattagatagtagctaaaaaaatcaaagttttcctcgttaatagaaaagtaatattggtaggtggatatgtgtaagggttgatgagggttattagaggaataactcatcgatttgcggactgatagaggataaaaattaatttattttgacatatttagaaaataccacacgttattttgaaaaacacagaggttaccggaggagagttttctcaattttcattggccagggatgcgtcaaggcggcgtacgtacaaagcgtaagtcgttacactgaaaatttacgctagtgctgtagctgctagttgaggccaagttaatcttgcatatgcaagggtacgtagctagccgtgctggagaacgtgcgcgcgcgtacgatcgaattaacagcagcaaggggcctcgctctccggtgtcttttcttgccggacaaagtaggtcgccacacctctcgcgacgtgcgtgcattccatgcatacgcatgtcgtgagctagctagctccatctatatattgtccttgacgtgcatcgcggcatctagtacgtaccgttgccttgccttgcctggacgaacggaagcaacagcaacgcatatgagatctctccggccatgcatgaatgcggcccatccttgtgccaattgtcggccaatggtgtacctagaaacccaaacggcgtgtgggagaagcatcaccggatttaccattgttgtcagtctcctttaagcatctgctctctgatctcactgttaaaaaataataattctaatttttaagatgagtctgaacatatatgtcaggctctaaacacttcaagcagtagtagtacgagtttgtaagctagtactctctatgtctcattttaaatgtaaccatgattttccgtgtccaacttttaccgtccgtcttatttaaaaaaaattgaaaaaaatttgaaacataagtcacgtataaagtactattcatactttatcatcttataacaataaagatactaattataaaaaaaatcaaataaaacggacgatcaaagttaggcacgaaaactcatggttgcgcttaaaatgggacgaatggaatagttgtgttgtgcctgggcatatgcacgttgattattactccctccatcccaaaatatagcaaacctttgagggagtaatgattataaaggattgatgactgatcttgaagataatatataggcacacacatatatatggcgtgtttagctaggccctgtttggaagattagcccagggctaattttaagagctaatgtttagtcatgaattggtaggctaaacattagcatagggtggcatgtttggatccatgggctaattcaaggctaaaagatggagagagagagagagtagaaagagaggagagagaaggagagagagagctatttttttatggttcccacacaaaattagcctcattagcaccccttggaggggctaatgttttgaggagggctaattcatattagctcaaaattagcccacctgtttggattattgagggctaatttaaggctaaaaggtgagggctaaacattagcccatggaaccaaacagggccctgcatggtacaaccgctgtgtagcgcagcacagcgtatcggttattacagccacacaaatcactgttgaggttgttggttgcgttgtggaacatgcccatagccatttaattacgggtagtggttttgtataaagctatatacagctatattatcatgctaagaatggtttctttatgtggttttcgtaaatggcaaactattggcttacataatagttgtgaaaatgcagtaggtacagtggcaaagctaggtgtgatgcacttgatagggcagcaacaagagatgtatgattttaaccataagatctcatatttaatccgtaacacactcgtattttttttcttaaaatatgttggagggacgtctcttccttcaaatcttgaaaaatgccatagttagttataggctgttctcggctttcactggtttattcaaatgtcatagtccagattttaaaatacatgtggacagcaatggaggtagcatacacagtagtatttcgtttttttttttcagaatagtaagcactacgagcctgcaaatgactgaagctgtgtgtatactgtatagtgcatagctatgtgtaacctagctaaagcctgaatgtttcagctctttcatagtctgaaggtttatagaaaagcagagagtactgcacagatttgaaatttaatctcagccccgtcgtaaatagaactttgcatgcattggaaaatattgacgtagttcttcagatcaacagccagccttcagccacagctcaaagcaagtacagataaactgaacagtcaagctgtacgaaccatggattatatatgaattagtgcacgtacatggtcaaacattgagacggggtttaatgattaatctaataaatcaacactgcttaattcatgggacatcttttccgaatatcgaatcctgacagatcgggaaaatggcatatttcctctgctggtatagtaactcctctgtcagatgtcaatatgtcatagatcagcagcaacattgtgccattttgtgccatttattgtcgactcaattattcagtaattagattctgtattttgttggcacaatgttattactgaaagatgtaattcaaaaataggaattacatcccacgaaaattttggaatcgtccttgtgtcatcatgcagagagaatcaataactacaattatctgaattttttttatcgaaacacatacaactatctgatcgaaaatgcttccgctcgggcgtctgagaccaacaaatcgaacactgtaccgtagtcaattagactgcagggattaacccttgtgaagtacagtattttcagtcaccctagcctctagtgagcagaaaaggattcggattttacagtcccctaccgaaatagttacccttatttcacaaacctacccttaccatgtcacaattttacagtacaatctcttctactcaattttagtttacccctttcaccacaggatcacataattaatgattttttttgaggtgaaagtgaaaaaaagagagaaatactgtagttcgagtggaacaccggagaccggacgtcagaactccggcaagaactccgtcaactcctcctcctccggctccggcgaaggctcgtgaagcttgttgaaatactctaccacgctgaacccctcgcacgcggcaatgtcgtcggccggcggcgggatgtacggcggccgggagagctcgccgagcaagtcccacgcgactccggcgaagaacgggtgggcacggacctcgtcggcgccgccggcgaagccgagcctcttcgtgggctccttgtcgagcagcctcgcgatgaggtcggtgagctccggccaccgccgccgcgagtcggcggagaactccggctcccggaggagcacgttgcggaacgtctccttccggctccgcccccggaacggcgtcctcccgtacgccatctcgtagacgagcacgccgagcgcccaccagtcgacggcgaactcgtgcccctcgccccgcaccacctccggcgccacgtactcctccgtgcccacgaacgagaatgacctctcgcacgcggcggcggtgccgccgctcgcgctcgcggccgagcagaagctcgcctgcttcttgccgcggcttaccggcgacaccctcgccgacttcgccttcttgaggtggtcggcggcgccgccgccgccgtcgcttctcttgaggaaccaggccaggttgtgggtgtactgcccgggcgacgacgtcgatgtcgtcgcggccaccgacgactcacttctcgcgaagattcgcctcagctggctccggccatgtccctgcagctgcggcggcggcgacgacgtggccgagcacgacgacgacgaggtggaggtggacgcggagggggagacgggcgggagcagccgggagaggtcgaagtcggtcagcgtgacgtggccgtcggcgcggaggaggacgttctcgggcttgaggtcgcggtacgcaatcccggcggcgtggagctcggcgagcgcggagacgagctcggcgacgtagaacctgatggccgcgggggagaagacgcggtcgggctgcgcgtggcggagctcgttgaggtccccgccatggcagtacggcacggcccacgccacgaggtcgcccgtctcggcgcgcccgagcagcgacgggaggtgcgggtgcgcgagcccggacagcaccgacacctcccacctcgcccgccgcgccgcgtccccctgcctcgccgccgacgcgacgacggacctcttgtcgaagaccttgagcgcgtagtagcacgccccgccgccggcggcgtcgtccgccgccgcggcgacgaggaacacggtgcccatggcgccgcggccgagcacgcggacggcgcgcacggcgtcgaggtcaatgtccgccatgcgcggctgctgctgctgctgcatgggcgcgcgcgcgcgcgctctgtgtgtgtgcttgggagtgtgtcgcgttgtgagcgacgaggacgtggaggcgagatataataagctggtagtagggggccgggctaaacccgcgagacggttgcctaattaatttgttgtttttgtcttgtttaacctgcagagattaatgaaacaaagtggcaacgccacttcaagatttatactattgttatctccggcacagctttggcgttttctcaattctcatcggttctgtcaaagagacgatcttcggagcatatactggcctagggtttcaaaaccggctcagtcatcgaataccgcacggccttttttttctgtctatatatcatatgacataaaatctcacctcctatcatttgaattttgaaccattggatgtgctttaagattcgcgcagccccttaaaccctaactcctattcctccttccccggttccagatcatgctgccaccctcctcctcccgtcccacacgcgatccgccgccaccaccgccaccgccacccccaccgcgctgccgcccgcctcgccggctggccggaaaaagtcaacggccctgcaagccccctccccctccccttcccccctcactttgtcctcatggcgacgatgacgaggtgcccccgccccgccggatccgttacctctggccgccacctcctaatcccacgcttgctttgacccgccgccgacgccggctcaccgccctcctccatccccgcggctttggcgatgccgccgccacctcgccgctcgccggagtccaccgcccaccgccagttctccgccacccacggccatccctttaagccccaaggaaacccccctcttccccctcccccaacccccctcctaccctcaccccaaccccaaaccctaacccgccggagttggaggagagaagccgatgcacgaatcttggcatggatccaatggtccaaaatctgtaagatttcatcctcaaatttcattcgaatgccatatagcaatcccctttttttcgataaacgcgattactgtatagtgtccgacaaaatttgaacaaaggtaggagtatttgaaagttattcccagtgaaatatactatttttatatttccatcttttatatttccaaaggtgccatataagcaacgagtcatgtaattgatgattgaaaaacacatggttttatttttgttgtttcataggtaatacatgcaagaaactatatattataaacaatttggacatggttttatcctctgacctcttggcacgtcggaacaatttggacatggttttatttagatgaaactcatcgatctcatctctcactttattatatttcttaccacatcattaaaaaaatactaacataacaccctatttaaatagaatgaaactactatattaggatgggccttatcttaacctcggtcgtctccttcgatctaatggctagaaaattgtctccaagattcagccaaaaagagagcagggagatatggagaagaccgactccccggcaatgacagtgttgccgctagagccgcgaggtcggaggagggtagtggataagtcggcgatagaggaattagatcagagtggtaggggagctaatgggggcaccttgccgtctcccatattgggtaggaggagaggcggggagggaaggggaaggtcgattggcgggtcttgttggcatgctgagggcagggatcgatgtggtgacacgagtagggtcaaccaataagtcaccaacgagataaaggttggctggagctgaagggcaccctgaaagaccttccagggagaccagtgaccctataacgatataagtctaccctatgaagaccaaataacctgaatatgttgaagaaggggaaaaaaccctcg

SEQ ID NO: 33065 - DNA, 4334 bp, Oryza sativa
ctaactctagtcaagaaaatacattgtttgaagatatcttaaaataaatctgtcatgatttacatgaaaatcatatggtggatttaaataaaaagcagtttaatatagtactatcatgtagagctgtttatttgtggaagatttgaaaactagctttatcacttcagcatggagtaagtgggtggtggatgccgttggtccactcactaatacgtgtgcatgataagctaaattatgtcaattttgtgctgcttatgcctcctccaataaaggtgagtcagctagctaataaatctccatatcagcttttgtatgatgtggaagagagagaagataaggagagagaatgcactatctcttcttcaagagctaagcttctaaagaaaatatgagaggaattgtgaaacccaaagcattttaaataatatgctataaaataatttattggagagttaatttttttctcttgtataaggtgaacaagcatatccattaaaggaggcgttacaagagagatcatttggcgtggagctcaaggtgagaaaggtgagctttacacgtgtgcacagtatcagcaaccgaagattttttttttttttacagtgactctacaaacaggcacttcacatagtagtattcaaaacaaaatttaaactgctggtcatcaatcatatgatgcaacggaacgggcatattccaaatcggacatcgtacgggattatcgagagactttgtgttgcgattgtacatgacaaaagattatgataccgataggacgaaccgtaccattatattgtgcttgggatgctgctcatgagtcgtagcttgtgttaattttgcatatttgtacgatgtacctaacgaattttgaatgcaaatttacgagctaaattaactggccagagcagaacccgtccttcagcgacttctgcacgtcgccaatattgacttcgagtcaaaatttgatagtacgaattcggtttgattaatgagacaaaatagagtgcgattgatgcttccctcctaacatgataatattttgtttaatgctgaaatcaagaaagtgaaggtcaaaacatatcttttcgtgaatcagccttgtctgttggtgcttgtttagttcgcgaaaagaaaatttttaagcgtcatatcggatgtttaaccggaatttcggatacgaataaaaaaactaatttcataactcgcctgaaaaccgcgagacgaatcttttgagcctaattaatctgtcattagaacatataggttactgtagcacttatggctaatcatatgtactaattaggattaaaagattcgtctcgtgatttctcccataactgtgtaattagtttttttagtctatatttaatgctccatgtacatgttcaaagatcgaatgtgatgttttaggaaaattttttggtgaactaaaccaggccttgtttagttcatatggttagctttaccttttgaaagtgctactatctttttttggtgaagttcgctcccatggtgagctgcatgcatgtgacagaaaaatcagaattgaagttgacattgtgcttactgcttacgtgccaccaaattacagtgcttaaattcagaattgaagttgacattgtgcttactgcttacgtgccaccaaattacagtgcttaaattcggttataatttagaataatcagggatcatattggcttgcttcaaacatgtccaacagagaattgagcttgagtacttggactgtagtttttttttttttactttcatacagatatttatagatttcttcagttagttctttcaaatgtgcaatacgaggagcagtataccatcagtatgacagtcatcaactggtgagcttgtatggcagaaatgggtcctatataaattgaattactaattaattttagctgcagtagtgccagggtaccacctggtccaccagtctaccaggaacactgttcgtccgtaaacatgtgtgtgataaagaagatactcagagccgtatttatttcagtatggcacaggagccatccaaaatggcctaaaatccagcgtcaagttgcaaacaaaaagtatatatattcaactaagtttgctgacaaaaaccaacataaccatcagggaacataagtttatatatgttaaagggtgggtggttcgtactacaaagacggtgtacttctatgaagaaaatcttcatggagtcatgtttaagttgagtgtgttagctacttttgttctcttttgagaggaggtttgattgctaagtggcagcaatactaattgctccaattctgtcgtttctgaagatatataattcttcgtggagcccagagcctgaatttgagggttgccttacataagcacattagaataaccaagaaacctgtcccatggtcaacaatttgtatatcgacacttcaaccaacaaccataaactccaacagtgctaagttcaaaacgagataatgggtaaatggagaacagagttcctgaaacactacctgattacctgctataaaatggaatagtcactcctagttcctagtgttgcctaactctagaaaatcttcatccgccgtcgatcgagacagggacggatgaagcaatttcacaggaattaaactatctcctatgaaattcctccaaaatttctacgtttcaaaggaaccatgagtgtgtggacggaggacacccggcagtttctgttgtagatcatcccctgagtcgggatgtgagaaacatcacgtggcataggcaaaccatcctatccaacaccatctgtgcggcacatgtatgatgaaattatcaacagtgaatcagtgtgatggtttggatgatgctctgaacttgagccgtggagagggaccagttctggatgatcacttttcttgatcaggcgccggtccggtcaaggcctcgatcgctcgtttcgtttggtggttgtctaccactcattaccaaagctctgggacgagaccgaaaacttctttgttttctccttaaacaatgattacctgaaagcaagattagctataacaaacgtaacgtggctccctggctaatcaaagcatatggcgtcttgtgccgttgttgcttcatgccactgtgcacgcaaaggccattccttcctgccaagggatacccagctgggaatgtctctgacagaagagaaccaaaatggagacgtgaattcagacgtagtatctgaacatggagaagaattgtggattttggtgtctctgcagatgcagagaccgacagatacacatatatacgtatagggatatgctcagtgttcagtgttgttgccacctgccaatccgtcaggttaacgatccttttggaaattccacccgtgcattcttgtgtgactgtgtgcgcgaatcatgctctgctccattattggagctgagcttggcgtttggcatcttcctgtttatctggttaacttcgtcgtcacctactggctactcactccccctagtctttaacaagtcgtaaagctgaatagttgctaacatgttagcccacactgatgcagggggttaagagtattcaaatcggagcttgtcacccatttaacaataggtgtctaacttggtcggccattacacgggagtattctagatcaaagtgaggtaatcagcactaagtaatttcatcaacacaagaacagatgcatcaacacaagaacacatagggacataggataggaggcccttttttgcagctcctgggtgcgtgatgaaccgatgattagtgaagctcaattagtagctccttgacctttgccgccaacgaacgcagattcaggcatcgtttcagccataagagccactaaactgaacaataccacttttgttcatatgggaagttactaaagatcacccctgtgtgcgatcacatcagagaagtgaagtcacgtcacgttggattgtggcgcagattgctttatgcaaaagcgtctcactctcacacaaaaagggggtcaaggccgacgcttagctgttcaactcttggcgagggcgaggcttcagatcagatcagatcaaagatcaagatcagaactaccgcgatgaactgctctgcaacaaccgacaaccgcggttaatgtccacaagttgtgtgagcactgttcggcgacgaagcagaaacgaacaacgatccgtgcagagagacgagcgacgacaccaccggcgccgcgtgaattcgcggtagccgagccggggaagccgtgaggcgcgacgaatccgcgggggatgtgatcagccgaccgccaccgatgggccgtgcgaaacggcaaaaaaatgggcgaaacggccgag

SEQ ID NO: 33066 - DNA, 2613 bp, Oryza sativa
gcgcgggacgggccagcgctcggtggagttcgtggaattcacgggatttcacggggaatttggcccgcgtgcgtgtgggtttacgaggccagccagccagcccaccgtggaaagctactggctggctgggttgatgccttgatgggttacaagtttacaacggttgttgggtttggattctataatcaggaggacgtgtcactccgtgtccagttctactacttttttctctttggaagcgcaaggtgcaaagcatgtgtactctatcgttcatgtcgtgacgctatacaggtcaaacatggagaattggagataagagattatggtgttctgacagtacttttgtagtccatctgctccctgtttgttgatggtgattgttggtaaaggtgatctgggtatacagaaaatgattcagaaaaagaaacacacactaaaagttgctgctatgtttcttttttcccttcagttactaccaacaacagctaaaaacacttgctcaaaaaaaactgaaattgaatttggcatctagatgatatttaaaattaaaatgttcattttgaactatgtggataatctcaaggaaatactgatctaacggtggaacaattaacatttttttttgcaaggaacaatgaacatgattgcctgattgggagggagtaagaaaagataacattgaactttcctcaccaaagacctcgatgagaataccatgtgctcatccattttgcccgttctccgtactgccacatgaagcacgctaaactccatttcaacaacaaaaaagaattaagtaatgtaaacctcaagggatcagtttcggcacaaacaatagaaaagcccaactggcaaagccaaattaacgagaagagagaactatatcacgagaactcttgactattgattgcgcatcacatcgagcagcctaaggaatcctaatcatcatcatctacaagaacacaattcgcctaccatcacgtatactctattgctaacagttcgtgttagaccaaataaaaaaatataatcagaagtaatcaaagacgagtgaagaacaggtcagagtgagaccacaacacttgcgagaaagaagacgactggccatcacgagcagaggatgtggacgtggccatgtgaagagtcaggccgtgtggcctccacgacagtataacccgtgttcatgcacaaatcgcgccgtatcttttactactcgcacataatttctccgcacaaaatgacttatctttttgttgagaaaaatgaaaagtttattctacttgggtagtagtactatgttggctgatctttttttttctccctttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagtaccggtgctcgccgcagaacaggtggccgcaccggcaccggaacccggtgaggccgacacgcttccggcacctggagcaccggttcaccgccgacgtcttggcgaccggcgccggcgccgtcgcgagcgcggaggccatctcctccacaggcggtgggagaggagcctgaggctcaaccagcggcgccgccggcctcggcggctgcttgtcgagcaccggtgacgacaaagaagacggcgacgaggtggacgccgtggccgccaagaagcagttctggcagaggttctgcgtggccgggttgcccgggaatccgcagctgttggcgcacagcgtgatctccggcgccctgagctccgtcggctcctgatccttcttgtcgcgctgcgccatcgtcaataaccaaaaaagaatccccctcttggtctcaggctctctcagcaggctgaggattccgctcgcggtttgggtttgctgtgtgatgaggattgcaggagagatcgaggagaggatttgatcgggaatggcggcgaggcgggggggctttttatggacgcggaggcgcagcgtgtgtgggggtgggggcagcgacctgccccgcctgccgcgcgggcgcgtgttatttccggtattggcctcgttggcgtcgcgcgggaagggggggggggggggggg

SEQ ID NO: 33067 - DNA, 2359 bp, Oryza sativa
aggggagggggtggaaaacgggaaagcgaagaccggggcaaagcggtaaaccaaaccatcggcaagccgcatcgccgtctcgggtcggctaagcaagctctcgttctagctgggaattggaagttggaacccgtcgtcgtcctcggcctctcgacccgtcgcgtggcgtggcgcggcgtgcccccgttcaccgcacgttctcgttctgccgatctgcctgacgccgcgatgagaaaaattaaggaaaagatcccccctttctgctgttgctgccgtggagctctcctcgcgtcgctttccgcccgctgagctgtctggattagcatggccattcctttccttccggccggccttcccccccccccccccccttcttcttttctccccctccctccctacgtagaccgtgcccatgtcactgtcacacatacgtacgtacacactcaaaagccaaattgcaatccgagaattgagaatactaaatcacggcctctctctctgtatatgatatatgcatcggctgtacgcatgtcgacatggagaaggacgattcgtggaccggttttggtccagctacgtacgcaatacattgccccgtacatacgcgccgcgcagccacgcgctgatggcgttttcatgtgaaatcacggcgtagtttgttgcccgattttacagggaaacttcacggcctcgctgagcttaactcgtcctgaattaacaaagtacaaggcggccaaccacgaggagacacgcgaaccggagcgcacgaagagaatccccggataagcggattccctttgccccagagaggacggaaaagacgccggaacagcacgcgcgacgccacgcgagagacggagcgaaccgaaactttccccacatgagtacattgacaattcggcaaccgatcgattgatcgatcacctcacccgatcgaatcgaattggggtaaaggagagcgaggaaaatatgccggaatgcgcgaaatatctctctgcccttggataggtagcagcaaaagcaggaatggatggatggatgatccgtcgggtactttggatagagcattggagctaacttgcagaggttggaagatgcatggtcgtgatcatatgatcaattgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatcatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgcaacacgtcaccgtccgtcttgcgggcaacagagagcgtcagcgtcggtgtgtccgttccagtttgcggaccgacttgatatttcgattggctttggattgctatcccttgaccctagaatcacctttgccaagtgctcctttttcgctcataaagttccagttcaggatgatgctactagtggctttgcacttcaggagtttactacataattgtttgtggagtttagacgtggcgattgtgggtggatggccggcagctggtgtgatatcctccgtcgaacggcggcggctgtgatcgaacccggcggcgacgctgcgcttcacacgtgtgtgacgctcgccaccgcgtgtctcccggccactgagcacgagcgccagcccagcacgggacagttcagggtcgcacacgcgtcgagccgtcaaccttcgtttactcgctcccggggccgatgtccgcttccggacgacgccggtttgaccgcaccttccggcttccaggagagtcgtcgtgatgcccgcgtgcgcgttttgcagattgggccgcgtaggggacacgctgaaaactgggctgccttttttggtccaacgtgaaaggaaaaagtacatcgaaggtccctcaacttgtcaccgagataaaaaaacgtcctcgaaccataaaaccagatatcgagggctgcaggaa

SEQ ID NO: 33068 - DNA, 2824 bp, Oryza sativa
atcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagctgttctccctgccggcggagaaggatggagaaggcagtggagcggcaccgcccgggctgctgcttcccctgccgccgccgcccgcccgcgcgccgctccgctgcacgccgcctacacgctgctcctcccccgccgcttgcgctcgccggccgtcccccgtgcagctgcttccccgcccccgcgcgcgcccgcaaccacctccgccttcgccactaaagccgccatcgtcgtcgtctacttgtcttcatccaccccaaaatgtcgtcgcacctagacgggcaccgccgagtagccaccccttttccctcaggcgccgaccgccgcgccgcggcgatgcgccggtgttgatgaaaaacacaaggcctgggtcgttaatagccggccatcacccaatcggagccgatgccgccgctggcgccccctccaattggcgccccgtccttctcctcccggcgccactcccttccctccctcctccgcctggcgccacctcgattcctcccctctgcgccgtctcccggccgcgctgccaagccgccgcgcctcgcagcctctctcctcctgcgtgcaaccgcgccgccaccaggctccctctccttgccgccaagctctcccccttccacgctgccggcccctcttccccaccgccgccgcccatcacctgcgtcgctggcgcccttcctctgctgcgcgcgtgtgacgcgtgaggaggaaaaaaaaaggcagagagagagaacggcgaagtgaagaaacagagagaaagagacaaaataaaacaagaaagaacagaaaaaggaagtggaaccccccttgactcctccccgtgaaggaaaaagtacaccaaggaagagatgtgacgtggcagtctgacacgtggggtacatgctgactcagctgccacgtaggataaaaacgggctcaaaaccaccgaatgagttattgtaaccggttttggtaagttaaggaaccttgatatctggttttgcggttcgaggacgttttttatctcggtagcaagttgagggaccttcggtgtacttttccgaacgtgaaatgggtggtatcatgatgggctgttcaatctgtcgatatttatgggctgaattaggcttacaggcttagggcaagccgaatttcgtgggctattatggcagcttttctcgtgcacaaatatggatctttatttggcccaccgcgaccccacggcataacgaaacaggcagagcccctggaaagatttcagcaatacctgttcagacgacgacgtctgctctgttgttcgatttccgtccgcatattcgtcgtgtgatcgtgtccacgcctggagttttctggcacaggccgcgctcttctcacctcagcctcaggactcaggtgatcgtgtcaacgtccggagctctcaggcgatcgtgtctcacttcacaggttgacaggtcggcgcattcgatgccgttccaaacgcagaaaatttagagaaacatctcgggacagagcggcgctcccacgcgtggaatcccgcagatgtaaaacttcgttacaatttacagtgttcgcaacatcaagaaacgacattttttcattcgaaaatgctgcaaatctgcaactggcaatctctagacaaatcctttccctttcgatgccgaagcagaattgaagtttgagaatgttcttcgtctagaccgagcagtcagtgatctgcaagcgcgaggcgttcacagatcgtctcgacgacctccctcccctgggacgcgttctgcctgaacctctccgcgcaccgccgctccaccatctcggccgcccaggccgccacggcagcgagcggcgcgcaccgaatgctcgtctcctgccggaacagcgtccactcgtcgggccgctccgggtgcgggcggtagctgcaggtctcctcgacgtgcaccagcgcccggaggttggcgttgcgggagatcacccgcatggcccgtgcgggcccgtccacggtggtgtgctcgacgcagagcaccacgtcggcggcggcgacgaggccgcggaggaggagcgggagcggcggcgcccgccccgcgatggcgcgcacggcgtcgatgcgccccgatccagcgtcgacgcggcgggacagcgtgtgcacctcgaggatgtgcgacagcggcgccgcccgcgcgtccgcgtccgtgaacttgcgccacgccgccgcggtcacccggtgccacgggtggcggtacacgtgctcctgcgtgtacgagaccaccatgccggccggccggccgccgcttgcctgtgcgcgcgcgcgtcgcgtcgcgccgagatcgagcgaggctagcgagagcgatttcgacagcaactgcagcgaaataatgggaatatgagtgtgtgtggactccggactccggaggaagagaggaatattcgagttccacggggaattaaacccattattttgggctcaatttgcttggactgcaaagctaccagacctgcagcccagcgcatctacagatgggccaaattttgacatacttcttagtgggcctaagaattcatgaattgggg

SEQ ID NO: 33069 - DNA, 10433 bp, Oryza sativa
ccgcaccatggccgccatccgcaccgccatctcccacgtccagaacctcatcaccggcgtcaccaagggctaccgctacaagatgcgcttcgtctacgctcacttccccatcaacgcctccatcaccaactccaacaccgccatcgagatcaggaacttcttgggcgagaagaaggtaagaaacccacctttggatcacttccatttgcccgctgttcgtggatcatcctagatctcccccacagatctctcaaatctgatgcgtctttctgtatgctttgtgtttcaggtgaggaaggttgacatgctcgagggggtgaccatcttgcggtcggagaaggtgaaggacgagctcgtcctcgacggcaacgacatcgagctcgtctctcgctcagcagccctcatcaaccaggtgaatgatacgatcccgtttcttctccctatagattggagatttcctggtcttctaatactgatatgatgcaatataacctaattagtcctgatctttgcatgtgttatgtactcatgttgccatggttgtaggaattagttctctttgctccaatgatatatctaggtttgtaattgtttaacaagtcatgcctgcctgcttgtttctgttgtttgctgcttaaggttatatgttgaaactgctaaggcggcatgatgttctatgtccttagtttgatcattggcagttgtgaatgtcattatttacagtgctctacttaggttttaataaccatttcaccatctgtctgttatgtcagtactgaagttacgttaacacatttgtgacgaacaaatccatttcttgaacaaccaagatcccttttgtagttgggctaattggcattgctaagttcttggtttggaaaccatgagtggtgtcggtgctcagggtacagtttgttatccactgtctgatccctatttgaatttggcgtctgcacaacaccatgattatacatcaaacctttttgccaatgtgatttatcttctatttttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatgatggattgcaaactggaggagtgtttttcccctgcccttccactgttactggaagcagcggttagtttcgagacattggcttatctggacatagaggattccattgttagcatcatggatgcatgtgtgatttagagctgcaattcatttgattaccacactccgcactactgatctgacactgacgtacagaatcaacattgcgaatgctttttggggacttcctctcacattctcgctgtagagagtgcgtctagtagagggtgaaaccgtcgctgtacttaagagagagtgcgtctagtagagggtgaaaccgtcgtcgtaggagacgtggcgtccgcggcggcagggcggcgcgccctcgtcgcgctcctggcagcagctccacctccccttccagttgtctctcccggtgtttgggcgactccccctgtcgttccacctgtacacgatcaccccgctcttgtcgctccattcgccgtcgatcccctggtgcggcggcgacagcgagaacaaccccttctcccctgcaaacccgtcaaaagatagattcaagtcttatttaacagtaactagctgggtggtccgtgcaattgcgcggctagcacccaaacaaaatcatatatttttttaagtatgattttacttaaaatttattaaatagctatctcattgtcttaagattttgaaagatcaaactttatcatctccgtgtttctaattatataatttttaaaagtcacactagttgctacttcttatgtcatctccttctttatttgcttgtccgatctaccacaatttctattcattctccttggaacctttaaaaattggatcttatatttttttagagtttattgtcattttgggtttcgtttttataatttctagatgtcccgtcaaacgttgccattatactcctctacggcccgtccactgtcttctctttattgccattgagattttaaaaatcgaacataattatcgtttgggttcatttttactttctagaagtcccgccaaaccatcagcggctttgctattttactcctctaccactcggccgctgcctccctttttttttgtcattgagattttaaaatcaaacatgattatcattggtttttttttactttttaagaagttccgaacctttaaaaattggaccttatagtttttagagtttattatctggttgggtttcattttttataatttttagaagtcccatcaaacgatgtcactatgctcctctacggcccgtccgccgcctactatttattgtcattgtgattctaaaattcgaacataactatcgttggaattcattttttattttctagaagtcttgtcaaccgtcggtggctctacaactatactcctatacaccccgcccgctgcttctcctttttattgtcattgagattttaaaaatcgaatattattatcaatggggtttattttttttactttctagaagtcccggcaatcgccttgctcgtttgcttcacggcctacatgtcgtccctccttttaatcatcattaggattatatttggtgttttattaacagtttttatatgtcgtatcaatcgtcaccactctactcttttataggtctgttacttaatttatcttgtcatgtgttttagatggttttttctttcaatagtctttattttatcccaaattttagttatttataaactgtattcataattgaaatcttatttttctttttctaatttgagaatttattttttccaaattttaattaataccatattgtgttattttaatattcttattttttattttcaattttagttgtttcaaaattgtattccgaactctctgttagtttttctaattttggatattattttattttttattctgaattttaattaatgtcgtattgggttcttatatcatccttctttcaatattgcttatttttaattccgaatttcagctaattttaaattgtatttctacttgaactctttttttttctaatttcagattttatttttattttaattccgaattttaattaatctcgttttgagttcttatatgaactcttcttttaatattccttatttttaattccgtattttagctatttttaaattgcattcctacttggattatccttttcttttctaatttttgtttttattttgaattttgactaatctcgtattgggttcttatatggaaacttctttcaatattgcttatttttaattccgaatttcagctatttctaaattgtatttctacttggactcttcttttcttttctaattttagattttattttatttttattttgattttttattaatctcatattgggttcttatttggaaacttctttcaatattgcttatttttaattccgaatttcagatatttttaaattgtatttctacttggactctacttttcgttttcttcttttttctccgattaatgtggaaatttctaacccccacggcaaacgtggtgcctcctttcaaaactgttttaataatataatagatacttatatttacagctaattattatttcagtgctatataatgtatatttatataaggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgtggcttgggggtaatgggccaaatacaaacggcccaaactacactggacgacgtagtagtgatgcaggggaagagatctggcccaaattgaaactagcgatgtgagtagtgccgtacccgtactgccatgtctctctccacgccaaggacggcaggacgccaggaccaggagagtacaagcaacttccttgtgatttttgaaccaaccctaataatctccacgttttttctagtagtacagtacataggtagtacttacagtcagtcgttgacgtgctaataacggtggctgtcacgcagtgtcatcatggtcctcatcacgcagtggaggtggtccaaacatgtatcataagcatcattcagaaaactctgaagaaactgcgattagttacagctcgccgacgacgacgggcgagcttccgtcggtccgaccggccgcggtcgcagagcagagcagggagggaagctgctgacttcgccgcgctgcgtcgcgttcggttcttgccagccttcccaagtgggttcctgtcagctttttcctcgcggcctctgagcctctctctcggtcatcatccttcagctcctgcggctttgctgactggagttgctccaactgtttgtttacagttttgactcttggtctccacatttacatcggcggctagaacacgcacatttcactctctcaaagaacttttcaccctatcacattaaatgtttatacacatacatggagtattaaatatagataaaaaactactccctctggtcctatattaattgacgttttggacaaggttgaggttaaacttttataactttaaccatcaataactttaaaaatatttagtttagaaaaacatatatagatttgtctttcaaaacactataataaaagtaaacatgtatttatttattgtatatattataatagaaaaataaggtcaaaggtatattttgtagagcgtgtaattgtccaaagcgtcaattaaaatgaaactggagtgagtaattacacagattacgtgtaaatgcgagacgaatcttttaagcctaattgctccatgatttaacaatgtggtgctacagtaaacatttgctaatgacggtttaagtaggtttaataaattcgtctcgcagtttataggcagaatctgtaatttgtttggtattagtctacgtttaatacttcaaatgtgtgtccgtatatccgatgtgacacaccaaaacatttcgtctcgcgaactaaggccctatttacttccaggggtgaaaagttttggcgtgccatagtgattaaagaaccaaactctgaactcgtagcacctgacatctttgtggcctcaaaatagaagaacagaactgtggcgaatgcactataccaaaacatttgggtcagggatctgaacacactaggctgcgtttgataggatgggttgggaatccatcccctccgcacgaaaaacggagcagtccattagtgcgtgattaattaagtattagctaattttttttaaaaaaatggattaatttgatttttttaaagcaactttcgtaatttttttttgtaaaaacacaccgtttaacagtttgaaaaccgtgcgcgcgaaagaaagtgagagaggttgggaaccttgaggttcgaaagcagcctaaagataaccacggaggaccatctgtgacaattcatcaatctttggacgaaaattcagaatatagaccctcatcgtttgggtgctattatgcgagcagaacactagaatctttcgacacatcgccatccccaacctccgtgattgcaaaatcaaataggaggctggggcttgggtcaaagtaggagcgtccaagttctaagagtttctatttggggggagattacgtactttgacctttttaagtcgggcgaggactttcacacgtcgatgtacatactttaattttgtttactccctcactatggggtgtttggaagagaggggctaaactttagcccctctctcaaaaatataagtctctaggagatggacttatatttttgagagagttagatttatttgttcaaagaaaagacgcctaaaaatcattcagggctcttggtatcctttaccacattcactttccatattccctttctttagttcagacgctatcatacctcagggaaaaaaattttctatcaacgattcccacccaactctaaaatgactctcccctctctcccttaacatatcgaaggcctcttatacgtcaactagaccttaatagctcagacttccgagccttgctggatgatgcagaagggccaacataagaggatcaaatagagcgacagtccagattcagggttacttgtccacaccaactaatcaggtatcggaaaatagggcatatttgtttcagccgggagaccccctgggggtctagttttaaggcgattaggcctattgagatgcacatactaccttctttcatcttatcaccccgcctagcgactttgcaagcattacaggctaggcaccgccgaaggtagtccagtccgcttgttagattgaattgaatcttatataacctacgtagctaaagagaaaatcataatagtctaagtggacctctcaaaggtataaataagtatacattagtcttactggttcgatctttttctttttttgttatgatgcccacatttcatacttctcaattcttatttattcaagggttcgtatgtactgagtttagggtttagcccctctcttccaaacaccccctatatatacaagatgtagcttttgccttcttaaaaaaatttagatcaggaagaaggtgaaagagaggagaaaactaatgaagtgacatgtcggactcgccctcaccttttattttctcaaaagatcctcttttttaatgattggagtcatataggccaaattaggccggttcgagcaagggatataacttaaacagtttgaaaagttaaagaggcacaatatatgatttgcatatttaagattgatgttagtgttccatggaattttagggtgccgttttacacatgcagttgattttgcttattttgttcctacaaaaatattttctacctgtgaattttgcatagcgtagctggttagatttcatttcgtgaaacatataaactatggttgaaatcttagatttagcatgggtacccgcatttatggctaatttttccaggtgtaggtgatgtatatgtcaacagcaaggtgctcgtgatgatttcatcaatcgcaaggtacatatcgattgtggagtgcttgtagtgtcttcgtaagccttaaggtatatgtcgacagcgaaacgttggtggtgacttcatcaatcccaagatatattggttgctcatagagaaaagatgtgtatgtattcacaaggtcaactgtgtgcgcgtgtttataagcatttgtgtatgtaatgtgtttcaaaaatatatattcccttattcccaaaacaagcacaactatgagtttctgtgtcccaactttaattgttcgtcttatttattttttttaaaaaaaactaaaaaatataagtcacgcataaagtaatattcgtgttttataatctaataactataaaaatactaaacatgaaaaaatttcaaacaagatggacgattaaggttggacaccgaaatttatggttgcgcttattttgcaatagatcgagtataaaatagccagctctacgttttttctttaaaaaaaaagaaagatgttttttgtgttgaaggaaaattactgggcgcgggagggccggcctggtcagccagccaggccagcggtagcggtaggttgtactttggggcaccggcatatccaacttttcaggacaaagactgaagctgctgctggtgttgattagactttgcatagcagggcaataatttccatatctcccaaagttcctccccacgaattattcaggcagctaccgatacacattttggcagggcgcgaaaaagacaccaatgtacttcagtacttgcagccaacgcagtactccgtctgtggccagtggccagcgcgcgtgtgtgtgcatgcgcaacgcaagagagcgtcgcattgattgtgtgtttctgcgtggcagatggtactacaaggggtacgtggagtccgggtcacgttgctggcctgcccggtccggccggtctcccccacctgcaaaattctcacacacgcgtgcccgttgaggtgacccgtcctccagcagctaccgcgcgccgcgccgatcgactgctccccctctcgtctcgtcctgctttcgcacgccggatcaaacgcaagctagcttcccatggtattcggtgttgttttgcccgaaaagcaatctatttacacctgcaaactgcatatatgaaacgcatgagtttgtggtaacgagggccgggtaagattgacaaaaaaaaaaaaaaaggggaggatatgcatgcagtgcccgtgaagtgcacgttacaccaaccctccatctatcgatccgtcgtctagatgaagctaaggccctgttttgggttgaaagttttgagaagtactacctccgtttcaaaataagtgtagccgtggatatccgtacccaacgtttgaccgtctgtcttatttgaaaaaaatatgaaaaaattaaaaatatttagttacacataaagtattatttatgttttatcatctaatagcaataaaaatacgaatcataaaaatttttcaaataagacgaatggtcaaacgttgaacgtgaataatgtaaaactacacttattttaagacggagggagtaagtcaaaatcaattggcaaggggccgacgattatgagaattaagaaagttggttttttagcaccgggcctagcaaaagagaaatcgccatatactagccattatttagatatgggtggagcccaagaatatcggagagggtctaacaccctactattcagtttataattacctaattagttagatggtcctattataaaaaaagaaattatttgagggagctttgactccatccattccccccttgtctccgccatcgcttggtgagtcatcagctagtgggagtatgtcaaaactagatttcccaacttcttgctgctagctgggttcattctgaatcctatagctattgattcacatagtctagatgagtatatggaccacttccctcggttccaaaatgtaaaaatttttaggtttaaacaaatgagcaattttattgtacttgagagataccatggggtaccaaagatttagtgtaaaatttggtatatcatagtacttaggtatcacgaggtatcaaatttacaattgaaaaggcagtacctcatggtatcttctcaagtaccgtaaaattgttcttacacaaatactaaggttaggtcaaaagattccatgtaaataacttcagttgtcaattttgaattgcttagtttttatttcaagcatttcattgtcttaggaatcatcaatagaatgatatgaatcttgggaataagtgcatgaatccttataatattatgatgtaaaatttgaatcatagaaatacttactctctccatcccaaaataaatcaacttttatacgagaatatacatagactatatccagattaatgtataaaattttatattttatagggcagagggtttatattttaaattggatggagcatttagaagaggtggtgattctataagaagctgtaaccattggaagctagaattaagggcatggtcgtttcaa

SEQ ID NO: 33070 - DNA, 2642 bp, Oryza sativa
gtccccccattgattccctctcatgtatctttccctttcaatccaagagatgcatgagaaaagctcatcatttgacatgaacatctcatggtatttgtgtgtgcagcagcagcagcaggtagcaagcatgtacatctgatgttccatccatccatcaaccttgcctagacatacttttgtcggccattccgtggtgagccttcaagtgcgcccaaaaagttgatctccatctacacacatatcctctcctcgtgaaaagaagatccccaagctatttgttctctctcacttacacacagtgacacacacatactactcatctctgtgctttgtttccctctctctctctctcttgtttcttttacagtacatgcaatgcacaggtaggtcacagctccatccaattgtaggataggagtatataaatgtttgggcaaggaaacatctttgtttttggaagtatctccagctacaataccccattgctcccttttttcccttttctagggcaaacaaacaactggacatgtctctcacagcctttctgcaggggaggttcggatgcttgcacaggaaagaacacatagcaacagtagaagcttgaccgatacagggttgggaggttattgttttccagatgtagacgaagagatggtgataaaattggccccatcccaaacgcatagcgttagctctagcaaaacctggcgttgtttgaaccgacaggttcagttgaaattaaaaaagagagctatatggcaaaattatccactcctagcttgaatttgctgccacgagttaattaatactagtactagctggtatctaaaatctcaaaaatcttgggggaggatccatttattaattcttttttttcctagaaacccctttaggactcatttgcaatgtaaacattttctagggttttgataggatgctagctcaatttcctctagctagtacaaatccattagtattccttcattttcaaaagaaggccatgagtttttaattaatgggcgaagataacaaaattccaaatcttacaacacaatgctaaaattgaaaaaaaaaacaattccatagagaggacctagcaagaaaaactaaccccactcattaccatgcgcaacttttttccctccactcacccgaatcctcattttcccttctctcccttcgtttgccctgtctccccttgtgatacttcacaattgttgcctgcaagtaattaacatcctccctcatgacgcaccatatctcctaggcaaaatttgccacaggacatgcaaaaaaaacgtgtaattggctaagagacaccgtgaaaacatgacacggctgatggacagtaaaaaaacatgtaattggctgtaggacaccggtcacattttttttattatttccaggtcaaaagaggtgagatatttttctaaatgcctgacttgccccttctctttccttctttaaacaccggtgggtcccatgtgtcatggacagtgtatgtttaatctaatttttaataggtttttaaccatcaggccccacgcgtcatggactaatttgttcctaattagtagggtgattactatttactaaccataagtggggcccacatctctctcctatcctccttcttcctcacgcacgcggcggagcagaggaacagcagcttaagttgggacggttcgggacccggcggaaaaaaccgggggcgctccgccggggtatcactgccggcgacggcgaggaccaacgccgggatctcctcattcaggaaggaccaacgccatggcgacgagcagcgccgggatctcctcgttcagtgaggaccaaaatcgacggtgacgaccaacggccagcctcacctccatcctcatggtgcagtagctgtccacggacatccagggtctggacggcctcatcgccagctctgaccccatcggcttccaggtcggctccttcgccaagagctacctcatgcaggagctgggcgtgcctgagtcccgcctccgggagctcgccatcaccgactactcctccagcctgcagagcggcgtcgtggcggccatcgtcgacgagctgccatacgtggagctcttcctctccatcaactgccagttcaggacagtggggcaggagttcacaaagagcggatggggattcgtgagttcttttccttgttggcttcttttcttcttctttttatcctacactacaaccaagtactacatatgcaggctttccagcgcgactcccctctggccgtggacctttcgacggctgccgaggaggaggaggctagagagcgaggtaggtgcggaggcaatccgatccgatgaattggcggcggcggtgctccatggcagggacaatctcgccatttgaaaaatattatcacctcttttgatctggaaaatataaaatattgtctccggtgtcctatagccaattacacaatttttagagtgtcaatcagccgtgtcacgtttttacggtgcctcttagccaattacacgttttttacatgtcctgtaaaaaattttgcctatctcctatttgaccgatgtcatccgccactcctcgactgctcttatgacgtttgctttggtaccttttcatctactctagttggatatctatga

SEQ ID NO: 33071 - DNA, 4755 bp, Oryza sativa
catattctagatgaacgaaagtacataccactgtacgaggtgatcgaaacaaatcgatcgagaatatcagacccgctggcaaatacgtacacacattgcattcacaggcaatatatgcagcttacagaccactccacgctacagcacccaaccaattaaacaagaaagatgataataacaaaacaaaacagaaaatctagacacgatcgatcgatcgattccttgatcgcgacaaagctacgggcgcgatcaatttgagatatcgccctagcaaaattaaagctagcctcctactataccagatcacggagttgcactaataatcaacaagagaacaaggcgtgtacgtcccaccagatggcgacaccaccaccatcatcaacagtgtgtacgccgtactacgtaccacgaagaagaagaagaagaagacaatcaccaacagcgagcgaaaccgatgagcaaactcgtatacatccacggtagaacgtagtagactagtagttcatagtagtagtgttgttacaatgaagagattcactctggtccaataaaaaaatacctcgaggttaccgatacattatggtaccaaattgtttccaatcgctggatccaataatacatatcttatccagctaaatccaacgatcagaaacgatttagtaatgtgaggtactagtacttcgagatactttttgctggaccgaagcaggtctttgcgattagagggatcgggcggcgggggcggtggaggaggagtcgtggtcgaggtcggagacggcgccgtcgtcgtcgtcgtcgagggcggcggcgccgccgagcgcgccgtggccgtggccgaaggcgcgggcgtggtccttgagggaccgcttgtgcttgaactcggagccgcagaggcagtaccagagcttgccgcagttcttctcgtgggtgcgccagtcgcccttgacggcgaacgccttgccgcacttgcggcacaggaacggcttcagcccgtgcttccgcttgtagtgcgtctgcagcgtcctgaagtccttgagcggcttcgcccgcgggtggtcgatgttgttccggcagcccgccgcgcagcagtagcacggcagccgcagcatcgccgtcggctgtatcccccgcagcgactccggccccttcctgtactgcgacccatgcccccacatatgcatctgcatattatcatattgaactcatcatattactgtattacgtatatactctatcaaataaacattgtacaatactactatatacgccctaagttagaaaaacacaacacacaactcctgaaaactactccgtgtatatgtacgtacaccgctagtaactcagaacgcagatgtcaggttgttgtctgtatgatcgtatgctggatttgcaggctgggttcaggcaatggtggtttccatgtgaacatgcagacttgtactgttactgctgctgttcatttcagtgtggtactaggacaccgtatactggctttctttttaatgcgtttgcttatcttgagatatttgcagacatctagtacggataatcagaagggagtcgatctggctggacctggccggctcatgcatcaatctctccttgctctttctcacacaaactttccggctttccccatgcatgcagctgtgataaaccggagaagccgcatgagcgcagaagaaacgccggccttttgaaagtgagggcgctatatatgtagctcttcagatcagacaaggctatggcttagctagtagtaggagtagaccattgcttgtgtgtttgtgactgttgcttgtgagatgagagagtgtgtggcgtgcttgtgcctgaggagcacagtgtgtgcgtcagggacagtggagctaagctacagcaagaacactgcacatctcttgcagttcttgggagaggtaaacggcagctgtagcaaaaccactagctcttgacaagtgagaaacgaaggaagaaaaggttaatgtggcttgatcaaacatccaacctaagctagcttggcaaaaaagcttcatcatctgaaagctagagagatcagtgtcatatggtagtggactgcatgctggctgctgtgagatactaccacacacacttcacaccattggagtagaagaaagtagctagcaccaggaacacctggcccctgccctgcctgtctgtgcatgcagctgagctgagcaaagctaagctttttcatcagagatatcatcagacacacacactatagctagctgctgcatgcatgctaatgagatctctttccatccatcaatagatacccaggactcatctaatctacttagtacaaatcttattcatgcagatcatgcaaaggtgaagtctctggaaaagagatcttcactgggatctctgctagctctgacgaaccaccactctaataatgcgcgcatttctaaagagagccccctgtaaaaagcaagagcgcccccagaaaagcataaaagtcgcatgcatgtatgactgcatttgcatttgcatggcatggctgccccggcctggccatatctgtcttgttcaatcacacgaaaaggcggccactgtgcgtgcacaactccaaccctctcctcctcatctcagctcagctcaatctccggtgatctcagagaccagaccagacaccagcacgtgtagcttgtatccactacttctcttatgagatttgctctaactcaaggtagcggtaactcacggtattaaatcatttccgatcgtcggatatagctgggtagtatgggtattgttagatctaacgatccgaaacgatttggtaccacagggtaccagtaccttgaggtaacttttttttttttttggaccggagcaaatctccttctcttatagcttgcttgctagcagttgctagtactcgtcgtatttcaacgataagctaaacaaaaaggtacgagctagcactagcagccatggaatcgaaggagaactgaactgaactgctctctagctttcatgttccctccgtttcaaactagatggctttgaaaataggtcgccagtttcaaaatatagctatctcattgaatggattttttttttcgaatggaaaaaaaatagctatctctgtagttcaaattatatggctttggaaataggaccttcatactttgtcgttcattaaaaatatggtgtgcgtgtatgtgttcatatggatgaatgtacacgtgttatgagcgattacgtttatactgtgtttctaaaaaaaattgactttggaataggagcttcatgcttcatcgttcattggtctgacagatcgagcaaaagaacaaattaatgttcaaagaaagaaaagacgggattcatgttcttaagctaactagcccggctatggagtggcaagacacacttgataatcgagatttactagtgtacgataattccaagatcagctgcatgttgtgtgggacgttttttgtcaagaatttctcagataatatgtaggtttagcagctagcagagtatctataatgcaaagagaggttggtgaatatatggatatttttacatagatacatatgtatatcacttaattaatcactgtaaacagataactcttaagtaattaattaggttcaggctttcttcttaccaatcctaataaaattcggtcggcctaattctttcagtcaacccggcaaaaataaaattcagttttttgtttttatataaaggtagtgcaggttttcgttcgcatgctgatcgaggctgagtaactagctaagtataagaagcatacgttaatgggatcaagaggtatatatagaacgagtgagacgcattgtcaaacattattccgacaaaagaactagcaagtaattacacccagctagatatgcagcgttcgttcaagagccataaagctttcctgaactactactgtagaaatttttcatagccagatcttagaaagaaaaggtaaaaattgcgtcgcctactgtcggtatcatttatttgttaggtgattgcaattaggatatgcttgaaagaaaaaaaaattagttctagctagatcggatttattctagcctaagaaaagggatttatcaatctactgaagaagacatatgctttgtcataccatgacgacaaaaacgggggaagacgaacaagaggaccactagtggtacagtttggggatcacgcatgatgctatgtctaattctaagtaaattaatcacttattagtcttgaattgcgacaaaactgaacagcaataacccacaaagaatcgcaaaaaagaataaaattaaatggagcagcgataatctagagcaagcaagaacagtagcagctagcagaattaagctgtgaagagaaatgaagaaattgctggctgacctgcatgttgttgtatcggttgaaggttttgaagcagacggggcaggagaactgcgtggggccgatgaggatctgcgacggcgtcgggatccagtactggcccttgttcagacgcccgatcggcgtcgacgcgaaccctagcggcgccgcggcgtcggcggcgtcgccgccgtcgccgtcgtccctgctcgcgccgccggcttcctccgcctcgtcctcttcctcgtcacgacgcgcggtggaggatcttctcccggctgctgacgagagccccgagatgaggtcggcggcggcggtcgggctcggcaggccgatgtgcagcgcgaccgtgacgtccgcgtcgtcgtcccccgccgcggcggc

SEQ ID NO: 33072 - DNA, 3459 bp, Oryza sativa
agccgccccgcgcggcgacgacggagctggtggtgtctatcgccgcctccaccgccgccgccgccgggcgtcgagcccggcacgtcctcctcgtccgccccctcctcctccgcgccgtcgtcgtcgtcggtgcagtcctcctccccccgctgccgcgcacgctcttgcgccgccgtcgtgccgccgcgcgaggcgggggtgagggacagtagcggcaaggcctcccggagcggaggcgacggcggggcagtcgtcgtcggcggcgtcgcggccgtcgtcgacgtcacccccgccgtcggaaagaacgggaaggaggaggaggagtaagcgccagccggcgacggcgacggcgacggcggggtggagaagcagtagcggcggtggtgattcttgaggaagctcgcgtagtaggggttctccatggctggcaaggtagcttgcgcctcttgctatggagagatcgacacagctcgtgtgcgtgtgtggtggcgtgggcgtggtagttggcgaggggttattatagggcgtgtgagtgtgagagggaaggcccccgaaggggattgggaatgagtatatttactatttactgtggaggttaattagctaatgtgtgcatggaggacgtggtacgtacgtacgatgtaccgggagataactcttgttttttcggattactaagatggacgcacgcgcgcgcacaccattatacactctccaagagtcggaaaccaacagcgcatctctgatctcagtaaaaacttgttggaagcccaactgcatgtgcatagttttcttggacatcacgatttaaaccctggtgggtgaaatcatgtgcatacgacttcaacaccagattttctacttcagcaccgcaccagtggtgcttcccctcttggtttttttttctttctcgtaaggagggacatgttctttctgcagagtaaggcttcacaagctcgatgaattttgatcggatttcgggaatttggatcatctcgagttatcatgtttggagtttatggaaattcattcgaaatgtgtcgatttttctagattggcgaaaaatcgatgtctcactgggctcgaatttcactggccaatcaataccttgtgactttatcacttaaattttgtattttatatattcattaaaaggttcatgaatagaatcaaaatatagataagaaatatatgccctctttagggggcttctagcagccatagatactccgagaatctcggctagctccccaaacaatccaaatgtttactcaagattgtgacacttagtaaagctaaaaatccaggaattaattagtgctataagctaggggattatatatacttctctatattctcaccagctcgccagatatattataagaaatgttctttttatgggaaaaaaagatttgtagtcaaatttccattgatcgattcatttttccatatgtccttatttgaaattaacgaaaacccatttattgtgtgtgcccatagttacaagctagtgatggtacatgtactattattatgtgtttggtttataaaattttgatggagaaatcttgtccagatgggttttctttctttcggcccggtactgttgttccttatatatacacattattagcattttgttataggtcaatttgttttgtccggggccacaattcacggattattgatgctgctatttaaagatgagcaatagcttgtgtcaaaagacaactaagaacatcatcaccggtcttgaccaaactacaaacgtgcaactttacgagttcttacattaatttccgaaatattgtaataatggaaaaaagatgttttctgaatcggttaaaaaatgaataaaattaactaaattcaggatgtatgaagcacctagaatatgaatatatatggaatgagggatcctaaaggacaaatataggaatcgagacgagagatccgaggatgatatgggagcctagagaacaaatatatatataggacccaagaggataaatatatatggcactttagaagaaaactaagaggacaaatatgggactttaaagggaaggctcaagggatgaataagaaaatccggaggaagattctaagggcgcaaggccttgttagtagggaaaaatttttgggtttggttgtcacatcgaacatacggacacacatttgaagtattaaacgcagtctaataacaaaacaaattacatattccgccaggaaactacgagacaaatttattaagcctaattaattcgtcattagctaatgtttctgtagccccccatatcaattcaggggcaatagggttaaaaatttgtttcccatttacccccaaattggggattgtttttttttgtccacgtaaaaaactccaagcatgtgtcccaacatttgatgtaaagggtgaaaaattttgttttgggaacttaacaaccccctatatgaatgtggctacaaaataacacggatattaattcttacaaattttttttcgatatgcatctttggagcaaaacttttattacatatgtacacttgtcatataaattgaatatatagcaaaattataatctataaaatatttttgtagaggaagattcgcatatactgttcttgaatgactaatctaaacatttaaaatatcccatagtaaaaatgtcaccacatcacattttctgtacattagctatgttttagtgtggaatttgcgcttgtcgttccgaaatgatcacaactttgccctttcgagggaaggtgttgggttcctgtccatcgattcagctagtatcttcttaatggcaacatattcaattttgcttgcttgaaattatgaaatgttatatagcatataattataattaccgtttcaagtaccaaatgttgagaggctgatttaaatattctttccgaacttcaaaactttggatattacaatgcgaaactgccctatataaacacatagtatattgtaagaatatgaaaagggtgtaaaatgtgacatcaatatagtatttgtattttttggagaatccattttgctattgttaattagagtctagacgtcataacactcggtgagaaaaaaaccgaagtatatattgatgccttagacctcttcttgatggcattttccaagtaattgatttcatttactatataaacataatgtaaattctccttttatttttaacatggctcttgatgcagttactagtacttatgttcttaagaggatgatttggttggacattgacacagtctccaatacattttatcattactatatcaaactatataattataaaagataaattatgaaagagtttttcatgacacaagtatgtcaacatttttcatattttgaatcatgatacctttgaattaatctattaataacttaagattttgaggtttgactgcacatattttaggacgtttctaagaaca

SEQ ID NO: 33073 - DNA, 264 bp, Oryza sativa
tgctactgcctaactttagatggggataactatattcgatactacgaatatcaatgccacctatgaaaagcaagatgtatctctatatccgaaccatttgcatcgatgccaaccggatatcctaccactttggaaaatggtgactaaaactgaaggacgtgctttatactatggggccaactaccttgaacactactataacaccttttattgggacttgtgaccgattcctgcctattgatttatatgatcatgggcctattt

SEQ ID NO: 33074 - DNA, 602 bp, Oryza sativa
ttcctgcagccctccggataaaattaacacgccatgcaccaacgcattcatggcgtgtgtgtgcacgcaacgacgcgcgtgcagctagctagcatgcagatgcagggtgttgtagggcacaggacatgcagagccatcggccatggccattgcagtcagcagatgctgctgctgctgcatgcttcatttcctcaccgatccatccatcggtggatctgtgtaccggccggtgtgtacgcttgatttcctcgacgtgctaaggtgtttcagctatcgtggtcgaagtactgctccttcacctatgttaaaatttatataaaaaaagttgttttattttgtaacagaggaagaacgagctaattattacccgttttctttgggggttggggggggggggggtgtcacgagtagaagcatgcagctgcagactcgatcgtgatgcagactatggcgagtaactgacagatgtgatagaggaggcatatagagcagatcgagaggagcatgtgcaggcatgcatcacatgccgtgctagctcgctgctggatggaagccgaagccgttatgggcaatggaatgggcaataatggaataggattgtt

SEQ ID NO: 33075 - DNA, 550 bp, Oryza sativa
cccaagacgaaaagtctaatttgcctccctcaacagtgtagatcttctacctctagcagccgaactgagaccgatttggctcggtttttctcctccaaatctgacctttccccttgtgtttttctaaaatagttgaggggaaatattcctcttatcctcctctatctttacccccaaaaatcggagctaatcgttgagtatcttatccgaatcgaactcgttttcgagtttatctccaaaaccgagttttgattttccggatcgatttcttgcgggaggagtccgatctcttcaatccaaggctataaataggaccccctagtcctcctctttcgtttgcccctctcccgtggtctcccgtgcctcgtagcgccgccgccacgtgctccaccccgccgtcgtcgccggccgagctccatccgcgtcgcgccgccgcctccgtcgtcgccgccggtcgccgtcatcgccgtaaggtgcgccgaggtgtggagaagcccggccgctctctccccgctgtcgccggtcaccggaaccccgtcgccaccgccga

SEQ ID NO: 33076 - DNA, 659 bp, Oryza sativa
tgttatatatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatgacaattaaggaccggttcgcgagctactgttgtgaaacatttatcgtgctaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagctgtgcccgcggttatgggcgggttgagcactgttcttcgtgattagtctcacacctctcacaataattatggatgttatacctggtaataatttgcttagcgggctgcagga

SEQ ID NO: 33077 - DNA, 90457 bp, Oryza sativa
  unsure (1)..(90457): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccagctgtatggcacatgttagaatttcaggcacaacatgatttgagtcttcgccatcgtgatgttcggtgatagtaggttctaaaatatcattgatcttatgtggaaatgctgattccactaagctacgaaggttcatgccatccttaaacatctcatcggttgggcactttcctgtgatcatctctagaacaataattccataactgtatacatcaccctcagttgagaccttgcaccccaagccatactctgcaataaagattgagcaagttagtaaagcatttgttggtcgaaaaatggtactcgattccatggaatggtatacttgccatcacctccgtgatagataatgtggaggtagtagaaacgaacaaataagaatgaagtaagtccgtacctggagcaatatatccaattgatcctctcagtccagcagtgcttgatgaattgtttaggcttataatgttgttatgaagaaactttgtaagtccaaagtcactaagacatgcaaccatttcatcatctaaaaggacattgcttggtttcagatcgcaatgaaccataggaggagagcatcgattgtgaagatagtctaaagccacggcaatgtctacggcgattcttattcttaaacccaaactcaaatgttttgtaggatttcgaccgagcacttttggatggatccagctttcaaggtttccattaatcctatattccaaaataagtgctttgtattcatttcctgatggatcaaatgtcgagcataggttgatcactcttataagattccggtggcgaatgtttttcaaggcctcacattccgcaaaaaagtttttcggtgctccattttggtcaagtctaaatactttgattgcaacattgcaagctccaaacttcaattgaccttttatgagaatttttacagtccaacaattggtacctccaggtactggtactgctaggtaccaaactaaatccaaccattaaatcagcaggggcatgatgggaaaaaaagaaaggaagcttcgactctgatgcgttagtgttcgtgaacttcttgtcaccaccgtcctagaatcttcgccactgcattagtgctcttccacggcaccggctccggtggcacctcctggccgccagcgccgccgcagcattgggcgttcttccaccctattccttgatccgtcgtcgccgtcgattaactgctaattactctgagcggtgccgaccaacatggagggatgaagccgtaaatctatgtatcgtcagataaactttatttgacttgatttgctaaccagtttaaatctagccttcaaatgtaattaatccctacgccaaagactgaaagtgatctgaatacaatgaatccattgtggagctgtgccgtgcaagttggagattagtgctctgaatccatgtacagagcgcttcatccatctatgagaggacaccatgattgaaaaaggacgagaggggaaaatcaagggagatggtaccgccatggacggccagggaaaaataaagaggaaaaaataatcaaggaagatggttccgaatcaagcagatggatctgtatcgctggcaagagagaagcgctgtgcggcgaggatgctggcagctgctcctcgagctcctgcatgccgtcgagtcgaggaggggtggggatggtgacgctgtgtcgtcgcgaggctggaaccagcgtcctcgggggcggcacgactggatctggaacctcccaggcttggggcagccggatctagtccccagttcctgctctgattccttctcgccttcggtggtgagtggttatgcccttgcctccggcaaaaaataccagagagatcccgactatgctaaacacgaaattccacttttaccctttggactagtagtaccaggcggggtgagcggtggtaccgcgaggtactcgtctctcgacagtcgtccgatcgtgttagatcgacggtctaaatttggtaccgccttagtcttgttggacggtaaaaaatctcttatacaccactccaaatgttcccgaaccaacaagattccttgaagagaaaccatttgttgcgttgtacaaatcgttgtatgagagtttattaaaatgcctgatcgaatcattgatgatgattttcttccgcccagttctgttcttctgaaggatgatggcaacacaagccaatgtgactataacgatggaagtgattggaattcctacactaagattataggatgtcttgttccttttagatgaaagttccttgcaaagtggtaattgtagcattggagaaattgcacacaactttttgtttccttggacgaacacattgcttgaattagcaaacacgcctcctctagggacaggtccctcaagattattgaaagatagattgagagtgtgtaaagatccaaaatactcaaaaaagtctgggatttcaccagacaagttgtttcgggaaagatccatctcattgatcccttttaagttggcaaaagatcctgggatgctcccttgtaggaaatttccctccaagtggactgattctaattcaaggcactcaccaagactagttggaatctcaccagataattgattattggagatattaagtgaattaagattagttaatccaccaatctctagtggtatgtgtccagtgatttgattctaggacatgtctaagccttccgaaagtgtagaaatggaaaagagttctggtggaattctcccatacaatttatttcttgatatatttagtttagttaaagttgtgcatcttgccaaactagaaggtatttgccccgtcaaatcattttcttgaagataaagtttagtaagttgccttagttttccaattgattgagggattactccggaaaacttgttgtaagataagcttaggatcgacaagttttggagatttacaattgtatcaggaatttggccagaaagcaagttattatccattagaaagatcgtgagactagttagtttttctatctccgaaggtatgctaccagtcaattggttttgatttagaatcaatacctttaggccttctgaaaggttggtgatggaacttggtattattccttgcagcttgttcctatccaaccacaaatttgttagttgagtgcagtttgtcagcgaagacatgaaagaccaatctccagcctcaagcttattgccacctaaatctaggtaagtcaagtcagacaaggatcctagagaagggataacaccggtgaaagagtttctgcgaaaatatattacttggagattcaaagcattggctaacgaagaaggaattggtccttcaaaccttcaaatattatacttgtgagtcctggaagggtgtagccaatgttcgtcggaagtatcccaacaagacgattggcgccaaagtttagataggtaagactcgagattgtgtaaagtcctggtggaacgatgcccgataagttgttatgacttagatctagtatttgcaacttagaaagattacttaggctctttggaatggtcccatctaatttgtttccggaaagcatcagtgtagacagtgaaggaatgttaccaagtgtgataggaattttaccggagaggaggttttcagttaaactaaggtatcggagtgacgaaagagcttgggagaatggaggaatggatccagaaagaccatttgatgacagatctatgtaagacgtggtagtgctattgaacaaagaaggtggtatctccccacttaggctattattttggagattcacccatataagtggtttgttactccctaaaagttgtgggatggtgccagtgagctgattgtgtggaatgaacagtgcagaaaggttggaaagcaaaccgatatctggggggatgtttccacgaatattgttggtgccaagaataatttgctgaagaaatgaacattgaccaatacttggagggatctcactttcaatggagttgctaaacaggtcgacaatctcaaggagggaacatgatgatatagtctccggtagctcaccagtgagggaattcatgcttagattgaggtatctaagatgtgttaattaaccggccaatctcaggggagatgtggccattgagttggttgccaggcatgtgaattctggagatgaaactgaggttagcaagacaaggaaatattgggccggtgatgttctgtgactcaagatccaacgcaacgactcgagatggattcttgacactacatgtaaccccattccaaatgcatattgcagaagattcatttctccaagaggctaatgctcctgaggggtcatggagctgggacttgaggcagaggagggcctcccggtcagcattggaatcgttgtggagttgagctgacacagaagaaggaaggcagcataggctctggaaatggaagcagactactagaataagaagtagcggtggcatcactaatggcttgtgaagtagtgatggaagagacaccatcttttcttgctctagcttgattaatttgtaagccacaacgtgcgatggggcaactatatatagcacacacagtttgagtcagtcagagatcgttcagccgtctgtgtctgacgtccaaactgggaaactagtagtaatccaactatgtaagcagacgatgtttctagcagtcttcaggtctatcatatacccattacttaggtggtgtttgaatttcctgaagacaaaaataaagatgaagattaagtatttcacacaaaacgaggtggtaataatgtgtaattaattgagttttaattattacaaacataaaaatagattaatctgatattttagaacaactttcatatagaaagttttcgcacaaaacacattattagtagtttgaaaagattgccataaatatccaaaactttatcctctctttacaggggattcgatcgcggccgggcagcgttcggaactatgagtttccatcctctcctctctcatttttgcaaaaaaacaataaaaagaatatagattaaagttgttttgaaaaaccatgttaatctatttttttgttttttaaattaatacagtattaatcatgtactactaagttacctcattttatgtgaagggcaaattaataagttacaatccatgaggtgattcgaatgtagcctaaatgtatatatatgcaaggcaaatttggttacagtaaatcgtgacttcgcggttttagctgtagaacaccgcgtgaagtgatttttggaagaagacactctcaaaagttggatatttgctggtggacatcccactcattaaaataataatttccggttgaagagtaaaaagaaataatgtgaaatatcaaacttgcccttgacccagatgctctcttatactctcttctgtttctatcatttgctctgtccctagctggaaggaggggatagagagagaagagagagagggagagatgacatgtgggtccattggtacttttgatgtttcacgtgatttctctttcctctttaaccggaaattgttattttaaagggtgcggtgtctaccagcaaatattcaacttttaagagtgtctttctccaaaagttactttgtgcggtgtcctataactaaaaccacgaagtcacgatgttctatagtaaaatttaccatatatgtagtatctcgctatgcggatgatgtagtatttttttctccgaaacgattaagttaaactcttttgttaaaaaaatccaatctaactagggctcaattcacagctgttatgttatgatgtgcttatttcaaaaaatgttgagaaaattataacatatagcaatctagaaccagatttaatcaatacagtgttacgaatttaaacaggagtgtgtccgaaggtctgcaccaccatatccatcacctcgtgttggtgtggtggaaggtatgcagtactgctaattgacatgtaggccccacatatcctcgggcccacataacaatgagcattctatatatgtagtactgcagaggatttggattggtgaaaggtttctttctctaaccaaactctagaggaagtgaacgacaactttttactccctatgttttaaaattcattgatatatagataatgaaatgtgatttatttggaacagaaatggtagcatagattttataaattgatgatttgttgatatgtagatagtgaacacggtgcatctgggccccaggaccagaaagttagttgcaaattcactgtcatttcattaaattatcttggccattccaccgaagacttggtatactgaagagcggccacttgagggagcaccaacgctattgcgcttcagggtcaggtgagtcgctggctaactaattttctcagtcttgttggagcacctgcagggatcacctagtggacgcacatgctcgatcttgttactccctccgtttcaaattgtttgacaccattgactttttaagtacgtgtttgaccattcgtcatattcaaaaaatttaaataattatttattcttttcatatcatttgattcattgttaaatatactttcatgtacacatatagttttacatatttcacaattttttttaataagacgaacggttaaacatgtgctaaaaagtcaatggtgtcaaatattttgaaatggagggagtaataattagtagccaaaattttctcagcccaagaatatatacctaatgagctgtttgatagaacggaataatattactcggttttgatggtacgaaaggagagtttaagttgactattcactactggagaactgatctttgttgggtcggcttaaaaccacattagtctcatttccaataaaaaccgggattaaaaatcatatttttccggttaaaaagcccaacgcacttttataatctttagtccagattggtgttattaaccgggaataaaaatcatttttacttccggttcaaaaaagcgtccagctccttactatctttagaactaaaattcaacacgtagtatataatccctcgtacttatcctttagatcgcaaactcttcctcctcattttttaactacatcctcctccctttcctcctctcttctctctctccctctctcctctcctctccttttctttttctcgctgctctctcttatcatctccttctctttttttcttgcagcgaacgacggcggtggcctgcgcggcgggcggcggcgcgaggcgactgcgacggcgcgacggtggattttgttgatttattatttgtgaacgtgaatttgttgatttgtgatgtctttggatttgtatatttgtcatgtgaattgtgaatgtggatgtggatgattttgtgatgtttatgtggatgttgatgattttattgttgagtttggttaaaaatcaatatggaaaaaaaacaatgaaaaaaaagaaaaaaaattagtcatggttagtgttatcaaccgggactgaagatgattgtgcctcgtgggagtagctaccatctttagcctcgggtatttcaaccgggactaaagataggcatctttagtcccggattcgcggtctcggttgcataccaaggaataaaggaggttgcgaaccgagagtgtagatgcattctctagtagtgaatctaacgcaaactcgacatttataagggtcgtaggacttttctcatcctatacagtaacttttctaactttaatctccaaacacgtgtttttcttccactgccaagaaacccttggtgctcctatcttgattgggctcctctcagagcaagtgttatggtagatgtgactaatatatccaaatttattcatatcatttactcataaattaagaggcaacacatacaatacgtcacctctaatacacacaaataccaatgtatctagtactctcacatcatttttgaaatttgtgtgaaggttagctcttgattaaggggtggttcatcatctctcctccacctcatcacctaatataatgtaacatttttaggggtagcatatgaagtattatagtgcgtgccctcaagcgggcatttgtagggttttcatgatgagtctatgttagttgggtgtgttggtttctaaactaggtgttcggtttttttctaaggagcgttatgagttaatttcatactgatccacatgtcctagtgcgctttggagtttggttaatttctgcgacaacaaatcttaactagaggggtagcgcgccgttggcgcgccgccgtcaagtaagcagtttaggaaaataacgaacatttgtatagtagttggagcaagtttgtacattaaagatttaaaatagagcggacatgtgtatggtagcatgtgaaggtttgtattttaaagatgtaggaagcgaaggaaaacacactgaaagaaggccatcagaaaagaagggagcgtaaagcggcaggtgtcggttaggacatcacacataagcatattagtaagcagtgataatttgcactgcatatatacaatagattttagtgctgataataagtggccagggtgcataggtaattagggtagcatagtggtgggaagggatgcatgcagttttgctgcatgaaaacatatgggataattcagtgctgacaaaagggcaactctactatagcacagctgataaaggtggcatttaaaggacatctattgttatcttgacgttgggtgccttgtagaagtgaaagatgcaaactgaatggagatgaatggcattggttgctgcaaaagttgcccatcctctctttaggttgcaacgatcgtccgatgatttatgcaggagcatggtgactgaatcactgcctgctgcttcaacctgaacgaagatagtttttttgcgtcccatgagtggctgaatgtaggtcactgaatattccttggtaaagtactgcaattggaactgcatgttatttttttagggaatgcatgaatagaccaatgtttgtctagtgtaagtatacttaccagtctatcttgcttcatgaatgtattgttcatagtcacaatatagaacttgctggaacgctggaggaactgcccgatgatgctgatgtagtttttaatgtcaggtgtgactgctgtattccttgcacaaaaaaacagagatcgtcgaagctatgtgtggtttcgcctgtgagcacacattgtttataagattgctatgtttaattggaaagaagtcatgaaataggtaaatatggctataaattctgttagtagacaattaattatatcatgattgttgatatgctaatagtgactcggatttgttctctgtactggtaggcttgtgtgataaaatctctgtggccagaatgcggatactgatgtggtgattttagaaggaaaagaactgagttatatgtgaacagatgaaaggcttacctgaattgtcggagctggaaggaatgtcagtcatcgactctgtccttgaatctgacgaagtctctgaaagatggtgttgaaatatgtcattagtgtgattggctatagatttgtacatataggtatatatcatggagcacaggattgtagacaaatatttgtgcacctttgtttgatgtgtgtgaaatgagcatggaagcatgcttgctggtaggcatgtcattgatagtgattcctgtcgatctctttggtgctgtcttgatttgtttcttggatgaagggatcatgggcagcttgctatcttttttcttgtcaaagagaaggacatttatctttgatggagtaagaacttgaaagcgaatgtattgaccagacagtaagccagtacggtgaacaaaggttttccacccttttgagatgaagaatgatcctgcaattttttctagttcgacggtcattggtggtgcgtgcggtgaaagcaatgttacagtctgtccatggtgtgcatggcagcctcgagcaatattgttcggcagccgctgttgtgaggcacaatgttagttaagaacatgaaagaaggtcaataggaaaagaaagcgttgctgttcttacaaaacgagtgcgttgtagcgaagtgaacttcaatataggtgatgtatgggtaggcatgattgaaaaacctgaaatgtatggtaggtggatgtcagaagataaaacagagcaatagaaggattaataggataacatctacattgtaaggtcaagaactgtagatctaatgaaaagggctctgtaattttggaaaggaaggaaacatattagtatcgattacacacagtataaatagagagaaaattaaacatgttagcttatgacagggcagcattaatgttaatgtggcgagttctacacaaggctgccattgttgctagtttttgttgagcaaaggacattggtagggtggaagagcagcatggctatattagggctgaaggagtttggatctggcatgggagatctattttgtagtaagaaaaaaaaaccagtggtgttgtctagatgttgtttgttggtggggaagcagaaatgctgtgtatttggaaggtgcagagagagtgaaagagggatgatagtggtaggaggaagaactaacctccaaagtggcgctcagctggcggtgggagtagaatcgaccttggttgatggcgattttttttgctctttggccggtcgctttgtcttctctgtgctagggctagggtggttgaagaaggcaagaagaagggataaggtttgtctgacaaaaaggaagcgtcgagagcatcgcatgggctttgtgggccttcgtacggagaggaagtaaatacatgggctttttggacctctgttttgtctgcacatacttatattagtggctttggagcattggctgagctgctctttgttgtagtgccgtagggaaagttcggttgagagcggcggcggcggctttttcctctgatgcatttgcgcagatctgaagggattgtgctgaccgcgcttgctttgtgcgcggtgagtatcgacgaagttgtgcgaggtgggacggcttggtagaaagaaaggaaagcgcacaggtgagtacgatctttcacattcggtttgtctgccattgctgttgaccatgaggtttgttttgttgtaagatttgttgcaatgtttgcttagtccgtgctggagttagacgcgagaggatgtgcctggcttggccgagtgagagcgtacaaatgtgtagcagaacatttactattgtttgtgataattcgttaaggtctgggctgatgatagtaggaagcaaatgctaaggtacatagcaatctatatggagaggtgcatttgttagttcctacgaagaaagtcactgtctttctggcagtacaacaaattaagtgtgtagggagtaatacttggtgtattgtttgcaatgatagcatgtttattttaggaagaggcaagatgtagtttgctataatcaatactttatgctttgtctagctcataagaaatgaagaaaaacttaaaggacaatgtcttccattctgtaagattggaatgcaatatttttggttgtttgggcttgttatgagactgatcatctgtagatgtgtttgtgtgtgttttctgcaataactcttctagttggatatgtcatgtagggaggcatcagttatctgcctggcaatggacaatattagcaggatggagagtgctcctgctgttagcgctgacatggagtggtgtgatgaatttggtctaggcagtgaagaatggacaacaaaggttgaaattaagatcagaaatgtcgctgagcatgtgtgtcacccggaaaaaatggaaagattagtatcgtctttctgtgatgtacaaacatatagttttgatgcaatgaaaaaggagtattatatttgtggatttgctcgtagcattgaatcaatcccaaagtataaatacttgaagataaagtatgggacagagaatggagtctggattaagtttttcatgcttaatctagaggctataccgtacgttgatccagaaaaagatgttgtggctaatggtaaattcattgtatgattgtaaatttattatattggacaattgactttttttctatctatgatgttagtactaatctgtcatacatacagagaaggatcctgaactgtatgaagatccagatgttgtgagagaagcctttgaaagtcaagttaggctgcaacgcattgcaggtatgaatttggtctgcggcgtttaaatgcatgtcggaactacatatggaaactaaaagtaacacctgttttgttgtatgctgtataagatggtgaggaaagcagtatttcggccgatggctctttgtgcatgagcattgactctgactggagcctgaagtatggtgggcgttgaatagaacaacaaggacatcagaaagatcagttgtctatgaaagatgccaagaagccaactatttagtttattgtatatgatgtgctatataatatacaatgtagcctcgtagcttttgtgttgagtattagtatgctgtgccgtaacatgttagcatgtattacagcgtgctgtatgtaacatatgggttgtttgattggttagactgccgtgtgggactgttgtgttggatatatgcatacgtcattgtaagatactaaagtttgtagcttttgtgcacgatattagtatgggttgtttgtagctggagttatttcatggcctacgctctcttgtgtggctggaatctatctgtgtatcataatgttgcaaggctaaccgttgtgctatgttaatatcacttaggtatgtctgtgtgaactgcattgtcactctgcattagcacacgaatatgaaatctgttcgtatcttgcatgagaaactatatactggtcagggaagagaatgatgattgttctagattatatttcctggtctgtctgattttattcattagctagttgctaaccaatagagggtgctggcagcaaggccaagagggttcgatgtgccgtgtaggatccagaagacatggtcgttaatcagaatggaaaccatgccattctgctggtaggcaggagaaaaggagtgttttttgatggtagctatatagacaaggtaaataagagagaacgcttaggtagattatagggataaccatgtctttgtagcagcagtctagaacacacaacagtagcagaagcaaacataggcagcatttccctacgataacgaccatggacgaaagccatgaacaaaagaacttgattcttagcctaaataaaggaaggaggctccttctgcgctgtatccaggttgatggcctatgtacacataagcaaaagccttgctacgcaactgcatgtggagctgttatttgctgcatacaagatggaaaagtttgggggtcaggactgtgtttccatattgtatttgcaggtaaataatgtgtgttgtgagtggtaacctacacctgtgtgtctactaaggagcatccttgaagagcttcttagcacttggatgtaggagcgcaggtttttccctgttgaggtataaggacatgttagtaataatggaaaaagggagtgaaatatagatgcaagcaacttttatgtaagaaccttttcttggctgtggctgtagtagctgatgttgcggctgtttgcggaatgtcctctgcatgtttagctgtttgttttgccttgtagaacaaagaatgtttaggtggttaggtctaagcttaaaggaaagaaaagcaggaataccttggactcaggagaattagtgacaacagttgtttcaggagcatgctctggatgtttgacctcatcctgcgcacaacgattggccttgcaagattatgtatggggtgaaaacctaaatagggtggcaggaagaacaatatgggcaggaaaggtaatgacaagtgttgtaccttaatagcagtgtcaacattggtgctaagaggctgcatgtggcacattgaaacaacgatgttttttttctctggtgttgaagaacttggtttgctggttggtgtgctctgtgtgggagtaccaataggtgactttgttggggttgaagtgctgtgcccttgctggacgagctgttgtgattcagagcttgtttggctttgctggggccctgtttggacagaactgctggagcttgcggatgcaatagctgatggttcctgggaagaacccggtggcataagcagcagtggctcatttgaagggccagaggaaacaatgctgttaacctggagagattcttggcttcttttgacagtatcacgtgtaaagctgacattccatgtaaatgtgctatcaacaagcgctgcgatctcagctggaatgtaatcactatctggtggattgtcctcaatgagagattccactgatttttttatgaggcggtgtgcaactcttccaaaaaggataaatgtagcattggagctggcatcaccggcgatgagcactactttatatctacatgggtaatatacatgtgtatattaatgtgtgcagcacaattagtaagcatggaaaaatctggaatgaggtgtggtatgaaccttggatctggtattcctatgttagaacagcttgagcatttgtagctagaaccgtatggcttagaagttctatagcataatcggcatgaattgtaccaccaggaattttcgctgcatatcctcctaacagtgacattgacaatgaaacgtgtactctgaaaaagcaaagaacagaaatgatatcactattattgaagtgagaaaatgtgcagcgatgtattgaacaaaaaactggcaaggaggtaccctgtttttgtgaggattgagggcaagtatttcttgaatagttttttcctctgcagtgtcctggttgtaacctgttgctgggttatcaacccagctgattggacgaaagtttgcactgaagctacatagttatatcacgttgaaagttaactaactgtttcacaaggagtgagaacacatcatggcaatggattataaacatgagttcaagtaggcagcctcacctctctttgagttctagcacttcaggaatatcaaggtttagataccatttgcacggcgaactaccagtcactgtaagacctgtatagcatgaaccaaataaaagcatagcgttagatggctagaataaacaacatagaagtgaaaatgcgtagtgaaaacgaacctaatcctgtgtaatctttgacaagtgtcccaacaaagacaataacttgggcctgagtttggccagcattgtatacactattagcgtcaaaagcatcagccctttctccccagagtgtaacaggcattgttgaattgctattgtttttccatgaatagaaaaaaggaaacagtgtgagtgtaatttaagaaagcagcagcgtactaagaatctatgcatgcatcaaaggaaaaggtaaaaattgcaattaaacatagggatattcagtctgagcaaagacaccttgcatcacatatctgtattgttctttttaagctatcagcattccttgacttcggccgcacaacggttggcgaaccaacctcagtgatgacacccatgacatctggttgcatgccatataagcctaattaatgatgagatagtatggattattgatacaacaaatatagctgtgtagaagaatctcattaccaacatagaagatggtcttgtccactaaattggggatatcactgaatggtgtcaatgaaaaagttatgccagggaaatcagcagcgggctcaatgtattcttcaaatgttgtccatttactgaacacaatcattaggctattgtcgactggcctgtatgtcctattcgcatacctcacagtaaaggagtcaatatagtaaaccttttgttccttaagcaaaggcctcaggctgtcaattgcaggtggataaatctgagcgtgaatgctgtttccctgcatttttaaagtaaataatgttatcaagagagttggcactatagcctaataggcatcgatgaataaatgtcatagtcacatcattaccatctgatcgagcagcacaagatcagtgtggaaaatattgccactgccgttgagatcgcagaaatcccataacctagaaactcttgcaaggatccttgtgtttaagtctccacaggacagctgtgaaatgagcacatgtgccatcttggacctgcaatgagcatagaactattttagaatgggtaaaatggttggataagatataacagtcaaaagattgcttggcaggatactatacatgacaaaaggcaatatactatgtaccatacacatagtctatagtacttgaggctgaaagacatttattccaaaatatatgtacaaatttgggtattactgtggtaaaaaatttcaagcatcaagcggcggagcctgcaatagtaacacatgcacattactctgctgaaaatacaacgaagtgatgaaaagcaaaaaaaaaagatataacgtgcgggaaatcaccgcttggactgtagcgctgagcacttcagagtaaactatattttttgtctgtgtaccacatgatccatcatcattttcaattaatatttttagccctgatcggcttgttactcttgaaatagcaacgtataattgcccatgtgtgaagacaggcttcctaagatatacgccaacccgctggagtgtttgaccttggcttttattgatggtcattgaatagcaaactcgaacagggaactgccttctctgcagtgtaaaaggccatttcatctttgtggtgccaagtgtgattcgaggtatgtaaacagtttcaccaatgtttgatccagtcagtactatacactgtaaaattctgtctcctaaaactgtgactaatagccttgttccattgcataacccaattgattgattaagatttcgtagcagcattacaacaacaccttctttaagaacaagtttatgcgttggaaagttagtagcatttattgaattcagaaactctagggggtataacagatcgaaatctggaatttgctcagagctttttgatatggtatcacaacttaggtatactctagaatctcctggcactaaaccaataatataatcgtttatttcatcaaccgttgtattagtaggacaaacaattgcacgagaagccagatattcaatgtctctgtagcacgtaaggaaatctgagtaaacctcatgaacaatagcagctattttgtcaccgctagtcataacaagtaaatcatcgggaattgtgatccatgcaggataattctcaccttcctttgctgtcataggtaaagtgccattgcctatagctaaaacccattgactaaaatcatgcaattcttttttttgattgtctggtaacattggattgagtaatctcatgtttatattcaggctgagtagcgctacatgtttccatagttctgagttcgtgatagatgcattgattatagcctgacgggatcctttaggaataactgggagtatttgtttgaaatcaccacctaggacaataggctttcctccaaaaggtataatagaatttgaagggcatgtctctgataaaatatctcgtagcgttcgatctaatgcttcaaagcatcgcctatgtgtcattggagcctcatcccatatgatcaatgcagtttcagctaaaagctcagcaagcattgtgcctcgttttatattacagatgcttgtttcatcaatgtcgattggtattttaaaccgagaatgagctgtcctacctctaggcaataggagagatgctacccctgatgaagcgacagcaagaacaatcttgttttgtgatctaagttttgcaattattgtattccagagaaatgtcttgccagttccaccatgaccagacacaaaaaagaaaccaggttcattagcgatagcacgagaacaaatagtgttaaaaacagttatctggtcattattcaactgctgtacgaaagagtctgcatgcatagcaagcataagtgggtcaattgtgatttcttcatcgattaatctattagtaccaagaacatgtggaacagatgatggatgtggcaggttaaaatctttgatattaccaccgctatttgcaaatacagcaataagctcatgtagtagcatgttaagcaagtggtcatgtggaatcacacagtgtggattgtcaagggccttttttagcctgttatgtatgtcatcagtcatgtatagccagtatttatcaaacaatgaacgaacatcaccaacagaacagtaaagaaggactgtcacaaaaagttgtctaagctgcgctgaagacgcagtcactatggcctcatcaaaaaggagatgccattcattatctccttcaagaagccctcgtgcctcacatgcctctctatacgtgccataaacaacaccatcgtatgtgcgaacatcagcatagctttgagcacctttgacaatcattaacaacatcctaagatagtaaagctcgcctgcagttggatgcacataataaattctgccaattttaggagcaggtgttcgctcgtgccaagttttagatgatggctcccatgtccattccttaggaaactcacagtatgtcaatgaatgggccttagaattttttttgttagtttcaaaccattcagtaagcatagaccgttttgcaccaggactctcaaggactgcccgtaggtcagctcccttctcgtatctcacaaagtttttcccaggcagatggacaaccaatcgctcaacaggtggcactctataatgtatatcaaattcaaataatcgatgaagtgcctcacaggttgagagaaatcttgcatccatgtattctaatatttcattgcgtggagcaaggtcatgatttggtgatgcattttgtgtttttcctgttgtttcaaaatagatcctagctcggtcatggccttttgtaatatatttaaataaatactttatcaaatttgatttgttacaccactcaacatttatgtgtgcctcatattttttcagtaaagccatgttgtagggtacaactgatctattgtctaaaaggatcccattcttcatgatagatcgtccatcatttcttcgtctatagattgtaaacccagattcatcaacaatggtttcatcttggaaatctttaggataatgttttgaacatttatcgtttttcatacaaggacacttcttgttcgcatcaccgcaaggaccatgcatcataaactcgctaaccaattcatatcctagccggtcggtgtcatagtcaggtatttcagcacagataaacccatctattatagaggctgagacatcggcagtggcagcagcaagccaaactaagcaatgtatgtgtggaaggccacgcttctggaattcaacagtgtacaacactgtaatcattaagaacaaaggttgatgagtgccacaccaatggccttaatacgctatgaactaacaaaattgtgaccatacctgcaagaactttaccaaaagttctgccttccctaatatcagttataaattcattaactttcatgttaaacacacgcacaataatatcagctctatcagatggttgttggccaggctcaaatcgaatcgcatctgcaatttcttgccatttggaattacatgtgtatgtgacaaaaaggtcaggaggcccatagacacgacatattgccatcgcatcttgataattcatgaccatatatcttcttcctccagtgaagctagcaggaagtatgacacgcttgccaactgaatctccatcagtgacacctttatcaattgcatcaacaattccatctacagactcagagcgcagctctttttgatgatcgatgaagtactgtagcctatttgtttcaatagtagaaaatatatcaacatcgatttgatcgctcaagcgaccatagcatgtgaaaggatttgattcatttagtctgtaatgcatttcatatctataatattccggcatcgtgacatactttttgccaattccatcatagttactgtatttaatgcctaaatggaatccgcgttcaccatatggaaataacaaaggatattgcaatgccatataagatggatgcaagggagaaatctggcgcaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgccgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaggaggggcatgcagttttggcaattgtatgcgtcctcctttgcaacatagattgtaaattatttttctttttgaaatagcagatgcactcttgaccctctcctggtaccagaacatggcacgacaatacgggcattcatacgtcggagggccatagtatgatctgtctgggtatgatgctgccacaaaagcgctggacaatgtcaaaaatagtctcgtgtaaaaaaacaatacattacgtgcacgtattcagaacagcggccgaaccctttagcaatcggatatactccttgtctgtccgggaggaactaccgttggctcgtgcagtgcgatttgctgcgaacaaagacagtaaaacggcctatgaacctaaactgcacgaaaaaaaacaagcctaccatcacagacaacaaaaagagcataccatccacattggccaaaggaacggacggatccatatttgaacgcaggagggaacgcctttgcctatttaactttgccagctgaggtgcaaaatccatcaacgaacatttcctcttgcaccgactttcctgatggggctgccctagcggaacgatagcatgttctatatgcattgcactctgttgggacagaacatttgtggcccttctctgccggctggcacgtaccctacgcactctatccatagcatgcgtttctaactgccatcataattttacagaggcaagaaaagaatgaagcaaagaacacgggcaaaaaaagtggctcaaaccacacagatacagtgaacgaacaatataaaacgaccgaaagctctggagcaaccacatgcagatttagacagcgatgaatgcaggcaatagaaacaaaatactaaaccaatcaaccataaataaaggacagaaagattaatagcgcgggaatacctttagcaaggaatatgctcgtcgacaggcagaatccactaaaacgcaccacgaagcgaacacacaagctgtgaacagaggcaaggaagaagacggaacagagctgcagagaacggagcatgatcagtgaataagaatgtaggaagcaaagcataacacaaggccaatgaaaccagcaacaaccaaaagtacctgctaggtcttagaagcagcccgcacacgtgcaatggaagatgatcaggaacctttaaaggtccattgcagcccatgcagatcgcctcccctaaatggaacaaaaggtgcagggtcaatgctagcaagaacagccgcgcagtcataagcaaacaaacaagagagaacaaacataaaacccaaatgacagaacggacaggagaaccacacgcattgatccaggccttaccacgccataacgaaaagttgaacaggagcaaaacgagtgggagtttctcgagcaaggaacagaacagtggagcgaagaaaccgacgagaggaggagaaaccgaagggaagaaagaaagagaaacgcaagtagtaatatatacagacaaagatagaaggggttctccgccgagctgcagcaaggaagcaaacaatcatgtacacctgcacaccaaacacccacaaataggaaccaaacaaatggctagctgagatgacactgccccacctatcagcgatataagtgcagcgcacctagctacaacccaagaaaacctgaccagagattagctgtgttcggctgagggagctgggaacgcgcacagtacttttcctccgtgcacgcttttcaaactactacatggtgcaattttttataaaaagtttctatacaaaagttgcttaaaaaaattaaattaatccatttttgaaaaaaaatttagctaatacttaattaatcacgcgctaatggatcactccgttttccgtgttcactgtgcgcgctgggaatggatggagccgaacacagcctaacagcataggctgcagaagaagaagactgcatggaccaagccgaatgaaccaagcatccaagcggattggacatggcccaggacgcagaggaacggggcgcatacaccaggaccacagcgatgcctgatattgacaacccacgcaaacgcaccaatagcggagaagccatcacagagtaatcccactacaggcgcggtctccaacagcatatggtcctagaccgtaacacacaggttcagaataaagcagacccaccggccagagagaaactgtgccatggacacagcgcacacgcgcaccaagcgaccaaagcaatctgacacagcagctaaggcaaacagcatagacctgttccacgttaggtacgaacaggcagaggccatgcggcccacacggcagccacaggcaatctgtggaccatggctacctcaaaaaacaaagaaatgcaccacgcaacgcataacaccggagaaaacaatggcaaggacacccaccctaccctgcgcgcggcgcaatgcaccgcacacaaaccaaccaaatgaggccaccacacagggaacaacacgtggcggacgcaacgcagagaaccagcggacgagaaaaaggaaaatgtggcatgccaaacgcaccgacgcacgatggtcatccaacggcggagaacgcgcgcaacgaccgcgctccaaatccacccctgggctccggctggatgacgtgccaagcaacggcaagggccacgacagcgtaaatcgccgcccagagcagccatttccggcgagtttgtatatagaagattaggcatactagtcaccaatctgtagcatggactattgttagcctcgaatttgatcttgtatgctggataattcgttattttcccattttgatggcttgtattaaaaacactagtacaaaatgattttttgcagatagtccataaggggtttacgtgtgcggcatcgctacccgcacgcactaaagggtcagcgaaaatcactatttttgcgtgcgggtggcacacccatacgtgaaaatcggatgatcgaaaaaaaattccgaaaacgcaaaaacttaaccatagcaagagacacttcttcgtgaggggacatgtcctagtaggacatgtttactatatgttcacatcccttcttcttgctttataaatacgtacgtgtaatcatccatatacaaacgtaccaagtgaatacaagatttgatccctcttgctcaatctctctccctcccgcaattccctacaacaaaaaatgtacaacggcaaaggcatctgatcgcatgatgatgtgtcccacgataccgccaccatgcgtggattagacgtcactaaaatcaatccacgcgttaatttggactaatcgatgcgtgcgcaccggttagattttgtgttttgcattatgcacctcagttgaattggtcgttggccaggcagaagactttcaaaagattaaacccacaaggatatttaccaagacaatcaattattgattcatagctttaccgtgtagatataatgctgctacggaaatgagagatacgacgtggagatggacatacatcgactttattagaacagcgcatttcctccgtttaaaacataacaaaaacaaatctaacattggatataatccagtactcttcctattctagtattggacatgatgacataacctatcttacatagggataaaaaaggggttcctaacgcgcgcgtacgtgccgcgaacggaactcgcgcgtacgctgcccgtcgctaacatgtgattagcactaataataacgtgatagtgctaatcataattagtacctaattttttttttccttttttctaatagattaaaaactttcaagttagatttgaaaactttcaacttaagatttaaactttgaagttaaattttgaaatctttcaatttcaactcgaaatttaaatttggaagataaattttgaaaaatttcgactcatatttaaaaaatttcaactcgaaaattgaaaactttcaactcagatttaaaaagtttcaacttggatttgaaaagttccaactcgagatttgaaaactttcaattcggatttaaaaacatttaactccgatttaaaaactttcaacttgagtttttaaatttgaattatgaaagatatttttttattaaaaatatcttataatagaaattttgaaaacattcactacatcctaaattaactaagatgaaaatggatcgtatagatgcatgcatgcatgtgtgggaccgaggtgcatacatgcatgtgcagttggcttgccacgtgcgcgcgagataagcatctgctgcgtctgcgcgaattagcatttgtgcaaaaaggggcagttgatttaactacggtactaataaaatattagcatgcatggttgacgttgaatgagagcctatattgttcaatatttgaacgtgcacaattggttaaggttaccttgttttcttccaatcataatagtagatggttataagtcaccgccatacatactgtacttcagtttgacctagagtcctagagagacgaccactcactatccaggatgcatatcgtactagcaataatttcaatccaaataggtggctcatggttgattataataccttcgtgcttaaatgaccatgtttctgactacataccttggacaggtacttaggaattatttagttgggaaaaattttttaggtttggttgtcacattggatataccactactacagaaaaagtaaaaggtgccggttcggaagccctaataggtgccggttttctgaaccggcacaaaggaggcggcactgatgatacttgtcatcggtgccagttctagaaccggcactatatggtcctaataggtgccggttctaggccaaattgtcatgtggctgtcaaataggtgccggttcgcggcgcgcgtgttaggaaccccttttttatccctatgtaagataggttacgtcatcatgtccaatactagaataggaagagtactagattacatccaatgttagatttgttttgttatgttttgaacggagggaatgcactgttctaataaagtcgatgtatgtccgtctccacgtcgtatctctcatttccatagcagcattatatctacacggcaaagctatgaatcaataattgattgtctttgtaaatatccttgtgggtttaatcttttggaagtcttttctgcatggccaacgaccaattcaagtgaggtatgcatgattacaaaacacaaaatctaaccggtccacacgcatcgattagtcctaacgcgtggattgattttagcgacgtctaatgtacgcatggtggggtgggggtatcgtgggacacatcggctgtatttagatctaaagtttagatccaaactttagtccttttccatcacatcaacctgtcatacacacacaacttttcaattacatcatctccaattttaatcaaaatccaaactttgcgttgatctaaacacagccatcattatgcgatcatatgcctttgccgttgtttttgttgaagggaattgcgagagtgagagagattgagcaagagggatcaaatcttttattcacttggtgtttgtacacggataattacacatatttataaagtaagaagggatgtgaagatattataaaaattttggcgtaccacatcggatatacggacacacatttgaagtattaaatgtagactaattacaaaacaaattaccaaaaactgaagttatttcggaacggagtaagtactatgattggatcaacatatgttggtgcttgcccattcaatttatccttactctttggtgttgaaataaggttctcctagccggtgttcggctctgaacgagttgcatgtcatcaaatcgccctctctcactcgatctggtggctaacctgatgattctgaagattttcggacggggaacatcgaactgaagaacaagttcagcagaacagagcaaaaacagaacaaaacaagataaatttttgcattgcgtaatgccgtgcagcttttcgttttttttctctatttattcacctccatatcaaagaagtctgttacatgtaaaacatgacaaatgaaacagctagatctgagagtccgtgccatgcatcccacgatctgtttccagctcggtcacaaccgactaaaaacacggtagtagctgatctgaataatggttcctctggactatttccagtcagcctattacatgcacgatgagataactgaaaaactaaaaatgcagctatacacgaggaaatatgaatgctcaagattatcccaacattgccatggctccgacgtgaaagcaaagcactgccaaaatagaaagacgtccgtatatatgcactcatgcatcaagtcatcggtcggggtagtggactggatcaagtcagcagtccacgggtcattgccactctactgtccctagcaagacattgacctcaaataaatatggcagataaggacttgaccgacgccctgacctcaaataaatatggcagataaggacttgaccgacgcccctctcgagccctttttacttatatgggtaaaaattttgacgtgtcacatcggatatacggatacaatatttaaagtattaaacataaactaataataaaacaaattacataaattccgcccttaaaatgcgagataaaattattaagtctaattaatccgtcattagcaaatgtttactgtagcaccacattgtcaaatcatagagtaattaggcttaaaagatttgtctcgtaatttacacgtaatttgtgtaattgtttttatttttaatatactctatgcatgtgtccaaatattcaatgtgacagggtaaaaagacatactatacaacccaagcataactatttttttggataattgataaaagtacaaaaatatataaacacgtgaaaaaaatcgtatagtaggtaagaaagaaaattttagaactcatatctactatattatcacataattctctcgcaacaacttgcagcgtaccatctagtatatatataggctgcagtgaatttataggtgtatatatttctcctcgccgaggccccaaaccacagacatatggtgctagttcaatgcccatgtttctgatgatcctgcttcttatcactggcagcctggttcgttcggctgccatctccgaaccttcgattgccatccccgacgacggcggcgccacgacggtgtttcccggggccagcatccgcctactccatcgatagttggttgtaagtgccttcctttccgtcagagagaatttatctatagaaactcttgcggaccgttgcgcgctacagattagtcgtcgtgtcggctcaaacgacggtaagaactaacaagacgcttaagaaaggcgatctttaggttcactacattcaaatagagaaaatataaatataaaaatatatataatcaagataattacgccaccggaaaggtaaatatatacatctagaccgttgttcatatgcacctcaatctcctggtcgacatgtgtacaaatggctccagtgcaaccgtgttccatcatgttaccttcccggtggagttgctatatataggcacagcatatattaggtaccatcaaagattgagcagtacgcactgctgcattcaacactccaattgctagtgtggatgttgatgccactgcatattagcccttatttagttttcaatgttttcctcaaacttccacctttccatcacgtcgaaactttcctacacacataacttccaacttttttcttcaaactttcaattctagtcaaacttccaattttggcatggaaccctaaatgacacgttgaaggagacagcttgccttttgagtttttttttcctaacagctttgacttttcagttgttcaccgttgtgctgattttcttcagcaaactagcctgccactacagtcgatactctaatttatgctgattttctattcttttacactaactttgcacttatttaattatatatattttttattttcatatatatagatagatgtatccacatatccatgttacttacggattctgtaattagtttttctattagtgcctgaacaccccatgcaacatcctatataatacccgatgtgacatgctaaaacattacacccctcgatctaaacaccccctgtgtctgtgtatatatatataatctcatcttcaaactcattatatatatagatcgagaaaaaaaaagacaaatacctgataaatttatactcacaaaactatcagaatttttatgttatttgttacaattaaaatataatgaaagtatttgtatatttttttctagatttttgagtgaaatttgttagttgatgtgcatggtatgtacacgagaagttttgtgtgcataagatatgttcccttctaataatatcccaacatatgaatttatatgtacaggattgcatgtgaaaaatcaatttgtgtagtacacgcgataagaacttttctaggtgtgaccaccctttagctaagtaatcttttcatttttagaacttttctaaaatatatttagaattttatttttattttggaccttctaaattctcttcgtgagcacatcaacatactccaacacatctgcaccctcatgccaagatctaccctattaatttacgtctaaactcacatcttgtgcagagtagaggttggacatgtcaaagacaaaaacggtaattaggtggtaaaaaatgtaattaagaatagtaaaaataaaaatattggataattggttcaaagtaaaactatgataataaaatataacttgaagtgtaatttactcaaaatagaacaatatgaaggaatgaaaacttagatctggaggagccgaagctaatctcgtgcgcggctggaggcatgcatccgccaaacgctctactcccaatatactcccttcatcaaaaaatgtttgacgccgttgactttttaaaaaatgtttgaccgttcgtcttattcaaaaaatttaagtaattattaattattttcctatcatttgatttattgttaaatatacttttatgtatacatatagttttacatatttcacaaaagtttttaaataagacgaatggttaaatatgtttaaaaaagtcaacggtgttaaatatttagggacggatggagtatatatatgttgcaatcgtcctcctgggcctcaaattaagacaagagtaaattggatatgatcatagatatatatgatcatagatatatataaatgccaggtaatacgtactagtagtattatagtttcaaaaacaatactgttaattaactaatctgacttgtggctacagaaaaatcgaaaactctacacaaactctctttttctccgtacttcggcaagcactcgcggtttattttcttgtggaattttttagtaaattcattttaagttcttatcatgcaatttgcgtgtatttttaccaccatagtaagttcctgattctagcagtgaatcaaattaaaccagatttttcggttttcgtgtgctatgcaggtaccaacgacccttacattgttaccagttgtgctccttcacatcgtgcttaccagtgcaacaggccaccatgtgtccatatcgttcatgcgagcaccgcggagcaacgtttgccttaattatgtacttcctcagttttataatataaaatagtttaggttttgaataaattaatgcatgaattcatgtatgtgttttaatgacatatacaaattcatataaatgttagtgaatctagacaggtaaggtaagagagaagtttaaatgacttatagtgtgtaacaagcgtgttgggagtacgtataggtcccggtatatgcgaatttctgtacctttttatcttatgtatttatatggtcctattaagaagtgtcttttgttcgtatgcgtcgcagtagttggcccattgtaatcggctagatggatcctgtaaattgttaatgatgtacagtgtatatatgaagaaaataagattaatttcaactgaggctgtttcttaaatgctttttatgtactaacagcatttgtcactcttcacattatgacgatgcaaccagagtatgtaatcgatcaattcatgtaggaagttggtgctctgatccctccatttcttattattatacattttaatttttacctaatcaaacttttttagacataactaactttattaaaaaaaattagtaatacatgtaacatcaaattagtttcattaaatctagcactaaataaattttagcagtacatttgttttgtgtttaaaatcactgcaacagaatcgacttgcgtagatgagcccccatccaacttccgctgcgattatattgataaaaaaaaagactagcatggtaaaatcaattttcgcagacgggcctcttaactacctcgcctaccactagccaaccagaccagcatccactctctcttccgtaaaatatctttgtattctttcccccatccctctccttatcctctctgctacacctatcttccacttcctgttctctccacctctccgctccacttcctccaacggcaagtggtagcgggagcagtgagctcgagacctgtcagcgaccatggggtctggcggcgagattgtgagaggccgttgggtgcggaatccggcggtagcggatccggtgggctctccccatcccgtgtagatccaaccgactccgctccctcgtcgtgcgttgatccggtaggcatgggcgcatggcctctcccactgcaagccgacatgcagatccgccaatggcagcaatggaaagagatgtcaggtagggtatcagtgataatgacaatagttgccggataggtacacgcgacggccgctaggcacgggagctgcatcccgcttctagctagggttttggattttttgggaattcttttttagctaaaaattctttttgcaagaggatgccctaacagagagaaaacaaacggtctgttttgatacgctctctctcgtggcccgatcttctggtgagagggataactctcgctttgatcgagtgcgacgtttgcgatgtggctaccatccagaataagtctaggacgccgtgcaatcgctacactacaaacgatgtcgtaccaaccgtgacgcgcggttgatcatccctgcaatgcaaacgagagaacactgcaagaacaagataagatgcaatataaatattgcgaataggtgattaagcacaaataaatagttgcgattgaagtggtagatctaatcgacccggcaaatcaacacaccaactattgggggctctgaatctatagtcgccgactaatcgagcgaggactagagacaaggtgaatggcacttggcaaaattcaactaaacaaaacccaaatgtttttgaggatgtacaaagctatttatagaggaaaataaagctagggttaagtgctaattcgtggaggtggagggagacacttccgagatgggcctagtctattacaaggcccaaggcccaagttcggtttcagcaacaatactgtcttattttggcgattcccgttgactcgagatgaatttggacatgagaccagatgcgtttgaaaggtagcgagataagctttccacgaagtccaagatcacccaaatcggagttggcatgaaggtgctaggtccgtttgaagtcagtgctatctccggaggctgaactggacttggacttggaattatcattggagcgtgtgaagttatgagcgtatccgatgaagtgatgtcctcatcatcctccccttcttgaattggagttgtcctcgactcaatcccatcttcttgattgtgtgcactctctcgtccattggccatccttggaggtatctcatcgtgaaaaacatcctcatattcctgcaaaaggttagtaatagcgggtggcaaagaatataaagtactaggagcagtagccaatgtgagtataggatctttgcaaaatagagcatagcaagaagaatctggctgatctagtgcacaaatattatatttagaagccaacaaagcacccttcaacttaatttcattctttgtggtacttggttctattttactagttgaagcaggatgtttagcaataatctgattttcacttttcgctttcttttcacattcaagtcttgcaaaatcatctttcaaagcagcggctggagtcatagaatgcaaaacaactcttttaccatcgaacataaatttatatgtattagtcctaccatcaaaaacaacttctctgtcatattgccatggtcgccccaaaataacagaacaagattgcatatgcacaacatcacattcaatttgatcatggtaggagcctatagaaaaaggtattttaaccaaacgggttaccttcatcttaccacatgtattaaaccactgaatatgatacggatgtggatgtggatgggtagtcaagccaagcttcttgaccatctcttcacttgctaaattgttgcaactcccgctatcaataatcattttgacggtatggcctttcacaagaactttgctttggaacaaattgtgacgttggttttgctcttcacacttctctttagcactaagtgctagcttgacaattaggctaggatactgatctagcgactctggatgcaaatggactttctcgatgtcatcattatcttgtcctcctgcgtggttagtggtagctaaagcatattcatcatcacaatcactagcagaagtatactcaccatcagcattcacaaatagagctcgccgatttggacagtcacgtgcaatgtgtccaatgccatggctcctatgacatgtagtatcacgggtacgtccagtggaaactactgaagtttcactcttggctggagtctgaactgaagcatttttgcttgtttcttgagcatgggatggcgtggaggtaggtggtgtggaagaagctggacgaacggcagtagtagattgacgtggtgttgactgtcgtgtagaagtagcacctgcaaaagaactcctatgcttgttgcgtccctgcacttctctttcagctttgcaagcaaaatggaataatctattcatggtattgtattctttatattcaagaatatcccgaatttctctcttaagacctccatagaacatagaaattctagcatcctcagtttcttgcaaatcacagcgtgacaaagtaatcatcatctcttgatagtatgtttctacagaattgggaccttgtcttaaaagttgcagtttatttaatatgtcacgagcatagtaaaaaggaacaaatctagatctcattgtacgtttcatatcatcccatgttctaggtctaagtcctctaccacatatatcattccaccatagagatgcaaaggaggtaaattcactactggcagctttaactttcttattatcaggaaaatcatagcaggagaatttttgctcaacagctaactcccaatctagatagacagaaggctcaaacttaccatcaaaagaaggcatagtaaaattttaccttagataaaggatcatctttgtccctaactcgacgttgtcttctatttctaacactctcgtcttcctcctcatcatcagcaacagattgctcttcatcttcattgtcatatctttggtgtcgatgggcagtggcacctgcaccttcttcacctgcagcctcaagtaaaccaatgcgtcgcacaatattttcatgtccaatattcatattctgaatgttttcagttaattgtttatgtgattgattcattttctcaatttgatccactactttcaccaggctttcacttaaggtttttaaatgtttatctgtgctttccttgtatgatttactattacgcatcaactcttcataccaattttccatgcccttcagtttatgcgctagattctccagtgttggttcatcggaacttgtacctgacatcgttagcaagcaaaagaaactcacaagaaagtgtcagttcctaacaatctatatatatgtggaggttttgaaggcactcaacactcaagcatataccaaattcttataatattctcaatgaatgcaaaaactactgtggctggttcgtggcacaatgacacgcttgatgagtggagcgattgcaaagccgaacctgtaaaggttactagtatgtggatcttggtaggcttaactatatcacaaggaatagcataaatcaaacagaaatgtgaaattgaataataatccaaagtactagttaaaattgctggcgtagcctagactcaatcttagcttaagcaagcaaatgatcacagtcggacaatccacaactcgctatagtaagcaactctctccaagattccaacaaaaaaaaaattccacactttctttttctggttttttttctctttttttttctttttctgattttttcttttttttccttttctgattttttttcccatcgtctaccatacagccgaaatatttttttttcttccatcaccaaacattagttttgagccacgcaatttcattcagcttttgctttattgagttttgatccactgtcgagtcaagtgctggtttaagctctagattagtcttggtttgagtttgcaagtgtgcgtcgccaccgtagagaaagttgcgcagaagattgataggtagcagattggtttgcgagctgaggttctgttcgcatctgagacgattattttgttatcggttgcatgtaccagataattagggaaattttgtttccttgttattccctccgagattttatcgtgcaaccaagtgaaaaaaaaacccagatatatttaccatactttaaaccgagcaattttactgcgcatgtgtttccttgatggatcagctgcttatttgattaagtctctccttgatttcatgggcatgcatgggagaagttaattctgtaccgaatgttagagcctagctttcctgtacgtgcttgcagactagcaggttttgctatttcgttcttttagtgtgagtttgctgggtggtctgtaattttttttttttgcccagctattttgtgtaatagctgtcgtttgttaaaaaaaataaagaaaaggcagaaggtgcaaaaaaaaaaaagagaaaaagagccccaccaaaaagaaaaaaatcagaaaaagaaaaaaaaagagaaaataaattacaaaactaaaatcctcaccaggcaactaaagctctgataccaactgatgacgctctctctcgtggcccgatcttctggtgagggggataactctcgctttgatcgagtgcgacgattgcgatgtggctaccaaccagaataagtctaggacgccgtgtaatcgctacaccacaaacgatgtcgtaccaaccgtgacgcgtggttgatgatccctgcaatgcaaacgagagaacactgcaagaacaagataatatgcaatctaaatattgcgaataggtgattaagcacaaataaatagttgcgattaaagtgatagatctaatcgacccggcaaatcaacacaccaactattgggggctctgaatctatagtcgtcgactaatcgagcgaggattagagacaaggtgaatggcacttggtaaaattcaactaaacaaaacccaaatgtttttttaggatgtacaaagctatttatagaggaaaataaagctagggttaagtgctaattcgtggaggtggagggagacacttccgagatgggcctagtctattacaaggcccaaggtccaagttcggtttcagcaacaacactgtcttattttggcgattcccgttgactcgagatgaatttggacatgagaccggatgcatttgaaaggtagcgcgataagctttccacgaagtccaagatcacccaaatcggagttggcataaaggcgctaggtccgtttgaagtcagtgctgtctccagaggccgaactggacttggacttggaattatcattggagcgtgtgaagttatgagcgtatatctgacgaagtgatgtcctcatcatgtttggttggagggagtttttaggagggattgagagtttagagggatgaggctattaactattttgtttggttgggcgacatggtaattttggtgggatgggatggggaattgaggaatgaactccctccttttcaatacctgggtaggggcaggtaattgggagggaattcctcctttacttcgcctaaacaaatatcagccatccattttcattaatgatctaatctccaactaaactccctatcaatttccaccacctctaccaaacaagagactgggatgaaaaatcaaattcccatcttaatctcaccatcaattcccttgtataaactcccaatccccttccctcaagttgccaaacaagccgaaatggtaagccgctcgcgtagcacagcctggttacgcaaattggtttactctctctagctaaaggacgtgactagacagctaccggtcgttggtttgtcttatccagcaaccattccatccggtataaatcccccttcaacttaaatcacatattatttttaagatatatttgtatcattgtactccactcaaaatatgtgtcaaaacgagatccatactgaatatattcaaacattttattaatttaaaagtaatttattacatgttaggaagtaacttctatattaccaggaaataacttttacatcttatacatgattaattatcattagttacttcatcaatattatttacaatccatcaaaagttttatcttcttttctcatactacattgaaaacaaaagtgaaaaggaaaaaacaatcaatgcttaaaatagatttatagaaagatacttcttaaccatgcaaaagttacttccaattaacattgtagttactttaaaaattgttaaacttacttgtgctgattaaatttaatataatttaatttctagatatatagagtcatatttttattcctacaacgaatttacttctaatgtcgtgacaaagttactttatttttgttttatgttacttttataatatatgtaaattacttttaggctttattgaatttacttttatatgtcttaaaagtaatttagatatattataaaagtaatttgtattttttcatcaaaatataatcatgtgagatcttgttataaagatttatttctacgaacataacggtgtaatcggatcgtagatcggatgagtagtttaagagaaaattttatttgaagcataggtggttcctatttgcttggactaatattatattttcagtagagtaatggcttcagtggtgtcacgctgtaggagtaaaccgagaggcttcttggtgtagattttgcactaattaaagtgtgcaacatcaaacattccagtgatgagtcacggtagttagtcctgtttgcctccttagcaattgtgtggcactagctaagctattattatcagtgaaaaatacattctacatctcgttatgctggtcgaatcgaacgcatacgaaaaggtttcgatttcagcactggtatatatgatctcgtcgtatagttcgagcagacgaagagcttcaccccaggccttcttctccacacatttgcctgaatgatctgtttcagcaacagcaatatctgcttttataccacctgctattgacacttgtatttcaagttagtcatagagccagacattctcgatgctttccaagcctatatatattaattacagtatttaattagcatctcagtggctcagtgtcacagcattgtaaatgatacttctatgacacaaagcattcttgctcctatgatagttttatctatggcattcatataatgatcatgccaaatcataataaataatttgagtttattgacccgaaacaacaactgcatacgtcgaaagacgtggttactccacagtggttggaaaagaagtaaagtgtattaatttgagaatttttcttggggatccccctattacatggccttatgagactatttatagcccttattacaggatcttactactagggttttagttatacaggggaatttacatggttacccttatgaaagggatatttacatgggtgcatagtgtaattgaggttcatagacctctgatgggtcgtcgggcgatcgtcggcccaatcgcccctaggattgatgagccggaaaaggcttcttcggccctcgcgggggcgaggttgctttggtgaagtcgtctcccttcggcatatactcttcgccctgcatccttcgcgcaagaggcctctagcttggcagagtacccgcgcgatccctcgcctctcgctgtccttgttccatagtcttcgccatggggggacttcgccccgactaactttgacgtctcggacttgaatcctcactctttacatagctttcggtagattttggttgaaaggcctcgtgccataccgccaacaatatatatggtgcggacacgctataagtacatacgaagcctgaaaacaataaaattttaacgagcattttgctgacttgtcatgggtcagggcaaaagccaagtgttgtccatctggctccatcgcgctgtcgagggccatgtccaggtacaagttctgtgttaattatatgtatagcaaaaaaatgatctcttgacaagttgttgatgaagttttttttttttttatggatcgttggttattatttttagtacaacaattaaggtggcttcatctcatctgtggtacacatttcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggtcatatcaggcccccccgggatctttagtcccggttggtattagatcgtaactttagtcccggttggtagtaccaaccgggactacagtcccacccctatatatatgtcttcttcctcctccagctgcccgagtaagcttcaaaatttcttcaaaaaagaggggaggtcatgccaaaatttctattgaatttattttggtgattaattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggtttatgccaagctataattgttggacatcccacggagagcaaggtgttgaaatggaagaagatgaagttgaagacgacaatattccggactttgctcagtatgttggatttgaaggaaatcaaacgtgcgaggaggaaatagctgctgatcgtaacgacgttgcggatgatcttggtcagatgttgcaggacgccagggaggactgcgaaagtgaaaaggaggcccaaaaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccttgtttgcaaagcactacgatacaagattagacgggacgatccaggagaagttgacgggcagctaacaaagaatagaattcctgctaaggtgatgtggtatttccctataataccacggctaaggcgtttgttcaggaacaagggaaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacatatcttaagcactgtagaaaggttgtatacatgggtcatcatcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatataaagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatatttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcatttatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgttttctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagttccttacatcgaggagcacttggctctagttcacgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagaggccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggaaatatcatatgtatgttaattagagtttttaacatttaatttactagcattcatatgctaattataattgactagaggattttttaaagttttaaatcacgcaagtggcaatttcatatgttaattagagtttttaacatttaatttactatcattcatatgcaaattataattgactggagagtttttaaaagtattaaatttaatatatttttaaaactattattcatatattagagtttttcacaatttaatttactatcgttcatatgctacttatatatgactattcgaatttttaaaaggtttaaatcatgcatgtggtatttacatatgttaattagagtttttagcatttaatttaatataattcctacgctaagtatatatgatgattaaaatttttattaattttaaatcatgcagtatgtacatacatatcttaattagagtttttaccaatataataatatcattcatatatatgctaagtatatatatatattggagtttttattaattataagtcatatatttgcttattacgatttatccacttaatttattacagacaaaaataatttttcgaagtaattgtcattaatctttgtactttaaataatgttaaggcattaacttctattttataaacacatatgtaagcgaaaatcatatgcagtgctataatctttagtcccggttcttaaccctaaccgggtttcaaaagaatttcgaaatagcgggagtaaagatcttttctttactcccggttgttctcaacaaccgagactaaagatttagtcccggttgttctcaacaaccgggagtaaagatccgggggtgtatatattcctggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcatcctcgccgccgcctccgcctcctccgctgccgccgcatctctggggtgagagccgccgccgccagatctcccttcatctcgatctctccgatctcgatctctctccgtcgcgccgcccgccacgagacgccgcgccacgacgacgacgcgccacgccgacgccgcgcctagccgccgccggcacgccacgccgccgtcttcgccgccgcgcgcgcaatgccgccgccggcacgccacgccgccgccttcgccggcgcgcgcgcaatgcggccgccggcatgccacgccgccgcgccaaccgccgccctgatgccgccacaccgccgttaacgaacgagaacgagaacgatcgaacgaacgagagcgagaacgaacacgtcaacgtacgttgccgcgagaacgtgaacgagaacgagaacgatcgaacgaacgagagcgagaacgaacacgtcaacgtacgttgccgcgagaacgtgaatgagaacgagaacgatcgaacgaacgagagcgagaacgagaacgatcgaacgaagataagcgagaacgagggaacgaacgtgaatgagaacaagcgaacgaacgtgaacgagaacgagcgaacgaacgaggacgaacgttaacgtgaaatgcaatatatatatatatatatatatatatatatatatatatgttacttcgcatttatcataatacatctttttatatcttgcagaaaagacgtgttgtcggagtcgtccgtcaagcctgagtggaagagctagccctagaaggaattagagcagtcaagtgacgtaataatataaatgattgttatatttgtaatgcaattaattaagattattagacctgtaattagacttatcatataagattgtgtagtgttctaatattatttgagttttaatataagattattttgttgaaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattaggtttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtatgatacaatcgcggagggaagcagccagtactagaatgaagaagaggggaacgaggatccaaaccagtacttgaacgaggaagggaacgtggagagggatgcggaggggaaccagcaagggcacgtggaaagggatgtggaggggaaccaggaggaggaggctagtggtagtcaaccctccattggacagaagagggcacgtgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggatgagttcgttgcatataagacaggtgaacaagggcaggcgatgatggaaagaaacaaagaaaatgccgccaagaagaagtaccatcaccacttgggttcaggaggctatagtgtcgcgatgccgaagtgggagcagatggaggctagcttgattgagaggggtatcgaaccggcaacagccaattggccgaaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgaggtacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccaacaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaggcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaggggccccccagctccaccgcctgcccacataagggcaacgaagaaggcgaaagttgacgccgccaagaacaaggacccggggtacgattgcacgcaagaggagcttgacgcttaagttgcatcagaagtcaagagacaattcgagcctcgaagtccagaaaagaagattcctatagaccccagtgtcaggaacttcttcaggggtatgtctgcacctgtcaaggaggccatcaagctatcggactatgagcgaacgctgaagaaagcatcttctggaaattccaaatcagtccctcagcttagagagcaactaaaccaggagatcgagccgttggtgatcggggaagacatgacgatagaagaatttattattgacaccggtctaactacggatcaattgctaggagttgaaccaatagaaaaggcggaattgaaatacatgtacgaactcggtaaaccgcttgtcaagcccgagctggtgcagtccctacccacaaaaatgtacaagttccatcagctgtacatggagatgagcgccaccggtagagagatgatcggagcgaggatcagggacccagacttcttgcaaggagatgatattctctggatcaatttcaagggaatctacgaagtataccagctggatgccctcgacgtctctattatgagttgctggattttgtaagtatatcgtttagttataattcttaattactacgtctcctttaattaattaggtccttgtatataagtagactatataaaataaaatactcccttttatcgttgtagaatggtgattcaaagggcccgacagcggagggttttcgatactggattcatcgactctcggagagtaaacgtcgcaatgctcgaccaatatccgcaggaaacagaggacaatctcgtccatctcctgaaggcgcagcattacaagacgttcatactgttgctgtacaacacagagttagtataattttactgtcttcctacttaccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgttttacaaggttttcgaacttatagataggtactggcataagttcctctgttaattaagaaattcttattatgttaattatttctattacgaatcatatctttaaactccatgtagggcttggtatcggttccgtcatttcgtccacggcaactggagtgaaagacttaggcggaggttcaaatttcctgtgagtacacatgctctacatttacatttctccgattcaaattaatacatacaagtgtatattaattagatctcacgccgttaatttgtcatttatttgtagtgcgcaaagcaaaagcagggaactaacttgtgcggctactacgtgtgtgagtattgccactgccttgcagaccaaatcatcaccacaagagagctcgatgtacgtacaaataaattcaaattttcattacataacgatttcttgtttaattactaatcaatttcatacattcatatagtttattcgcatgagggataacctgatcacacacaaggaatttatcgcggcggttcaagaacaactcatgggattcatcaacgaagaaatccttgatcccaagggtgaattctactacgacagaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtacatatgtactgaaccatatatacatataatataatataatataatatatatatatatatatatatatatatatgtatgcatatatatgtattgaaatatatatatgcatggtttatatatatatatatatatatatatatatatatatatatatatatatatatatatatatatatataaaccatgcagcaacagggccatgcaaaaaaaaaaaaaggtcagctcgatctttagtcccggttatttcacccgggactaaagatagcgatctttagtcccggattggtactcccggtttggaaaccgggactaaaggggggttacaaaccgggactacaaagggtttctccaccagtgctcccaatccaaattttactttggtttttgctcttgtttggatgaatcttaatgtcaactcatcactcatgcatataaggattttcggtcatcctcctggcctttgatatatatccatgggaactactggagaaaggctctgtagtctcggttgggaaccacctaactacgaatctgggactaaagatagacatttattctcaaatcacaataacattctcatcctcaaatcacaaattgaatgaacaaattattctcaacaaacaatcatcacatatcatctcaacaaacaatcgttcacagattaacaaggaaaaaagataaaaaaaaaggaaatacgcatgcgcgccgcccccccctcctgggcgcgcgcagccctgacggccgccgcctaccgtcgccacgcgcctccccagcccgaccaccaccgaccacttctggcagccgctgccgcatcttccacggccaatcccgcctgctccggcgcacacaggctgccaccgccgtgcgccagtctctcactccttgatctaaggcagaagaagataggataagaatgccgtaaaggataagagagagaggggagatgagaggataagaacggtctgctgagagagaggggagatgatgagtttggaggataagccctagggattatatattgtatatggatttttagttccagttgataataccaacccggactaaagatcgatgtttagttccgattgataatactaaccgggactaaagatcccaggccccctgagaaaatctgacggtaaatgaaccgggactaaatatgatccttagtctcggttggtaacactaacagggactaaagatcatcttggaacgatagagttttaaaccgggacaaaaaaattatctttagtcccggtttctattcaaacctagactattgtggtttttggtcgaccggggaaatatggtttctccagtagtgtcagttgcagatccatatacatacatgtaccatgggagggcaaaactgaatagatttgtgttttttagtccatagcaaatgtgtagttctatttgcacatatccccatatataaatcagtttgtactacttcctccatcccagaaaaacacaacctaggcaaggatgtgacatctcttattacaatgaatctggacaaccctttatccagattcgttatactagaaaatgtcacatccctttctaggtttatttttttttttggaacggagggagtatgtcataaatgttgagcttcctctgaaaggactcttaatttcgaattgtaacaagtattcctttgaaattgtgagctaacaaatttgttttatccctcgcacatgaagttggtttgaacatgagatttggtggtgacatactaatacctatacctgtttagcgatttttgcatgtatttagaacttgaaaaatgtccaaatacccccctaaactttatatggtagtccgtctagcatcctgaactttaaaaccggatatccaacaccctaaactttaccataccatccatattaccccataagatggttttggatgatagttttgcatattttggaagcttaaacaaataattttttctaactaatataacatatttggatatcatcagttataagttatcaatttatttttatacagtagtgtcatactattattatgttgtaagtgagagctaataaggagtaaacagaaagatttaagtcaaaattttaatatatatgtccaaagcatatgacatgtgatcaaactcatccaacttatataaacggtattataaagtttagggggttgaatgtcctattttaaagtttagagtgctttacggacttccatccaaagtttagagggtaatttggactttttccttagaacttatatgtcaggttttcacttattcgatggttttcatcatctattccccgctttaacacatgcatggctcatatttttctcccgcacacgtagaattatttcaaatttatatttgaaattaacgtatttgcatataatgtctattttgttattgttgatatattatgtacgaaagaaataaaatgcatccatgcatgtatcgaaaagatcagcatttgtcacttgtgacaagcgtgtactttgtgctagtacagatcgagtatcattattggacttatatctaaaattaatgcatattatcatgacattcactttgtgcttgttgatacattatacacgcatgaaaagaaactagcgattaatgtacaaacgttgaagaaaatatcaaaatatggtgtttacagtaaaactgtgatcttcagtcctcacaataatataaaaattcatcacccataaatctgccagtagacccacatagaaatgtgctacgatcttgggatgccaccacaccccgctgggccatcagatttccaccgtagctgcttaagtgagtacatttctcaccactggtggcaattgaatatctaggaacatatgaggtctacagcggttgctggtaggctggaatgccacacttttgtggtacaattgcacttttgaggatgcatatatgtttttttttttgaaaagcttagacgtcaagagcattgctggatatattggaagggaatgattggtttaagtacaagaacaaggcagatctctggtgagagccttgaaacatctaggaccacctaaaaaggaagccagacaagaacaaattacaaaaggtctatattttcctttatcaagaaagctacttgggtcgctgattgcgatctttgctggaaaatccatcggtttcgctccagccaaacatgccaccaagtggttaacagggttcctatgattttcttcttttcacttttaggcccaatatgttccatctccactaaaaatagaatcccaaaaattagttagtaaccacgtatgattggatgggcccatggttggtaccgattttttttttaagaagcgcgtggatcagatcagatcagatcactcccctgctgtgctgccatttctaaatgccgcgagctcctgccactgtcacataaacccaccggccacggtggtattgacgaatgatttcacatctaatgtggagaaatagaaggcccagttgatcctctacacggccgtgtcatgaatctgtaggttaatatcgtaggcaacatgttaggatgctcttgtttcgatccgtcgcacccgatgaagggcagttggtgctatggatggagggaaggcggcacgggagacgggcagatggcggggatggaggattggtgctgatcccatggaaaaccataaccgaaaccgacgaagttaatacggcagcttgggtgcagcgttgtgctctagttagcacgagaaagaagactgcgcgagaaggggtaaaaggaagtgggcaaaaaaaaaaaggcccaaatcctaaatgggattggccttgattttaggtgtaggtaaattttgggaccatgattgaaagtctattggaggcctaatgttaaccaaagtctcaaaatttagtcttcagtaacatatttgggcctttcttggagatgctctaaagttcctctaaaatcattctaaagatatgctctaaagttcctctaaaatcattctaaagatatactccctccgtccctaaatatttgacgccattgattacataggaccacataagagctgcaagtagtcaatgtgtcatcttttgctgagctggcagcttgcataacaataggtcatttcgatgtagacgttctggttaagaatatcatcttattgaatcctatttacaagatggcagtcgggctaaataagaaaataagaaaaaaaaatcaacgatcaagaaagagaagactctaaatatattacgtttagctgtcaactgaggctgagccactgcgtcgatagattcactccaaaactgctcgttagccactgcagtctgcagcatacagcagccgccgtggaagctgaacaagagttatcgcggcacactagtattctgctatgctactgcctactggcttctatgcagccacgatcacaggatgtagctttagacagacccttcgttagttgcttttgtgagtatgtgactactcgagcttaaacatcagggtagcagatcattgaagagatctagcaagatgcctatccatttctagtcgtcccaatacttcacatgcctatgttttttttttttttggatcaacatggagaactggtcagagacaagttccaatatgggggatatgtcttataggtaactttctcatctgaattactgaaattagcgagcatggttgtttttatagatgaatggactgcttctatacatttatagtagatgaaactatttattgtttcacatacccctccgacttattaaaattttgaccggtaaatacacaagtgattaattagtcgttaactttctgccaacttggaatgatggaatggtttgcacctctcttttctctggtcttgcttttggataggcagatatctctactattaaaaaaattaaagatgttattgccggtactttggtacgtcatttgtgtatgagtcggttttcaaattcgttaacttttggaaatacatatccgtatttgagacgtttattaagtccgtttacatttggaaatacagaagaagagccgtataagaaatccctttaaaaaactcgaatgctaacttaagatgatcggactctaactgcagctcatgactttaagcgaattctcatggtgaatttcaccttaattaaaccgtataataataataagattaaaatagccttcacccgtcgcaacgcacatgcattttttctagtctatatatatgtctaatccttttaggaatggaaaagagattgaactaaaatccaaaccaatccaaggtgatctttgaatcataaatacagatttttaacccttgaagatgaagtgtagatttatggccagtaaccagtcaacgacattattgcttcattctatctctgacaacatggtaactgttcaaacaggagttaattaatgatttgttaatttacagaaaattaactcagtcacaacgtgaaaccatgacaattggaaaacacaaatttagtatatagcatgtgtacaatagggcaaattcaaattaaatgacatttctcaactcaatgatattggcaattctactgaagagatgtgtttcccaataattcagatagcttcctcttgagggagcaccaatgctagtgtgcttgatgtaggtggttaactgatagcctcatcattgctgattcgaggaataagtaaaataacatatttgcaaatgaaaaatagtctatgaataaaacttttatatacgtgttcttaacgatctaaaaacaaacgctgaaaaataaaccacaataaaaaaaaatcccaaaatcaactctaaatttatgattgaaaatttaaattttggctaataagtataggcataagcaaaaacatgaggccgtttgtcagtcttgttcacaaaagggtgtgatcactagcaaaggcacatgctccgtcatcgtcatacggtccattttgctgataaaaatggaagacatgatttccactgatttgatctacagaaatagaaagtagtacaaatatttgttgccattaagcagaacttctcccactgttcaaatctgagatcagcaagaggggcagaggagcaggggaatgtgtcctctggtctacccaagaacagagcaggagccagcgtgagatttcccctgcaccagaaagaccaatagaaaaaaaaaattcagcaaaacaaccaaacaaacttcacagtcatgtcgccaattatttcttgggaggaatcgtgtgatactcggatagagcttttcctactttcatagtgttaatatttacactggaaactagaaccaagttgattctccaatgatccaattaacgagagttctagggtaagttgtgtacagatcgagcagctgaactcagatggcaaaatagacgcaccgaattactagctaggtgtgtgcttcctgattctaattggtgattgctctttcggcacaaaaaatgggatggcaacctgattgggtatctaggctgtatgatcatactaggctttcaagaaactaacttgactaagactaatgaattcgtatatattcaaagttttctgctttttctgtcatcaccattgtttattgcataaagtttccgtgtgcctctgaataagtacagtggcataccttaatttagctagaatagttcacagtacacaaaattattgatattatattcgtgtgccgttccatagaaaatcactcctatgcaattgttgcatgggccatcaaaattttgtgatcaatgcctttggaatagactgcataacagcatgggagaaccttaacagctgcattgcccccatgttaaaattgtagtgtgtacaagtgtaactacaaaatcgtaatcatagtttatttggattcataaagagaatcttcactacaacaactggaaagatgagtaccagcacaattttactagtttcaggaggtgaacttcagtagtatccatccatttcctcagttgatcagtgcataatatttttctttgatggaaatgatatcatagtaaacatcatccattgtcggtcgatcttttggtgatgtctctgtgcacattagcccaagcttggccatttgtatggcgcatgttagtatttcaggcacaacatgatttgggtcttcaccttcacaatattcggtgatagtaggatctaaaatgtcactgatttgatccggaaatgccgactccacaaagttgtgaaggtccattccatcttgaaagatttcatcagttggttgctttcctgttatcatttctagaacaataattccgtaactgtatacatcaccctcagctgagaccttgcatcccaagccatactctacaatcaatattgtgcaagttaataatattcattagtcagtcaaaatatgatacaattttgcatcacttccttggtagagctagtggaaacaatagataaaatacaaataacaatgaagcaagtgctcacctggtgcaatgtatccgattgatcctcttaatccagtagtgcttgatgaattattgaggcttataaagttgttgtgcagaaactttgcaagtccaaaatcactaatacaagcaaccatttcgtcatccaaaagaacattgcttggtttcagatcgcagtgaaccaaaggaggagtgcatcggttatgaagataatccaatgcagtggcaatgtctccagctactcttacccttgaagccaaactaaacagttttggggggctttgactgcatggttttggatggatccagctttcgaggttaccattcgctctatactcaagaattagtgctttaaactcgtttcctgatggatcaaaggttgaacataagccaattactcttacaagattccgatggcgaatgcttttcagtgcctcacattcagcagaaaaactattgggtgctccattttggtcaagtctaaatactttaattgcaacatcgcgtgcaccgaacttcaattgacctttatataccaatccaaatgttcctgaaccaacaagacttgttgaagagaaaccatatgttgctttgtacagatcactgtatgatattttatccaaacgcctgaacgaatggttaatgccgattctctccggtccagatctcttcttcagaaacatgatggcaacacatgccaaggtaatcataacaattgtactaactggaactaccacagtaagaatataggatgtcttccgtttggctgacagttccttgcaaagtggtaactgtaacattggtgaacttgcacataacattttatttccttggatgaacacatcgctagaatttgcaaacacgcctcctttgggaacaggtccctcaaggttattgaaagatagattgagagagcgtaaagatccaaaagactcaaaatattttgggatttcaccagacaagttgttttgggaaaaatcaatctcaattatgcctcttaagttaattagagattccgggatgcctccttgtagaaaatttgcctccaagcgaactgattccaaaacaaggcactcaccaagattggaggggatctcaccagataattggttgttggagatattaagagaattaagattaatcaatctaccaatctccagtggtatgtgcccagtgagttgattataggatatgtccagacctttagaaagtgtagaaatcgaaaagagatctaacggaatgcttccattgaggttatttcttgaaatgtttagctcaaccaaatttgtgcatcttgctaaacttgaaggtatttgcccagttaattcattttcctgaagataaagttcaatgagctgctctagtgtgcctattgatcgaggaatttctccagaaagcttgttgtgagataagcttaggatcagcaagtttggaagatttgcaattgtgctgggaatttgtccggagagcatattattacccatcagaatggcagtgagaccagtgaggttttctatttctgaaggtatgctgccagtcaactggttctgtactagattcaatatctgtagtccttttgataggttgccaatagaagtgggaagtactccttgtagattatttccacccaaccacaaattttgcagttgggtgcagtttgttagtgaagacatgaaagtccaatctccagactcaagcttattgtcacctagatctaagtcagtcaacatggacaaggatcccaatgaaggaataataccagtgaaggagttgcgtccaaaataaatctctgtaagattcaaagcattggctaatgtagcaggaattggtccttcaaactggttcccatgtagtatgaaactagtgagtcttggaagggtatagccaatgttggtgggaattctcccaacaaatcggttgtcaccaaaattaagataggtaagatttgagattttaaatattcctggtgaaataattcctgataagttattataacttagatctagtaattgcaaattagagagttttcctaggctctctggaatggtcccttctaagttgtttccagaaagcatcaacttagacagggagagaatgttatcaattgagttgggaatctcgccagagatgtaattattagttaagcaaaggtatcgcagaaccaaagatgtttttgagaatggaggaatagtcccggatagaccattctgtgagagatctatgtaagttatggtagagctgttgaagagagaagggggtatttccccaacaaggctattattttggagattcacccatacaagtgttttgctacttcccaaaagtggaggaatggtgccagtgagctcattgttaggaatgaatagtgcagaaaggttgggaagcaaaccaatctccgaaggtatgcttccatgaatatggttattgctaagaataatttgctgaagaaatgaacaatgagcaagacttggaggaatcttaccttcaatggagttgctatacagattgatggtttcgaggcgagaacatgacgataaagtctctggtatttcaccactaagtgcattcacgctgagatttagatacctgaggtgtgttaaacggccgatctcaggtgaaatgtggccattgagttggttaccaggcatgtgaattctggagatgaaactgaggttagcaacacaaggaaatatttggccggtgatgttttctgactcgaggtctaatccatctactcgagctggaagccctgtgctgcatgtaaccccatgccaatcacacatcgaaacactggaatcatttctccatgagcctaaagctccagaggggtcatggagctgggacttgaggcagaggagagcctgcctatcagcattggattcgttgtgaaactgagctgacaagcagaagggaaggcgcaagttcaggaaaagaatgaaggctagcactagcatcggtgtgatgggtttattgagagctaagcgaaacatttcttttgatggaattgatgcttgaagactgaaccataacggaagggttagcatctatatataggacaccacgtatgtgtttagttcacggcaaaattagaagtttggttgaaattgaaacgatgtgatggaaaagttggaagtttatgtgtgtagaaaagttttgatctgatgaaaaagttgaaagtttgaagaaaaagcttgcaactaaacaaggccgtttgcatttgaagtgaacgttttacagttccaccattgttgggaacttcttttgcaactagaaccttagcaaatctatttcaaaatgtagacgtaattaaattgttagaacctggacctgtgagattaatttgatgacgtatgtgaacactggcgcatgatatggtgccagtgcagacaatagcatataggacgatctttcgtggaatatactctgagtcccaaaatgaatgaatttctatggtttaaaatttatccgaataaaacttatccacctactccttcatcttatccgattacaaacatccccgtttcttaaccattttattatctgatgctttaatttcataattttttcttacgattacactacaggcgcacaggcgcacacacattactacgcatgcaagattatactcacacccccctccccgtaaatactgccctagtcttttgagcctaattagtctatgattagccataagtgttacagtaacccacatgtgctagtggcggattaattaggcttaataaatttgtctcgcggtttccaagcgggttatgaaattagttttttcattcgtgtccgaaaacctctaccgacatccggtcaaacgtatgatatgacagccaaaaattttcttttcgcgaactaaacacactctaaaaaagtggatggaggtctatctgataaaaaataatgttctgaaaggctaaatttcattcggtcaaagaagacggctagtataccattggaaaccatcgcttgaccttgttggagtcttgagactttgaagttataccggtcgtcctgacgtccatgtcgtggattcaattgtccaagctgatagtgtagctatcaaagtatcaatgctttcttctttttcccttgtacgtattgatgccgttgatttttttaaatatgtttgactgtttgtcttattcaaaaaatttaagtaattattaattcttttcttatcatttgattcattgttaaatatatttttatgtacacatataattttacatatttcacaaaagtttttaagtaagacgaacgatcaaacatattttaaaaagtcaatagcgtcaaacatttagaacatttaggaaggagggagtagtatgcagctgtcactgcttgcatattttcctatacgttagtactatgtttgactgttttttcatttccacacggggcactcgtaatcaggcccatctggagtcccgtgtacggccgtaaaagttcgagccaaaaatcatgtgtttcaatttaaatcattaggttcaaattaagatatctttatttttgttacttaggctgtatatttagatatagaggtgcaaaattttggcatgtcacatcagatatatggacacatatttgaagtattaaatgtactctaataacaaaacaaatcctatctttctataaagttaaggcccactaaatcctaaagctcaacatgcaaaaatgccaaatcatccactaacaattattacatttcaaacctcatgcaagcatgctaatttattaagttataaagatttaaaatgcaaacatcttaattaaattctcattccacataattcatataatatttcaatatatctctccatcattttttataatatcctatatgcctatatagtgcatcctcacttaaattttagagctttaaaaatccaagcatgttaaatcatcattccacataattctaaaaatatctctccatcattttgtataatatatatatacctatacaattcatcctcacttagttaatgctatttctctcttctctcattatgccatatcacctcaattgtttctatccctccaatgattaatctatgatcagaattatcttcctcattttcttctctcgtaaatccacatcattatacttttacatttagatcatcattctatatactatttaaattatgataaaccacatcaacttattgaagtttctgtcgtctagctatcttacacattatttctatttattattaacataccaaactcccgcagcaaagcgtgtggtttcatctagttacagaatccgcctgtaaaccaagagaagaatttattaagcctaattaatctatcattagcaaatgtttactgtagcaccacattgtcaaatcatggcgtaattaggcttaaaagatttaaaagattcgtctcgtaattaacacgcaaactgtgtaatttgttattttttcgtctatatttaatactccatggatgtgtcgagacattcgatgtgatagggtgtaaaattttgccaggtgtaacaccctgaaaatttgaccacaaaaaatctaaactctaaaaatacggatttttcaaaaactttttaaattaattgcatcatgccgatcttattcgcctattttatttggatttgatcttgaagtttattaattgtgagtaaagaatagttaattaggaataaaccttaaaaaaaacaaattggtaaaataaatataaattaaaataaagattagttgtggataggaataaataaaatattatcgcgaccatatttggatcaattaaatttaaatacgatggaataagaattaaccctaattaaaaattcaaataaattatataaaaataaatatgagtaatattaatctagggagaattcattagttgagataacacaaatattgagtaaaatgcatatatgcaaaaattaggaattgtggaatcaaatttatatgggaaataccctaaaatcgggataaataggaaaagtcactattcattgccccctaggtgttcgaccgcgttccctagccctagcccctcctctgccgcgttgccctcgcgccccgcgcaccgtgcgccgctccacctcccctctaccatcgccgtcgccatcaccgcgcgtgccgccgtcgcctcgcctcccgcccgtcgccatcgccgcctgccgccgcgccgacgtcgccgagccgccccgagcccacgccgacatcgccacccccatgccgtgagtgctgtcgtcccgttgccgcgtcgcctcgagccccgcgcagccgtcccttcgccgcgtcgccgcccgtcgccgtcaagcccgcgccgcgccgcgccgcgccgtcatatcgtcgctgtcatgccatgccgtcgtgtcgccgcccatcgcatcccgccccgagccgcgcgccaccgctgtcaccgtcgccatcgatgtcccgtcgccgcgcgcgtcccatcgccgctgccgcgccgcgcgccatctcgtcgcctcgcgccgccgtcgtttcacccttccccctccttcccctctctttcttcccctctcccctataaaaaccccggcccaatcccccttctccaccccactccattccctcctcctctccctcttccccttctccacgtgccgccgtcgttgcgccgcccgccgccaccttcgaagccgccgcgccgtcgccccggagccgccgcgccatgcgtcgccgccttgcgccgccgtcgccgtcgtcgccgccggtgagccgtctcccccctccacctcgcgcccaccgccgtcgccgcccggggaagcaaagagccgagagagagagagagagatagaaagaagccgggagggaggagagaaaaagaaaagagaggaaaggaggaagtagccgggagagaagaaagaaaagaaaggagaaagaaaaagagaaaaagaaaagaaaaagaaagggagaaaaagaaaaaaggaaataaataggaaattagagggagattagggaagtttagaaaatttaaaataattggaatttaattatagattaattatagtcgtagaattgcaaaatttaatataaattatggattattcttggcaatttctataagaaatcgattcacggtaataatttagatgtagttaataactaaacaaatagatgaattcttatggattattatagattatttatgggtaatccctataagtaatcgattcacggtagaaattcggatttaactactagggattttacccgtgtattatatttaatcatttagtcatagactaaattaaatcgtataatatttctaggattccgtccaatatttagctcgcgatagaaatttctaacctattatatggatataatgctcgggtagattaaattaaaaacttatgataacaaaatatttatacccgcaaaatagtttgaatcgaaattgggtttgccttagttcgcgaataataaagttaatataaagaaatcgactttcgcattcgactttcatttggattcatttggatttttatttgaattctaaccgaattcaaatcaattttcgcacgtaactatagagcccgagggagttgcggatccaagcgaaggtcaagacccgcaagacattgagcaaggcaagtcagcactattccttgatcatgttgatcccaattgtgaaattgttttgtttacaaataaaattgcatgcaatgatgaacatcctacttgtgattatgccatgccttgattattgtttgccccttattccttcgtaaccatgtttacgtatgagtccctagtcaactataacaaatgcttagaaatgctattctagaatcatgcatactcatatttgtcaaatgctatatgcttgggcaattatctttgggaaggtaattgagatgtggcatgtggagacatgagcgccacattgccatgatattgaggacatgatttgtgaaaggagaaataaactaaataactgttttcgattgggcagacggaggatttgggtggtatctggaaaaggctagtaccgtccccggtcaattaaggaccgagtcatgaagttaagcatgaaacgaccctcgtacaaccgcacttctcgtatgggtatagacctagtggagtagatagccgagcggaggcagtatccctgcatagatggttcagccctgagtgaggcaggtgcgctatggtgggacagccgttgaggtagggccgagaggcgtgccctacatcggtgtcgccattggtaggactgccatgagtgtgtgagagagggaacttaacttgagccataatttaatatgtatgtgagacttctctttcccgggagcgccagaactcctctcactgctagaaacatggacgcctagagtgcatgaggatttaagttcatggagcgggtactgccaatgcgaggttatctaaaggctttgccgtggcgcatctcatgtgttgggacgaggctcatgtgttgggcagtcgcggagtgcgggtaaagtgtacatccattgcagtgtgagtaaaccaaatctattcgaatagccgtgctcgcggttattgagcaccgggacatgtattacacttggctagactctaaattctttaacttgtgtgggatgggatattgcatgatgatttttatgccgatggagccacttcctgagaggcaggaatatggacgtcctcagaaaaccataacgactcaatggcgggaagctatccttgggatcacaatggatggtggacagaaccgtcattgtttaatatgaatactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttagtactcacccttgcaaatataatcagaagcgggagatgaagcttcggaggatccctatgcctactaccaggagggagatgaagacgatagcgctcagtaggtcttagttacggtcgttggctgtggcaatggcgtgccgctgccttaactccgctgccttacctacttctgtttttggaatgtattccggaccactcggtccgatgatttaagactgtgcctgtgggcttatgatgtaattcgtactagactctcgtgtatgtgcacttgatatttcagctatgagttcgtgtgtaccagactacttgatccagggaaatggtactgattacacgattgattcctgttataaaaacgggggtccacaccaggggatctgaacagggccttaaagtcctatttttctgcttcattgaatctacggtgcatgctagctagccaccaacgcacaaagaattcagtttcgtgtacgcgcaaaagaattgcacgtcagtatattagaagaaaaatagagttttagttatacaacgcaaaagaccagacaggcccttgcctggtacagggtagagtcctctacgaaggggaaagcggaaaaagagctaaggaaaaccactgctcctataaaaaaagggagatgggtagaaactaccctacgttcccaataggtccccaaatgaagcggtaaccactgaaggatgtactccaacatcgctgagaccggtaagagggaggagtcgaaaaccctggcattccactctttccacagctgctaggaaaccaggaggactagagagtcaaggctcgtacaaagatgtgctggcatgggagccctggccgacggccaccagaactgaagagagcagccctgggagggggcaaactcatgccatccgggggaagacaggacaaggagctagacttatcgtgcgaaaacaagagcgaactatcggcacctagtttatcaacacgtgatgcatcagactcctgagcctcacatgggggcaaccttaatttccagtaccagccccactcgcctcagatacagtatcggccaggaggatcaccacagccccagtatttgcctcaatacaactagctggatcaaatacaacagcacatccaggcggcgcctcagtagaagccttgggcagatatgatagccgatgtgatgagggagcaattcgggctcaagcccaaggatagtgggagcctgtatcggcatccatacccagaatattttgagagagtatcattactgaaccgatacaaggtcccggaatactcgaaatttttgggataggacaatgtgataacatacgaacatgtcagccgattcttagcccaatgcggggaagcatcagctaccgatgctttaagggtcattgtttcctctgtctctgtcaggatcagccttcacatggttctcatcattaccatacaattctgtacaaagttgggccaacttggagaaatagttccataaatacttttatagcggaattcacgagatgaagttgtccgatttaacgttgatcaaacataagcatgacaaatcggttcaagattatatccagatgttcagagatatgaggaatagatgctttagtttggccttgacagattcccagcttgctgatctcgctttccagggcctactagcaccaatcaaggagaaattctcgacccaagaattcgagagtctagctcatctagttcagaaggtgacggcacacgagcaaaggtttcttgaagctagaaaagcatataaaaaggggaacaacattttttgaccgggaaacagtgggcgaagcccccacgattgattttcatttataaaagcagaaactgtacaagaagaggatgaaaaacattagtacatatgtctctgaaacaaaagacgattaagaccctgaggtagcaatggctgagtgggcaagaaacaaaagagtagtcacgtgccaatatgtcaaggactccggaaaggaggaaaaatttgattttgacatcaccaaagccgataggatcttcgatttatttcttcgggagaagcaaatccacctccctgctggtcatgtaattccatcggctaccgagctagggaagagaaagtactgcaagtggcataactcggggtctcagagcactaattagtgcaaggtcttcaggcagcagatccaatccatgattgagcatggaagaatcaagttcgacgaccaaaagaaatccatggaaatcgatggcaatcctttccctgtcaacatggtcaacactggcgaagggatagccgatagaagaagctaccgtcccaatgctgctacgatcatcaacatgtatcagaggaagcttgagagatagaaagaggagagttatggagacagcaacaacttcgaccctcattgggactgcgaattatttagattctgctggaacggagggatgaggctaccctcgaaggaagattgcccggggtgcagtgatgccgacgagaaccatgtcagcagttcaagccgatttcaccccgggaaagaaaatcggtcgatgcagaggaagttgcctgttcatcagagattgggaccggtctatcaaaattctgtacaaggggaagatggggaggatgaagctaggaatcaacagtggtgtccctctggtattttcaccaaaactcagaaaacaagggttcaaaggatgaggagtagggaacggttccaagaggtttatgaggaaattgaccatcggctgaagaggaccaagcaagaatggcgcataaagagtaaaatcgttccagccgatgaggtcgacgccgacaaggcaaaacaggtaagtaaaggaaagaccatcgaatcttcatcggttaacatggtgttcgtgttaccagcagagtattgcgccaagccagcggatgcagaaatactagaggaatccctagcaagattgatcctatcacccgagcaggccgtttttgagaaaccggaaggaactgagcatcggcacctgaagttgttatacgttaaaggctttgtaaacggtgagccgatgtccaaaatgttagtcgatggtggggccgcagtaaacttgatgcgatacgccacattcagaaagttaggaaaaagcgcagagaatctcatcaaaactaacatggttctcaaagatttcggtggcaacctgtggacccccgtttttataacaggaatcaatcatataaacagtaccatttccctggatcaagtagtctggtacacacgagttcatagctgaaataccaaatacacatacacgagagtctagtgtaaattattacaacataagcccgcaggcgtagtcttaagtcatcggaccgagcggtctggaatacatcccaaaagcagaaatagataagacagcggaattaaggcagcggcacgccattgccacaggcaacgaccgtaactaagacctactgagcgccatcgtcttcatcaccctcctggtaataggcatagggatcctccgaagcttcatctctagcctctgattaagtttatatttgcaagggtgagtaccaaccgtactcagcaagccaccacatcaacaatgcacatgataggggtatttcaaaggatggctatggttcttttgcgcaaagcaagttttgtaattattttcacaagcctaagacctagcattgactgatcaaattttagtaccagtgtttatatttaaacaacgacggttctgtccaccatccattgtgatcccaaggatagcttctcgccattgagtcgtcatggttttctgaggacgtccaccttcccccttctcaggaagtggctccaacagcataaaaattcatcatgcaataacccatcccacacaagttaagaatttagagtctagccaagtgtaatacatgtcccgatgctcaataaccgcgagcacggctattcgaatagatttggtttactcacactgtagtggatgtatactttacccacactccgtgactgcccaacacatgagccttgtctcaacacataagacgcgtcacggcaaagcttttcgataacctcgcattggcagtacccgctccatgaacttttcatcctcatgcactctaggcgtacacagtttctagcagtgagaggagttctggcgcacccgggaagggaagattcacacacatgtattaagttataattatgttcaactcatcacatggcactcctatcaatggcgacaccactgtagagcccctgccttacacatcgagaaaccactatgcatggatactgcctccgctcagctatttactccgctaggtctatccccattcgagaagtgtggttgtacggggtcgtttcatgcttatcttcatggctcggtccttaattgaccggggacggtactagtctttcccggataccacccaaatccaccgtccaccccggtctaaaacaagtgtttaatttctttcctaatttcacaaatcatgtcatcattatcatggcaatgtggcgctcatgtctccacatgccgcatctcaattacctttccaaaggtaattgcccaagcatataacatttgataaatattagtatgcaagattctagagtagcatttctaagcaagtgtcataattgactagggactcagacgtaatcatgtttacaaagatttaaaggtgaacaataatcaaggcatggcataatcacaagtaggatgttcatcattgcatgcaatcttatttgtaaacaaaaaaatttcgcaattgggatcaacgtgatcaaagattagtgatgacttgccttgctcaaagtcttgcgggtcttgaccttcgcttggatccgcaactccctcggtctctataattacgtgcgaagaacaatttgaattcaattagaattcaaataaaatccaaataattcacacaaaagtcgaacgcgaatcaatctttctaaattgattacaaagttcgcggaaccgctcatttcaaattgttgggtcattttaacctaagtcattttgtgatttgaaattacgtcctaagacttcatctaattattgagttcttaattacatctgaattactaccgcgaattgatttcttatagagattactaaaaataatctataataatctataagaattcatctaactgtttagttcttaaatacatatatgattatagtattactttacaaatactagattttagttaatcctataattaaattctaatattttaaatatcctaaacctctccctaatttcctatttatttttccttttctttctctcccctttctttttctttcttttctctcccctgtcggcttctcctttcctctccctctcttcctcggctctcggcctaaccgggcggcggcggccaccggacgcgaaaaaaagaaatgggggggggggggggcttaccggtggcggcggcgcaaggcggcggcaacggcgcaaagcggcgacgcacggcgcagcacgcggcacagcacggcggcggcgaggcggcggcgcggcggcacaaaggcggcgacgcgtggaaaaggagggggaaaacggagggaatgggtgtggggtggagaagggagccggggtctttttatagggcgcgggggactgggcggctggcccttatggcgacgcggcgcgcggcgcggggctcgagacacgatggcgacgggcgaggcggcgacgcgacgttggcgcgaggtggcagtggcgacgcgacggcgacgggacgacggcgctgcaacgggacgggcgacgacgcggcagcggcggcgcacggtgcgaggcgatgccgatgggtgacgacgcagcagcggcggcgcgcggcgtgaggcgatgggacggcgcggcagcagcgacacgacgggcgcgcggcgcggcgacgggacggtcgtgcggcgacgggacgggcgcgcggcgcggcgacgttggcgaggcgcggtagcggcgacgcgacggcggaacggggctcgaggcagcggcggcacgtgcggcgcggcagcgggacggcggcagcgacggcgacagcgcgcggcgcggcagacggcagcggcacggggcgcaaggcggcagcggcgcggggcttggggcgatgtgacagcgagcggcgcggcgcgaggcacgaggtgacgcgacagcaacggcgacagcgacgcgacggcgacggcgcgcggcagcggcggcgacggcgcttggcagtggcggcgtcggcgcatggcagtggcgggttagggcaagagaacgcgatcgaacacttatggtgcaatgaacagtgaattttcctatttaaccccattttagcccatttattatttaaatttgattctataattcctaaattttgcataaatgaagtatactgaacatttgtgttattccaaccaatggattcattctagattaatttattccatcttttatttatttctatcccctcacaatccttatttcaaattagaatttaattattcctttaaccaatctaatttcagggttcattcctaattaactattctttattcgtgatctatgaactccgaaatcaaaatccaataaaaatagtcgaacaaaatcagcatgattcaatttatttaaaaagtttttgaaggcccatatttttagagtcttgatttttgtcggtcaaattttcaggatgttacacaacccttcagaggccaagtgcgtttcaaacgtcgagctaaccatcggcaacaagacaatcccgactaccttttttgtcatcgatgggaagggttcatacggtctgttgagaagggattggatccatgcaaattgttgcatcccttcgaccatgccccagagtttgatccaatggcaaggtgactagatagagatcatgctagccgacagccaattggaaatgaagagccccaattattgctttgagggcatcgtggagggttcaaatttctacaccaaggatactgtagatgttctagatggcaaattagggcaaggattcatgttggccaatgatctggaagaagtagacattggaccaggggataggcctaggctgacattcatcagcaaaaaattaactcccacattcagaaccaagcttattgagcttttgaaggaattcaaagattgtttcgcttgggagtactctgaaatgcccgaacttaccgatcaattgttgaacaccagctccctattaaaccaggatatcggccattcaagcagccaccaagaagatgcaaggccaatatgtataatgatattaaggctgaatcactcgattatatgatgccggttttattagaccatgccgatatgctgaatgggtttccaacatagttccagtaagaaagaaaaacgacaaacttagggtctgcatcgatttccaagatttgaacaaggctacccctaaagatgaataccctatgccgaacgccgatcaattagtggatgctgcttcaggacataagatcataaacttcatggatggtaatgctggatacaatcagatttttatggccgaagaagatgttcacaagacaacttttaggtgccctggcggtatgggcttgtatgaatgggtcacaaagagccgtgaatggaaagtatgtgaaaaaatattacccaagtatttggctcaattcgtgatcgactaagctatgccgatgcattatatccgatgtgttaccatcgcctttagatggccaataactgttttacactactagaaaaacaatttttcatggcgttggtctatgattttcgctggcggaaaaatgccaaaaccgccagcaaaattgtaacgagggggtaaggggtaacgatcgccagtgaaaatagatcttcgctggcggccgcgttatacctgccgccagcgaagatatgtctattttctctggcggtcacttaggtgcactaccagcaaagatggataattttcgctggcggttgtgttatacagacaagtagggaaaatacaattattttttctagcggcccacttaagccaccgccagcgaaaatagattttcgctggcggtataaggaccgcttgcatagatgaaccaccatctattaatatggaccacgcggcccaccaccaccaccaccaccagtccaccacctacccgccccctctctccagctcccctccctctcttctctccctcgcgtctctcatccctctcttctccaccgctgtcggctgctctcctctactctctcctcctcccaccccacagtcgggggcagcgttttcggcgtggcgacgacgacgcgaggcaggcgtgtggcggcgacggtaggcgtgcgggcaacgacggcgtcttgggtgtgggcgcggcggcgctcgggagcgggcggcggctcgcggggaggccggatctgccgccgccggccgcgaggtggccagatccgccgccgccgggccacagggaggccggatccgcctccgtcgaccgtgctcctgcggatgatgtgtaaatcattttgatttttttccttttctttttccatgttgttccagatgatgtgtaaatcatgtttgatctgtgctgatgatgattttgtatttcgtgtttgaatttggaaatgagcagcgaatctagatgtgaatttgaaatttgaaattaattaatgaattaatgggcggctacatgggtattttcgctggcggctgggtagctgcatgcgggttttttttttgttccccaaatccattttcgctggcagccaaattaacacagccgccagcgaaaatagattttcgctggcggccgtcttaagccaacgccagcaaaaatggttttttgctggcggtcaataaccactagcgaagatcttgattttcactggccttcgctttttagcggctgcaaatcccgccagcaaaaatccaaaatggccgccacgaaaaatggttttcgtagtactgttatcgcccttagaccaacataatcctttctttttatataattggtacccactaaaaatcattgattgctataaagctcaaaatctgtgaggccacgtcatcatctaataccagccgtccgatcaattaggatgagcactatagaccatttgatctttcctgttctcctcgccctggcccaatcatatgattcagccgagcccaaccaaagtctcgctaagcagttggcccaggtgttgatactctatttctacgtgctgtgcagggcaacgtttcagcttcgtgaaaacggcaagggcatctattacggctgtaatggccagttagatctcagtatctcacactaatttaccctgaaggtttccttttctctcgcctcattacacatccttaaattaagtcaccgtatcatcgtcaagtagatcttgccaaatcgaaccatccgcctaagcctacgtctaatctcattcccagtgtatgtttttcatacctgttcttcgaccatatgacttcatccaattttccggcttcctttctttcaatcattttaaggttccgttaacactacaatgattcgttctttgttgttccatatgttaatgatgcaaacatcgtggcccatatgtgtaagtccgaatacttatgggtgcagcagggatcgactgttctggcatttccgtatgagggttgtctctagccaatggagtccgctcgctttactcatgtcgagaaggggatgggaagcgaggaggctgaaaaaagaagaataagtttgacattacgtgatcgataacgggagaaagattgagttgcaaattactgatgggggcggtactggtggcttcttcttcttggaggccaatttcttcctcttcaaatgtagaaagcatgtataagttgaaggtataaccatagtaagaaggaggaagcagtaaaaagcaatactggttggcgtttcggggggcttgaagtgttttgtgggcttggtggattggctggagatgttggccccgccactctcatttcgcttacatcagcagcagcatcgtcgatggcctcatccatttcctcgttctccaggcactcctccacgtccgggtctatggtcggaaaatcttcgacagcggctgccttctatttctttgtagttttttctttggggggagatttggcatccgacggcttggccctttttctcctaccagtttcaataggttcacgaggtagaccatggagcaatgaagatttcctcggagcattataaccgatgatggagtgagcgagccccccaccgttcggaataatccccgcagcataatttatgggttccccgctttggccaatgtggggaggtaaggagtctgtggcctgcaaaacaaaagaagagattgaagagtcagtaaataagtattggcatcggttcagcaaaatagtttgcgatagaggaaaaacgcttacttgcgggatctgatccgggaacatagtggtcatatacatcgaagccgattggtggaagaggtgctttttccactcgacccgccagcggtcaaaggttgcctcctgatcagggccagctcgatattatcaatgctgcccaatggcggccctggaatattcagaagtctatccatcatgagagccgatataattaccctctagattggatcttgtccacaaagaacaagccgataggtagctgacccagtccaagttgtcttgcagcactcataggatggtaggattcatacaaaatctggatgttgcgaccttgatgaatgccggcggggaggatgcagggagaaatagctgttgacaaaaccatcctagactgctcaaacctcacgtgattgatttcctcaaatctgaaatcggctgggagttcgaagtcttgggaatgctcgtaggcaaaccagatcctggagttctttggaaatccatcatagaagttattaaaccaatcaaagagtagttcaaccgatagatctgacccaagataagcaaaggccacttccccaaaagacgtgcatcggtgagttttaaccaggttcccttcatcatcttcagtaggctcgagggttgggaagctcatcatggttagggccgatcttccagacactttaatcgtgtgaaggttgagccatgtctgcaaaagccaccaagggtcaccagtgccgatgacagagtccacggcaatcctggccgatgctgagcccaaagattgatacagggctcccaagagatgtttgcccaagggaaactgccttttctctgcaagggcttcggccagatgctactagttggaggtagggccacagcttgggccacataacaggaacttttcggccagaaagcttaacttttccttcagggtaaccagaccagtccccgtgtttgtagtgataaaactagtccaaccacctatactcttggtcttataggaaaattggcctttagagttcagactaactgagttggctgccgacgtgacatccaagccagtgatcatgactatatctaaaagagttggcgtcatcggcccctaaccaaataagaaagcattgagggtgtcggaccagaaataagttgcagccgatagcatggattcatctctcttcatatcggctaaagtaagaagcagacattgagaaatccctagttcgtcccaatgggcttgcttgtgtgtcgatagtctcttatacaagtctggccatgtcttgacattggcagctggccaggacttgaaagtgttggtccaatggattaggctagggttggtttgtctaaaggggattcggttggttttggcattgaggaactgagtcgggtctgagttgccggttgggcccagaaagaactggttttggtggcacggattggggattgcaacctaatgggaaagatgctacagtagaaaaaaaaagggggaataaggagtcaagattgctatgaaagaatcacgcaaaggaaaagaaagaaccaggagcagttttagccgataagcagttacctcaggaaactcagccgccgaaacacttgagggattgacggccatcaccggaataccaagcgccgtcgaaaggaacgcctatgtagtcgccgagaaaactgacggaaggagtagggtgctccgttgactgaaggcaaaagaagcggaagggacaccgtggaattttttcgagaaggtggttctatttaaaggaggacgcggcaccagccgaaacagaaaagaaactctagatacaaactgaaacggaatctaacaaatctacaacatccctaacatcggggacttgggggcatttgttaacgaccaaatttggtgaggccatgggctggatccaaagccagaatcgaagctgatgtggatgaattctgtctaagaaaagcagagtgcgtgtcggctatgagcagcataggctgccgtatatatatcagctggtgccaaatccaacggagataagtcgatgcaggcagcctcggaaagacaatcccacatctatcatcagggttagtcaaagtacttgataggcattgccacgcgaggattgaagtccagaaaaaggcaattgtatctattaattaggatattttcagtttccttacggatatgtttgctaagagtccgcctaagggacttgttcgtattttaaattgtaatattgatagagtcgtgtccagcaaggacatgtttgtactttgggtataaatatgacccgacaccttgtaaacaagggacgacggttcaaaaatacattggcgcatcaccacccttttctattttcattattttgacgagtttttactttcgagttgggctgcatcgagttcgatctccgacgaagaggtaaagcttgttatggcggtttgcattctcgggattagtgcttacatctctatgacacactaatcctgtctatgtaaatcatcgagttatcatatatgctgtataatctagatcgatcccgtcatctaactccatcggctagcctctatcatcgaaaacggccgatagatatagatatcgatattgagctagattacatagtgtatctaccatcttgaatgagtcttcatcgatttgtttaaatctcatgtttcttttcacgcttaatgctgcattggttaggttcgatattttaagtgatgtcttgaaccgttttctctagctttttcaatgaattctaatagagatagcatcggggtttcagccgatcttacctggtttagttgtcttgtgccttatatggttctcgatcttctaaatctgccctttatattaagatcttgtttatttgaagcatatcttgctctttatcagtcttccagtccatcttacttgctatattgatctgcgttttatatattttatttatcctggtatcttagtataaggttgtatcggagtactagccgatacacattgggtttgctctattggctatgctgtaagaattcacaatctctactttgagacacatttagatattaagtaatttatactatctcagcacatcatctgatctatcccaatcacttggtttaaatgtatttcattggatagactgtgtattgctgacatctacagccgatcgagtatatctaataatctctacgctttatcttccctcactgatctaatgcaagttatgtcagcttggctttgaacgatatgtcatcggcaatccagccgatcgttggttgcaggatcaaaccaactggcacgctcaaaatctgaaggcaatctctttggacctacactagagttaagtagatctctcaggccagtgcgtgtttttcgcgtcaaaaagcccataatggagacctttttctctatcaagtcgccggctcctcgaaccgtcttagagaaaaaggctcctccagctgccgcgtccaggtggtcccagacgtgggagtgagtccattgtaaaaattttgcaaaatcagccagtcgtccatcccaagatgaggataggcgaccatatattcctgaagtcgttcccacgccccattaatggactcatccctcgtctgctgaaaacttaggattctcccacgaagggcgttggttttgcccatcgggaagaactttgacaggaatgccgttgagcatttgtaccagatgttgatcgtgacacggttggcataaaaccactgtttctcttttccaaggagggaaaacagaaacaatcgtagcctgacggcgtcaggactgatgcccttcactatgtatgtgctgcagatctccaggaactgttgtagatgtgcattggcatccttattaggcttagcgcagaacgggctagcatgcgccatcgtaatgaggctggacttcagatcgaaatccatgtctcccatgttgatttgcggcccagtggccacgttgttagcgaagggagcagggaattcacgtagggtcttgtcagccatagtcttgaatgttggtggcgctggtatggctggtttttgtgtcggaagagttttctgcggagcaacgacttgcggcttgatgctccgaaagaaaacttctggattctcctttaaattttttggcaagttgaaactagtcatgcactaccctgtttccacaataaaagtgaaaacaactaaggttagccagcaaaggacagtgattctacaagtggtaaatataaaatattagtaacggtaatctcgtttatgaatcttccccagcaacgatgccagaaatgcttgttggtatgtcttaatgacattactagaaacataattcccaacagtgacgcagaaatacttctggtatattatggttatagagtttatccgcaagcgtacggatataccattgtaggatttcacacgagagtattcgatgggtagtttatttgtttaatcccatgggaagattataatagagagaaccgtactaataatttatatattacttgtatcaaccaaagtctaagcaggggttaatataattcatctggtcgagtgacactaagcagaagcattcatactcttactcatgataatctaagctaagtggaaagaatatagaaagatcatattcctatacttctaggatgcatactgttataaaagctagtcgatatagcggaatgacgactaaccttcctgatcgcttcagtcatagatcactcaagacacgccagatgacgacacaggaacacacgatatttgttaacgaggttcagccgaagcctacatccccggggctctgattatgggcgctcctccccaaccaatatagctcctagccgctacgagtccatggcctcgccgccatcctctccctgcgtgtctacgctacattgtagtcgccatggttacattgtggtgccccccctctctatttaagagagatgtcgtgttacagagtccgactctaactctacctcctaacacctattacaacttcaagtccaactgtaatcaaatagaactagtatattcgacacctattctaaccaaatccaaggccagaaatgaacttgtgagagtgcgcagcccggcccaccaaccgtgggccacctaagtcacattgggtctgctcaaccacaggcccaaccggagccacaactttaggtcataggcctacacaacccaaaagactagtttgatgggtgaggatcgaccccaccttttaagtcgtgcttccccatcatcaattaccgatgtgggactaaacccaacaatctcccccgtcacaacatcaggcccaacaatctccctgtcacatcacccatgtgacccgaagacttcttacctgggcctcgggcctaacaatctctcccgtcacaacaacccatgtgaccccgaagactcgttaccggcctccccaccatgtgacccatagaaattgttccgtgttctaaaccttgggctttaataccacttgtgagagtacgcagcccggcccaccaaccgtgggccactcaggtcacattgggcctgctccaccacaggcacaactagagccacaactttagttcctgagcctacacaacctaaaagaccagtctgatgggtgaggaccgcccccaccttttaagtcgtgctcccccatcatcaattagcaatgtgggacaaaacccaacaatatacatattatacatatatcctagttatatcattacttagctaataccctctttccgatgccctcctggtgcttctagaagcaacccttaattgccgagtttcttacgacaatccatcatgaccatacaaccgaggctaaatacggaggagtaccctcccctggaaattaacttaggactatatacacgcgcggaggaatacccgtactgagctgtcaccattagcggcccacctcgtttctgcagcatataaccccaaataatgatctccaataatctaaacaccatgcttaaattaccagatattactctaatatcaccgtcatgacatagagtcgtcgtagatacgatcattatacccacaccattgcatctcctggataagctagcatcataatgaatataacttgaacatatagtaaagttggtatttatatactcggaaagtaatacaataccaaagtagtataaagaagaatattctaataaaagtgcaagtcttacaaaagaaggaaaagcgactagagccatacctgaattcttccaaagactccgaggactgaagattctattctaattctattccactatactctagaaactatactaaacttgagagatgaaatgaacttcttgcttgaggtgtgtggagaaagtgagaaggtgaagtccttttatagcctcccaatgacggttgtgacagttggaatggtcaaaaatgccctccaattgtcattgggatgcaatcgtggacatccacgcaaaaccctgcatccaacggtggagatggtggttcggccgaaccccctggtttggacgaaccatgggctggtgcaatccagcctatttttggctggcagcctcctggagttcttctctttgcagacaagtgaattttcacccaattgatcatgtcatttctgagttcttggcccattcattgataagtctgattctcgacatcgtccgattgattgatcacctgttttgatgtcgattctcctccattttatggtcattctctgcaagaggttagtaatcctagtgctagtggaatatttattatttaaacataaatatgcattgcaagcgtaactagttctcctttattttggtagtattgacggtcgaaactgatcgctaatgaccgccaacagtgttaccaactaggtgtaaagatctgtatgatctttagtcccggttggtaacaccaaccggtgctaagatctcaggggggcctgacagcccctgacaacatgtgaaccgggactaaacattacatagtcccgttgcgcctataaaccgggattaaaaaccgcttttagtctcggtttttagtggattttggctaaccgagcaaagatgtttctccagtagtgaattcatatttgtttgaagcacatatacctacacattgtgataacagagtcgaatacaaaatataaacgatggagatcggatagaatcgtacagataagaacaaaatactcgttttttttttctcgttatcaaagtatctagctgtgtactctctctatctctctctctcttcttatatgcaccctataagggtcaatgcaatacccaacactagattatttggatttgtcccatatttaattattccacaatactaaaagagatatcggtaacaactcgattggaaattcatgcacaggaaaacgacttggttgaaaactgattgtttgaattattgagtccaatgatccacacggacaggataagtcgtcggtcttcaggataagtcgtcggtcttcaggggcaagtaaaatatagattgagtggcctctgcacttataacttctaaagataacatgcaaatgtgtcacatcatcagcaactagctattattatctagaggattattcaaattcacgtgtgccacatcatctcactcactaataattattatttaggatattttaaatatcatacaaatatgatatattattcataattttgttgtctttttagtactcaatatgtaattaatgtcaaatcattatctccacatcattttcacattatttaaatgtgtacatctatcatttctgtaatgtaaaatataaatttatccacagatccggtggcaaaacgcgggatatcaactagtaactagtcttaatgatagacactacatatatcagacaggtactactacacatctagagacatgtatgtctttttgctattatgccatacatgtctctttttttttcttattataaaagctgcaaaacacctcctaatttaccgtccatatacaacggaagcaggacttcgctgctgaccatatgacgacctcggcgataagactgcaatcccttctctcaaccttgttgctagtgttcctgcttctcaccggcagcaacctcctcctttcaagatcagcttctacgcaccgaccaagcccttgtaagttccttgaattcactagctacttgagtttagtaccatggcttcacggatcatgatacaattatttctcgtgattggtggacgtttgcttgttggcacaaaatatacagtactatatcaattcaatattttcttccaatcatttattgaaacacaaacacttgcatgtgttgtatctataagttcactagctattctctcgccgaattgcacacggtccagcgaaacatatttggctcgtttggttaatccttagaaggaagatattcaagggtattgagagagattaattctacacctcgataaatataaaattattcattttcaaatcctcttatttatagattgagtaaacaagtccttaatacttgtttggttactctcccataaggggattgaagggatttgaaggagatttattccgcttctattttagtgtggaattattttctcttactcgccccgaatccttctctcttaggggattaagcaaacaaaaccttatgcaaatactattggttcctaactgggatagggtgctggtttccaaacctgccttgggcgcatttttaaacctggattacgttgctgcaggagtaaatttttatttctcgtgcaggtaccttggaccccaccaatccatctcccatctgtcctggtcaagctccttccccgtattgtccccaaccgccatgtcacaacatgaatcacgcgccagccacggagcaacagggtgcacatttgccttaagtagcagatggtaaagggagcgaggtgaaaaacgtatatatattcagggaaaatttcaaaccaccccaaaagtcatttaacgtttgatgtttcaccctataagtaattttgttggaaaagcctcccaccacccagttttgttgcaacaatctttcaatacaaacgtgattaatcaaatcagcccgttatcactgatattgtgccaccatatgctaaactagccgagttaatcttgtctaggtgcttatattagaccactctttatgtttcactgtattgattttgttaatagctaaactcagtgcaataacgtttaagatctgatccgcaattatgtttgtgggaatctttaaaactttttaattttgacagctccttgtttatgaaaacatgttgatttggtcaaacacgtacgtactgggatggttttctggacacaacagtaggattttaggagggtagaaatttatagcaacataatttatgggatggaatatcaaatttcaagtgttttatactgtggtttttgtaaatttccgtatattttagttcgtgtcatcttttaactcgtcccacatctgtgatcgtctagaactatagtatgtagtagtatgtaataacttatgatgtattcctactaaggaaataatatttccattgcctgcctgctaatgcttttcaaataatcaatatatctatctatctatctatctatctatctattatatacatactaaaagtccattaaacttcctacaaacgctctcaagccgccacgtgaaactcctacaaacgctcctaggtcgccaagtggctctatctaatctaaccgtcgattttaacttaaattggtggacccaatattttagaccattagattagatttttacttaaatcggtggacccggtattttagacaattagattagatgtattttattttattttaaagaaactaattccttactctattacgtacgtatatgggagaaacacaactgaagtaaccaataaagcctacctattgttcgcgtcaaaagaaaaaaaagctgcgcacagaattactataaaatcaataagaaaaaaaaaccatacgtacttagcaccatgggaaaaaattgatgatatttaaaataggattttctatcatttaaagataaaatattttactctataaatttacgtaaatatcaccgttgattttcatttaaattggcggacccgatcgatgttttagaacattagattagatgtatccattatgtatacttcctaaaaatgctcctaatccgccatatgacatcctgcaaacgttcctatgtttccatgtgatgctctaataaattagtaaaattctactttgtctctctgtcctttaaaaaaaagttttgtttcggtatcaaattttgctccataaagagtgtaatttttggttacaaagaaactttttaatgctgcttcgtcgatttctacttcatttaagcacaaaactaataacagtagctccttctccgatgcttgttttcacctctccttattctatatgaagggtacaagtaattgtaattatttaccttttgtttaacttgtctttaactaactaaaataatatttttttagaaatgaagagagtattaagaaagatattaaaacactactatgatttcattaatatggagaaaataaggtgggagaaataaggaggcatctggttcaatggctaaaaacaacaaagaaaaggatgtaatagcactattgaattagatttagcgtatcattataaaactacacaatcaattttagggtccaattcttaaactaaaactacacttttatatggacagacggagtagaaaaaatagaaattaattttgagtcctccgtatataagacgtggggatgcgtgcccatgggtgaaatagcttctctccctctaggccttcgaagcgcaggggatggtagctccggtcaaattaatgtcgacaagcctacaagattgctctatgtcatcccgcctgtcgctggtcatcgtcctgcttgttatcgtcggcagcacggccagcaccgttcctcctgttgccagttcaatggagaactctccttccggatgtaagtgctttattctctagatcgagcgttgaattatttaaccagtataacagttaagaatattgaacacagaatataagatcatcaagtcgagaaataacaaatatgaatgcgggactaacgaacaatgatatataaaagtaaattaggtaaacaaagcaaaccagtcaattcgtcggaatcgacatgtttatcgtgcacttaagttattagtatttttctttcatgtgacgttatcaaacttttatgagaaaatccataaaatgccatcgacaaccaccttgatcccagaaatgccatcgacaaacacaacttcctgaaaatgccatcgtacaagcttatttctcccagaaatgccatcacaccgttagtccacaccgttagaacaaaacattttacaagaatgactaaattgccctcgctccaaataatactatcccaatccaccggtaaaaaaaaactactgctaatgcttgatgcgtcacatgcatggccggcctgcgtcgaaggcgtcggcctgacacgcggacagccagaggaagtgggagggtcacatcggcagtggcgaatgtctcgtccgcgttgtggttggagtcggagtcggcgcttcgctcgctatccctggaggaagaggaggagaggcgggcgagccccgcggcggtcatgctccagacgcgggcgccacagtaggggcagcggacgcgcggctcgagcggggcgtggtggatgacgaggaacccgcgcgtccgcgaccgcatgaacccatggtacgcgtccacgacgtcgtcgtacgcggcgtcggcagtggccgccgcgtgctcgcaaagtggcctggcacggcggcgaccgccgcgccgcagcagaagaagagcagcttcgccatcgccagccaacctcccccaatgcgtcgatgcctgggaccgtcgtgcggatgcctgctgccgacgcgccgccgccggctgctacctcctcaccacccgtcgtgtcaacgcctgggaccaccatgcggacgaatgctgccgacgcgccgctgcctaggggccccgcgccgccacctgggactgatgcgccgccgcctgccacctcctcgccacccgtcgcatcgacgcctgggaccgccgcgccgccaccgcctgggagccccgcgcctgctgccgacgcgccgccgcctaggaccaccgcaccgccgcctgggagccccgcgcttgctgccgacgcgccgccgcctgggaccaccgtgtcgccgcctgggagccacacgccgccgcctgggagccctgcgccaccacctaccacctcctcgccgcccgtcgcgtcgacgcctggaattgacgcgccaccgcctgggagcgccgccttgccgctgttgcccatcgggagctggaggttgaagtggaggggaggaatggtggccggcgatgggatggaagagaaggggatttatcctttgttgaggagggtaatttggtcattttgacaaaattaacagtgtctaacagagtgaaagtgacggcgatggtatttttgggacaaaatggctcgtacgatggcatttcctggaagtcgcgttcgtcgatggcatttcttggattagggtgtttgtcaatggcatttcatggattttctctttatgattagtcctgtttgcctccttagcgattgtgtggcactagctagctgttgttatcagtggaaaatacattctacatctcgtgatgctggtcgaatcaaacgcatgcgaaaaggtttcgatttcagcactggtatatatcgtatagttcaagcagataacgagcttcatccccttcttttccagtccacacatttgcctgaatgatctctttcagcaagaacaatatctgcttttataccacctgctattggcatagagcgaaaatttatcgatgctttccaaggctatatatattaaagtaaaaagtacgaattaccccccgaactatcacggtcgtccgaattacccccctgaaccacaaaaccagatattcttcacccccaactatgcaaaccgggcgaattacccccctgacccaatccgcggtggttttggtctacgtggcagtccagtcagcaatttatttattaaaaaataggtggaccccacctgtcagtctctctctcttctatctcttctatctctctctcctccagacggcgacagcggaggcagcggcgaggcgagcgcggcggaggcagcgagcgcggcggaggaggcagcggcgaggcgaggcgaggtggcagcggcggcggaggaggtgagcggcagcggcggggag

SEQ ID NO: 33078 - DNA, 5345 bp, Oryza sativa
  unsure (1)..(5345): unsure at all n locations
aaccgcctcgcctccgtctcctttctgacttcgccatcgccgctcgcctcgcccacgtggtcgtcggacaggagcgaagcagcggcgagcacctgcagcatgcggtgatgcggaggaggacgacctcctcagcacccgggtgggagagggtagagaagccgctgccaccgctcggcacccaaccgccgctcgcacccgcccctgcgccgccctgcctcgccgccgccgcctcgcctcctccgcccccaccgctcgcctcgccgccgcgcctcctcccccaccgccaccacgctggcctctccgccgccgcctcgcctccttcgctcccgtcgctcgcctcgctgccgccgctgcctcgcctcctccgcccccgccgctcgcctcgccgccgccgcgctcgcctctccgccgccgcctcgcctcctccactcctgtcgctcgcctcgccgccgccgcactcgcctctccgctaccgcctcgcctcctccgctcccgtcgctcgcctcgccgccgcgcctcctccgccgccgcactgcctcgcctcgcctcgctgccgcattgcctcgacttgctgggccgtgtgaaggaggagagagagagatagtagagataagagagagagactgacaggtggggcccacctattttttactaaataaattgctgactggactgttacgtacaccaaaaacatcgcggattgggttgaggggggtaattcgtccggtttgcatagttgggggtgaagaatgtctggttttgtggttcaggggtgtaattcagacgaccgcgatacttcggggggcggggtaattcgtactttttcctatattaaatattacactatactacaagcaaaatatcacctcagtggctctgtgtcacagcattttaagtgatacttctatgacacaaagtattcttgctgttttatctatgcatggcatttataatgatcatgccaaatcgtatgaaataatttgagtttatcgattataatatggcacagatactctataagtacatacaagaactgaaagtaataaaaattcaaccagcatttgctgacttgtcatgagtcagggccaaagccaagtggtgtccatctggctccatcacgctgtccatgggccatttcttacaggtccgtgttaattatatgtataactgtttaaaaaaaattatatgtatagcaaaaattgatctcgtgacaagttgttgatgatttttttgatggatggatggttattatttttagtacaaattaaggtggcttcatctcatctgtagaaaaatatgcaatgacacacatttggccaactccactcaacatagttttgttgcgactacactaaggaagttgacaaagtgaatcaaagatatagcttgacgttacaccgagatgacctggtgaagtaggttgcaagctgcacggtatcatgcatctagggctcgcagatctcgatcatgggtgaagataagacatggacatcgagacagtttcgcctctgtacgagaacatcaccgaaacatagaagaagtttgatacaaaccactggtatgtcagacagtcccgatgcctcccaaatctaccactgcacacatgtcctaataataaacgagttctctgaactaaggagcgaataagctttgtcatcggaactttatgtatcattgttacacatgcatggggctctgaattttatataggcaggcattgtacaaacatagctaggcaatgaattgatcagctatataatgtgaataaatttcaccctcatagatagcaacatggtgagaactgacatttacaagcatatatatatattgtcagtcataaaacggtttgtactatgcgtactatacagccgcataagtttctactaaaatgagcagttgctgattattgatgtagcataccgcagttgctcatatataatgtgaataaatgagcactgcatgtggaagttacagtaccagcctaccggttaccaccaacgtgcattagttagagccaacaaatgatttccctacaatagaagtactccctctggaattttttaatgtacgacgccgttgactttttgacaaacgtttgatatttcgtcttattcaaaaaaaatatgtaattataatttattttattatgacttgatttattatcaaatgttctttaagcatgacgtaagtatttttatatttgcataaaaattttgaataagacgagtagtcaaacgttggttaaaaagtcaatggcgtcatacattaaaatacggagagagtatatatatatatatatatatacacacacacacaatttgcaaccttaaaaaaagaactttcactgaatatacatccttgtttttccccagcgagaagagtattttctaaaaaagcgtataacgcaatgtaatgatgatctggagtgtactacaacattttacatgacgtatatataactggtgctaaaaaagaagcaaaattatcgttcgtagggcgctgccaagctaaaagttacagtaacaagagcagaactacatgctgcgcagagatcatgtttgaaagagagagaaaaaaatatttggttgatcagaaaggcatttagaagatgagatgcacattgtcgttgtcatgttaataacccattctgccctgcatatttgtgatcttgacagaatgaaagaagatgcagttatttcagcaattcagctgccgcgcctccaatctctgctcatccaaaatgttagtagcagagagtttgcgagaaagctggttatgcacggtcttctccattacacgaaatgcagtcctcggtaacgtgcgaatcgcacgcattgagaggcagaagaaccatccggtcgtcgtgatggggatatctccgtgctactgcattgcttttttctctgcaagccccgaagcaaagttaaaatctcgagctacatatgtcggacaatcctgttgcctcccaatccaaattttactttggttttcgctcttgtttggatggatcttaatgtcgactcatcactcatgcatcgctcatcctcctggcctttgatatatatccatgggaactactagagaaaggctttgtagtctcgcttgggaacctcctgactacgaatccgggactaaagatgaacatttattctcaaatcacaacaacattctcatcttcaaatcatagatcgaatgaaaaaatcattctcaacaaacaatcattctcaacaaacaatcatcacaactcttctcaacaaacaatcattcacagattaacaaggaaaaaagaaaaaaaaagggaaaaacgcccgcgtgccggcccctccgcaccggctccattggccggcccctccatactggccccgctggtcgccgccgggatcgcgcggccccgccggccgctgcctaccgccgccgcctccccagcccgactgccaccaaccacggccagaggcagccgccgcatcttccgccgccaatccaacctgctctggcacgcgcagggcgccgccgccgtgcgccagcctctcgctccttgatctgcggcagaagaagataggataagaacgccgtaagggataagagagagaggggagatgagatgataagaacgatctgctgagagagggaagacgaggagtttggaggataagttttagggattatatattgtatatggatttttagtcctggttgataataataccaaccgagactaaagatccccggccccctgactaaatctgactgtaaatgaaccggaactaaatatgatctttagtcaccaaccgagactaaagatcatctaggaccgatagagttttaaacctggactatttgttttttatcgactggggaaatatggtttctccagtagtgtcggttgcagatccatatacatacatgtaccatggaagggcaaaattgaatagttttgtgtttttcagtccatagcaaatgtgtagttctatttgcatagatccccatatataaatcagtttgtactattccctccgttccagaaaaacacaacctagacaaggatatgacatatcttattacaataaatctagacaaccatttatctagattcgttgtactagaaaatgtcacatccctttctatgtttaattttttttggaacggagggagtatgtcataaacggtgagcttcctctgaaaggactgttaatttcgaattgtaacaagtattcctctgaaattgtgagctaacaaatttgttttttccctcgcacatgaagttggtttgaacataaaatttggtggtgacatattaatgcctatacctgttagcgatttttgcatgaatttagaacttggaaaaagtccaaataccccctaaactttatatggtagtccgtctagcatcctgaactttaaaaccagatatccaaccccctgaactttaccataccattcatattaccccataaggtggttttggatgatggttttgcatattttagaagcttaaacaaataatttttactaactaatataacatatttgaatatcatcagttataaatcatcaatttatttttatatagtggtgtcatactattattatattggtacttgtttgtaagtgagagctaataaggagcaaacagaaagatttaagtcaaaattttaatatatatgtctaaagcgtatgacatgtgatcaaactcatccaacttatatacaaattagataaaaaccacgatacaaaaccatcttaggggttataaaaacggtattataaagtttagagggttgaatgtccggttttaaagtttagggtgctacacggactttcatcctaagtttaggagggtaatttggactttttccttagaacttatatgtcaggttttcacttattcgatggttttcatcatctattccccgttttaacacatgcatggctcatatttttctcccgcacacgtagaattattttaaatttatatttgaaattaacgtatttgcatataatgtctattttgtcattgtcgatatattatgtatgaaataaataatatgcatccatgcatgtatcgaaaattaaaggtcagcatttgtcacttctgacaatcgtgcactttgtgcaagtaccgagtagcattattggacttatatctaaaattaatgcatattattatcacattcattttgtgcttgttgatacattatacacgcatgaaaagaaactagcaattaatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33079 - DNA, 4450 bp, Oryza sativa
cttacgggcctacggcgagacgatgatgcggcagaccggcagtggcggtgatacggcgatgcgacgacgccggcgaagaggaggcggctgttggccgacgcgacgacgccgacgaagaggcggcggctgtggcgaaggggcgaggcggcggcggcggcggcaaagaggtgaggtggcggaggcggcggcgaaggggtgaggacgcggcggcgaaggggtgaggcggcggcggcggccgccggccgggatgcgtgggggtcgggggaaatcggggaatgggagtagtcggctggctcggctgcctgttgcctgttggttgttgctagctagctaggatttgcataacacaatagtacagtacacacgtagttgggctgggttgggctctttgggctgattctgatgaatggttgatgaaggactccggatatccgggaaaaatttctggatagtttccgaccgttttccgtttccgtcgaatatcacccttactgtatttattttcgtatccgagaaaaaaatccgtattcgtttccgaatccgaaaatttccggatagttccgaccgaattttgccgtatccaaaaattggtccgaacggaaggaaactatccgaaccagtttcatccctaggcacaagtaaccacatctagctatgttctcaagggatcatcatctgaaaatttaacgtttgtgtaaatatatgtagcatatgacaatactccttattttgaaaatatgtaaatgcctaacaatacataaaacactaaattcaattaatggcattgtaaatttgccgtattagaaaaaggcaattactattcgtgaaaccttgtgggtgccactgaaactttctaagatttgaaccacggcattgccaccgagtttcctgtcatcttctcccccaaatcctgttccatctagatccagggaagaagccgtgaaaggcgaggaaagcggtgacgtgctcgccttcgccatgtcgaaccgctcgacgacgccggtgagctgttctctagtcaggaaacggtcggcgtggctcctctgttgacggcggagggcggcagcgacgtggacgagaaggtgtcgtgactgcctctcatgagggtggttggccgcccaggggcgcaacatctcacaatctcgctgctgatcttccaaactagcggcccttggacaccagcacacgaggcaagatgcagccgcgagctcctatagacttcatcgggacgtcatcgctcggcggcaacgcaactagctgatcacaggggtctgctgttgtccttcgccctgcggcatctgcgtggactgcttcctgtaggatcgaatcacaagaactaagccaaccagaagggggtgaatggttggtatacccaaaaaccgaaaacttttagtggaaataaaagttacccttaaagtcgatggagatcggtctgaccaaagttgtcttgccggtctgaccgctcggatgccgtcggtctgaccgcccgtatatcgccggtcttatcgccgcttgctgccggtctgaccgccggtagatcgccggttagaccgccaaaacccggtgaaacacaaatcgaagaactctaaaagtggatgacgactttattgattctctctgtgtttacaaagtgcaccaacagcactccttacaaaatattcgactaaactcgaaaccctaactcaaaactcaactcaattgctctctaaagcgataccgggaagcctcacgctccccctctatttatacatgaggtcggtagcctaatgccacgaaccaaactcatactaagagttctaaacaccttaggaaaccctctagtacaagaaaaaaaactttacataaccaatcgtaccaaattcggactccttccaaattcgactccgcatcccatacgcacacaatacctccatcgtatgccatatggaatctccatcaaccacgtgcatcaactctagccttagtatcccgcatgatctctgaccaccacggacgtcgtcttatccccaagctgattccaggtccatcactgcgaatactctcccgagacatcgagtcacctacacatgaaataaacaaagaaatcatattccgagaccaagctatctccaacttgattcattagtagcaaacaaccgtattacatacgtttagtatccatctagaagtcataataatgaaataatcacggatattgtaacggacccaaaatttcaggggaatttttttgcgaaatgttttaagtcatgctcttctcgattcttgcattggagtgatcttgcttctaatctttcctttgattttggacttaaactttatttgcaaagttaatagctcccttttaaattctataaaacatttccatttgttttctgtaatatctaactttggctctaaattatatttcctttgaatctattcccgaacacctccaacaaataccctttcaattcccgctcaaccatctctagagcacatgaaatatcaatctctctagagttaatacctttttatttagagtttaccacactaccaccaaatctagttttatcttccacacatatttcccctttgaaatatcgtttatctaaattatccattcgagatttcaaagtttattatttagcttgggccaatacttccccgattgacccgactctctgttatatcccattaaccatttttatctttggactaaaccagtataactccctttttgttggaatttattttggatcacacctctatctaaacctatccccaaaaacctttatttcctctacatcgatccaaaacattcaagggtcaagttcctattttgatcaagccgcctgtttgattcctatggcttgatttcctcctcggcacaagaactatactatcacaaataattgagtgattgctcttgtgctaagaaacttatttccaatcccttctattcaaagtccaacttcgtttagccacaaatatttcatcgagaatccataccccatattttggaggctaaaatcctagttatttacctccatctatttttgacgtcatccaaaatttatccaaagttagaagatcaattatttgtgttccttttcctcccatttgattatttcaatcttacatttttaaatattaaagaaaatcttttgtgacaacttttatatttggttcttattgaattctataaaattggagaatctttatttttatccttttcaaaatttatatcttaaaataaatatctttgattttattttaaaaatatttcaaactccttttgctttaaaacccttattcaaaagacccccaaatatttctcttttaaatctattaaaaccctccattcaaattttcccttagttttcatctcctttgaaattccatttcaaatccctccacacaaaattcctaaaacccctattcattttgggccgaattcccttcaattaacccaatcagcacaagtctacatgtctccttcccccctcttgggctgtcagccgagccgagccgagccggcccaaatcggcccatggccgagccgctccctcctcctctgggtgcacttggcgcacgcacagggcgccgccttcgccgccgtctcgccacttcccgatgccgcccgccgttttgcgccgccgccgtcgtcttgccttcgacgcgaaggatccgtcaccaacgtcagctgcgacatcacgccgccgacgtcagccgccgaatcgaaccgccgaatcaacgaatagagctggcgccgtgctccacttctccacgccgccgtcgccgggttctccttattttcttcctccgcaaccgccttacgccaccgcctctcgccgcctataaaaggatgacgaggtcccctcttccccctcacataaaccgagctcctcaagctctctttctctctttctctcccatgtccggccattagtaccaccggccgatctccctcaccggagcttcgcaagccaaaccctcgcgccaccaactccgcctcgtcgaggtgattccacttttccctttcccgatcactccaccttgagataaaccgccaccaccacgttctcttatcggccggtctgagatcttgctaccgccgttccggccatctccctctctccctccgccttccaccactttccccgggtgcgcgttgctcggaaacaccatctcccaccggcgttcctacctcccggccaccagagagccggcacctcgctcgctctcccttctatttcctctcggctgccagagagaagaaaagaagaggtagaagaaacatatgacaagcgggccccaccttttataaagtaattccattttcttttatccagttccaatctttgagcatccatatctctccaaccattgatccaattagaaaaattctttgacctaaattcatctattttcaaaccctttattttgataccaaatttcctattttaaaatt

SEQ ID NO: 33080 - DNA, 664 bp, Oryza sativa
taaccactccaatatttagccgtcgtgctaccctaccctagcaccgactagaaaccaatccaccaaataaaccccacctatccaaaattatcctttcttcgattttaatcaatttccgacctatagaaactatcatctctcttttatccttcaaattaaaattaagtttattctatacacattcttttctcctctcgcctcgctctaattttatttactccttggtttttatcgtttctttgtagcaatttgcttataggctttatttgctatctttttcgtattcgtatgttagaccgtacagcaagttctatcggcatccaaggagctgacgtggacccaaatggctacgctgaagccgtgggaaatcttaaggcacaaggcaagacacaattaaaatttttaccacatgaaataatcaacccccatatttactttatgcataagttaatcatatgaataacatcattgtggtggcttaaaatgatatttaatgcttttaagcattgttatatgagattatggaaagatatactgaacatcattttatgtggtttattattcaaacatctttacaaacttaggaatccggttaaaatgggtatttttgaatgttatacatgatgaagtttgttggtgtggggagttcggaaagttttgggtg

SEQ ID NO: 33081 - DNA, 6089 bp, Oryza sativa
atttaggtgacactataggatactcaagcttttaacattgttgctatttttatgtaagacttttcgattggatgaggcaaggtgagtcggcacctacccactggatggttcagatagaaaagaagaaaatgaaatgaaatttccgatacatgagttgattcaactctgaaatcacattataatctcaaacgagaataattttatttctgatacaggctcttggggcatgggttgatgagttcatgaacacatatgacatcgaccattggaagaagcagtgcgaaaggcaggcacatggcatcgagtggatttatctcggctgagactttctcaggaactccgtagctccggtgctcacggtggatgttgcttggttcatcgcgtagagacatgtgaccgtcaacgagatgcgtgcagacattaaaagtgtctcctgatctcgacccctatcaatatctcaccttgcatcaaagatttccggtgtcttccaagcccaatatatatggataaaggtcatcgagcattagcttgcatgtcactgacaaaccatccgtagtgcgtgttttgtgacatgaagctgtaggggcgccaaaattatgtactgttcatctctctgccgttgtataagcattcctgttgaaaaaaaaaaaagagtgaggaggttgcacactagcataattaatttcagtgtagatcaacgacaggcagctccatggatatatattgccatccttcttaagtttttggatgagaaatataaatgaatgttattagacatcgcaattcctttgaacaaaaatgtaagagattaaactcatttttttatcaatccacttgattgctcaatttaggctagaatcagcccatacagattcaatttgtttttatttctaatttaccaaaaaacattccatgctcatcagaatgtattctcgatttgcaaaatttcaatatatttattgtttcaaaatttcgctgaaacaacttaaacaacggaagatcagaagcaattaccagtctaattaagatattggtggtaacgggtcccaaccaactggttctttaatgttacaatccaactcaatccttttgctcaacaatctctacaaacttaagcctgccctttttacacaacccttaaattttaaattttgtatgctaagaagttaggccaataactcaaccacccaactttaattttgacagaagaaatgctaacatgcatcttgttgacagaaataaaggaaaatattttgtcttttttcgaccagtccacttcagcacacagtcaaacgaggtcaacatacgggatttagaactgacgacaagaaattcttttagacagctcttaacttttactgcccgactttttagagaaagataaaatccgaccacacagagaaacatcttcctatccagaaaataggcaaacaaactcacacccagagaaacatactttacatgcagaaaaataaaccctctagtttctagatcattaggtagaactaggaaggtagcccgcgtgaatacgcgggtatgcgtcgtacattatgtctgagacacttataagagcgaaacatctaccatgatttctccataaattgttttcgtcgatatttaattttataattttctaacctattagctttatattatactccctccgtcccattttaagtgcaatacatgagtttttgtgtccaacttttattgtccgtcttattttcatttttttataattagaatttttattgttaagagatgataaaacattaataatactttatgcgtgacttatgcttttaaatttttttaaaatttttcaaataagacagacgatcaaagttaggcacggaaaatcatgactgcatttaaattgggacagagggagtattatatttaagtaatatttataagaaattatttataatcttcttcatcatttgaaaagaatgtatacttattttttttagaaaacatgtcaacgaaaagtaagtgtaaagtaaaattaagatatttttctttttttaattgcatatatattatcatggtttattcgaggatgaattgggtgagatatgaagctccactaaatatatgggtttatatagcttaatatgattgatgtagtttgaatgtcggtccatctatgaacatttcatgtagagtggataagaggttccacgcaagctaacgttaatacgataacgacgaaatataattgcacaataatacttctgaaatgtgacataccatgaatacacgcttgtgttttcttttataagattaatctaacggttagaaataacagttctaccggtttaaaaggtataggtgtactccaagaatgtagcttaaaaattatggttgtttaaatatccaacattattatgaagtgaacgtagctcaaccggttaggttccttgtgatggaacttgcccgagtctagacatgacaaattcttccagtggtaggcgacgtacctgtcgatagcgaggtgtacgtggtgacttcgtcaatctcaaaatatatcagcctagtctctcagaagtactcataggggtatttgtatgtgtgtgttcaaagatatgggtgcgcgcgcatgtgtttgtactttgtttaaaaaaatttcaaacattatttctcttttattttagtagatacaacaatagggaggggacgacagtgttatatacatgtgagggtgagggggaggtgaagattatatttttctattttttctaaatgatttatgtgaaagccaatgacaaggtgtttcatttttttatatgaatttttaaggttttctccattttttataggacgtgacacactgtgacttaagatttttttttaaaaaaatagatttaatcgttaaaaataatggacaagtcaatttaattgttttttcttataatttaattacaatatctaatctaatggtttattatagatctagtttacatgcatatacttctgtatatattatgtagtattatattttatctttttctatattatacaaaatcctattttagaccatagttttttccacgggtactacgtacgcaatttttttttgggctttatcattttttatcatacatagatgtctatttttttttcttccagctaacagtaggaagctttatttgttattttaattgcccagccaccgtttgcatatctttttttaggaaaagttatcaccattttaataataaatctaatctaatggtataaataaacgggtacaccaatttaagtgaaaatcgatggtgagattagatagtgccacatggcggcctaagagtatttgtaggaacgccacgtggcggtttaggagcgtttataggaagtttaattattcctagttcactatcggcaccctcaaagacgattgcatcggtaattagtaagttgagtactattatcaattctggcctccattgggccagtctcgactcaaccatatgtgatgaggacatcactttatcggatatgttcataacttcacacgttccaatgataattcctagtccaagtccagttcggccttcggagacagcactgactttaaacggacctagcgccttcatgccaacttcgatttgggtgatcttggacttcatggaaagcttatctcgctacctttcaaacgcatccggtctcatgtccaaattcatctcgagatgatggaaatcgccaaaacaaaacagtgctgttgctgaaaccgaacttgggccttgggctttgtaatagattagacccatctcggaagtgtctccctccacctccacgaattagcacttaaccctagctttattttcctctataaatagctttgtacatcctcaaaaacaattgggttttgtttagttgaattttgccaagtgacattcaccttgtctctagtcctcgttcgattagtcggcgactttagattcagagccctcaatagttggtgtcttgatttgccgggtcgattagatctaccacttcaatcgcaactattccttgtgcttaatcacctattcacaatatttagattgcatcttatcttgttcttgtagtgttttctcgtttacattgcagggatcatcaaccccgcgtcacggttagtacgacatcgtttgtggtgtagcaattgcacggcgtcctggacttgttttggttggtagccacgtcgcaaacgtcgcactcgatcaaagctagagttatcccctcacccaaaagatcgggccacgagagagagcgtcatcagttggtatcacagcttcagttgcctggtgaggattttagttttatagatttattatttttcctacccatcacccacaaaattgccgcaccactttttccatctccaaacattagttttgagccttgcaattttcattcaattttgctttattgagttttggtccgctgtcgtgtcggagtgctcactggtggagaaaccatctttcgtcgtacggctgatttccacaatagtcccggatgcaataaaaaccggggctaaagatgatctttagtcccggttcaaaagggtaacgggcatatttgatctttagtcccgattcgaatgctatcagggcatgtcaggcccccccgggaaagatcgtaactttagtcccagttggtattaccaaccggggctaaagatcctggtgatctttagccccggttggtgctaccaaccgggactaaagtcccacccctatatatatgtcttcttcctcctccagctgcccgagcaagcttcaaaatttcttcaaaaaagaggagaggtcatgccaaaatttttattgaatttattttggtgattacatacaaatcggaggtgcctaaaaggtttgcaacttcatcgtccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcatataattattgtatgactgtcattattgtaagaataattatttgtgtatggttttttttgactcatgtagatgaatcggcaatggatgtacgctgaccagcggtccaaagagtttattgacggcgtgcactattttttgagggtggccgaagctaacaggcaaaggggttttatttgttgtccatgcaataagtgtaagaatcagaaggagtattctgcatccaggactattcatttccacttgtttgagtcggggttcatgccaagctataattgttgggcatcccacggagagcaaggtgttgaaatagaagaagatgaagtggaagacgacaatattccggactttgctcagtatgttggatttgaagaaaatcaaacgggcgaggaggaaatagctgctgatggtaacgatgttgcggatgatcttggtcagatgttgcatgacgccaaggaggactgcgaaagtgaaaaggaggcccataaattggacaagatgttggagggccacggaacttcgttgtacctaggttgcgagcaggggcacaaaaagttggataccactctggagttcttgcaatggaaggcaaaatatggggttagtgacaaggcatttggcgatttattgaaactcgtcaagaacattcttccggggggaaacaaattgcccgagacaacgtacgaggctaagaagatagtctacccgttaggactggaagttcataagattcacgcatgtccgaatgattgtatcctatatcgcggtgaggagtatgagaacctagaagcatgccctgtttgcaaagcactacgatacaagattagacgagacgatctaggagaagttgacgggcagctaacaaagaagagaattcctgctgatgagctacttgc

SEQ ID NO: 33082 - DNA, 962 bp, Oryza sativa
aatccttttggagagataagcagcggccatagcacttggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaaacaattgtggaagaagaaaggtgtccccgtgtgggatgaggacaaacaggaggagtttaacctacgagcgctgctattcgtaatcatcaacgattggcctgcacttagcaacctatccggacagtccaacaagtggtacaaggcttgcactcactgtatggatgaaacagaaagtatgtatcttaagcactgtaggaaggttgtatacatgggtcatcgtcgattccttgcagcaaaccacctggtacggaagaaaggcaagcacttcgaacataaggccgaccaccgtacgaagcctaaacatcgcagcgggaaaacagtgtttgctatggttaaaaatcttaaagtagtgttcggaaaggggcctgaaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacgcaaagtcaaaagatacactggaagcacgtaatgatctgaaacatatggaacaacgcggcgaccttcacccggaaccaaagaaaaaggaaccattacttgagtccaaccagctacactcttagcaaggcagaaaaaggaaagtatgtttgaatgcttggagagcataaaggtaccgtctggatactccaccaatttcaagcaaataataagcattaaggaaaagaagtttcacaaccctaaagtct

SEQ ID NO: 33083 - DNA, 989 bp, Oryza sativa
catgtcgaaggaaaaaacagaggagcatgtggaaaaacaaaagacaaaagagaggagcatgtggaaaaagaagtcaatattttggagactaccatactagaaggatcttaaagttcgccactgcatagatttgatgcatgtcgaaaagaatatatgtgagagtttaatgagattactgcttaacctaggtactacaaaggatggtctcaacgcccgacgagatctggaagaaatgggtgttcgctcggaactacatcccataaccacggaatttggcagggtttaccttcctccagcctgctacactctctcgaaagaagagaatattgatttgctaacatgtttgagtggtataaaggttccatctggttactcatcaagaatcagtaggctcgtttcactacaagatcttaagttggtaggaatgaagtcgcatgattgccacgttcttatcacatagctgttgcccgttgcaataaggaatattttgcctcctaagctgcgacacacgatccaacggttgtgttccttcttccatgcaatcggccaaaagatcattgatcccgagggactagatgaactacaggcagaacttgtgagaaccctatgtcatcttgagatgtactttcctccaactttctttgacataatggaacatcttcccgtgcaccttgtgaggcaaacaaagtgctatggtccagcattcatgacgcagatgtatccttgcgaaaggtacctggggatccttaagggttatgtatggaaccgttcacaccccgaggggagtatcatcgagagttacaccaccgaagaggtcatcgatttttgtgtggactacatgtcagaaacatcttcaattggattaccacgatctcatcacgaagggaggcttgatggtattggtactgttggaagaaagaaagactgttaggtcggatcagaaggtacgataaagctcatttcatggtactgcagcattatgactgatg

SEQ ID NO: 33084 - DNA, 796 bp, Oryza sativa
aaagcaagacagcaaatgcacagtgcagaatagtgggttacgcatcgaggctgctagtgacggtaaaagttgacaatgaaggttttaccactgtcaacttggctaacaacgcatacaaggatgaaccgttcgttctcgccaaacaagttgttcaagtgttctacatagttgatccgtgtaacaagaaactacatgttgttcgtgaagggaaaagaagaattgttggattggacaatattgcagatgaggatgattataaccagcacttccatggcataggtcaagaaatacctctagaagaggaggaagaagaagatgacgttcaatatgcacgcgtcgaccatgaggaaggattatttttgtaatttatgtacgtagtttatgtctacatgtctgttatctgtatgactctaatatgttcgcaatgatcaatagtatattgctgatgaaatagtcaaataaaataattaagtgaagcacccactagaagtgaaataaaataattaaattattataaccattgaaataaaataataaaattagtaaaataatgaagtgcaattactactgttagtgaaataaaataattaagtataataaaaatatatagtgtatgtggaaatatgttaaggaaaataaaataactaagtgaaataaaataaaataaaattgctgtaggctaactcacctgtgacgggctctaactatggggccctcacaggtgacatcacctgtgacggaccagagtgttgggcccgtcacaggtgggatcaactggggctgacctacagttgga

SEQ ID NO: 33085 - DNA, 13148 bp, Oryza sativa
tccgccgccctctacgccctcctctccaccgccacctcgacctctccaccgccgccctcgccgccgccaaatccgccgccctctccgccctctccgccaccctctacgccctcctctccaccgccgcctcgacctctccaccaccgcctcgacctctccaccgccgacctctctgccgctcaccctctccgccgaccttcccgacgccggcctgcaccaccgccgccgcactcactctctcgaccgccgccatccatttccaccgccatctccaccgtcgccgtctcgacctctccgccgccatctccgccgccctctctgccgccatctccaccctctacaccgccctctccaccgccgcctcgacctctccaccgccctcctcgccaccgccctctccaccgctgccgcctcactcactctctcgaccgccgccgggacctcctcttagttgccacgccaggaccgtcgtcgccgccaccgggatatcctctccgccgcctcctcctctcgaccgggacctccacggtgagcccacgcccccccgcctcccctcgtttactattggtcactgattaaccccctcttctcctcctcagcgctgccgtgccgagaagccgtgcgccgtgcgctggccaggactcgtcgtcgccgtgcgccgcctcctctgctcgtcgtctcctctccaggtacccctctctctctctcatgccgatgaatggaatggtgcagttaatggatgaatgaatgatgcaatggaatggatgaacgaatgatgaactttggatgaatgatgaattttggggataattgtgctctttttgaattgaaaatgcatatgtataattgtgctctttttttgtcattccgttcagatttgttgcaactgttatttaaaacttaaatgtgtagctagtttgaaacttgaatgtggatactgctttataattgaaaatgcatatgtataattgtgcagtgtatactgctttatatgttgttttgttcccttttgctagaactattgaattttggggataatgtttacatttagctgaaaaatgatggattaatagattggcaacagtgtagttagataggttgggtagctagctagaaatagtttgtctagctagctagttaggggtaatgttcccttttcctataaataaagcatatacagggtttgaaatttagttcaaatggatgaattgatagattggccgtagatttaatgtagttccgaggttatcaaaccatcacagaatacaaaatgcatggggaattttggtggattggtcagtgtagtccatggacggaaccgacctagacaccaaaattctccatgcattttgttttctgtcattctttgataattaaggaactttattaggtttagggtttgaaatttagttcaaatgaaagaattgatagattggccgcagattaccagcacttgttgatttatatacccttgttgtctatgaataggtgaattgcatgaattgttgtttatatacatgatttatatagccttgctgtctatgaataggtgaattgcatgaattgttgtttatatacatgatttatatacccttgctgctgctgccacataaattattgtgggctgttttattatctacacttgcccctgcttgataaattaattgtgggctgtgatgaatgctcaagaacagaaatacctctaaacttaatctttaacttaatctttttttaatgcataagaacagattgtctacacttgttctttttttctgcataagaacagattatctacacttgttgatttatatacccttgttgtctatgaataggtgaattgcataaattgttgtttatatacatgatttatatacccttgctgttgctgccacataaattattgtgggctgttttattatctacacttgcccctgcttgataaattaattgtgggctgtttaagaaattattgccatgtgtatgataatttttttgatgccttgctgtctatgtttgcccatgctgctgcctatggttgccttatgttaaatggcgagtgatgaatgctcaagaacaaaaatacctctaaacttgatctttttttttaatgcataagaacagattatctacacttgttcctttttttatgtacacttgttcttttttgatgaactgctacccctgcgccccttattcattttttctgcatagattatctacacttgttctttttttaatgcataagaacaaattatctacacttgttctttttttctgcataagaacagattatctacacttgttctttttttctgcataagaatagattatctacacttgttctttttttatgcataagaagtgcccctgattgcctgattttgttgaattttgatgattgttataaactgaattgccatgtgtatgataattttttttgatgccttgctgtctatgtttgcccatcctgctgcctatggttgtctatgttaaatggctagtgatgaatgctcaagaacagaaatacctctaaacttgttctttttttaatgcataagaacagattatctacacttgttcttttttttatgtacacttgttcttttttttggattgataagaggagactatatacacttggttcttttttacactttactttgggttgctttttcctcctagcagctgatttcctcttttttttcctttcatgcaaatgatggtaattgatacataatttagtacaatggtaggaagtttataagctttttcgcgaaaattagaccatgacaacgcccggcgcaaacccgccctccccaacacctgcgaggatccaggaagaagcaaacccagccacggagacagttgccgaaggtcatcccttgacaacggcagtcgaaaaacccgacattcatggtaatttataggacaaattttcaccacatgaccacataaattttagctagcaccccttagcaaatgttgccttctgtttgtgcagcagaattgccgcaggaacaacatacatcgatgtcgggcgggacaagtgcaagtaggtcgagtagaaatccctggtcacaaaatatatggccgaccacagtgctagttataagagaggttgacgcaagtggtaggcccacggcgcccaggactgtcattggaagatggtctaactgctgcgggctagcggcacgtgaaaacttcgggatcctccataaagatatcggcaacgtcacagaagccgagaaagagcaagcttggatggcaatggagaaatggttcacaattccggctgaagcaaaggataggctcaagcggaaggcattccagaagttgggtaaagcttggaagaattggaagtcgaagctcttcaccgagtttgtcaacccgcccggcaatcatacgccgttcgatgaatagcctcaaataaccgaggcggtgtgggaggatttctactctctcaagaacacccaagagtttagggaatcaagcgaggcacatcgcctactgcaacagcggaatgagcacccacatcggcaaggaggcaatatgggcccaagaagatgcagccgctgcagcagcgaatgtccctgccccgttttcagacatccctgaacaaagagctcgcaactgggcgcgggcaaggggtaaggtcaatccagacagctctgtcacatttgagaacaaaagtgatgccgtcgtctatcaggaactggtgagttcactacttaacctaactaatttccattcgtacaaagtagaagtttgtataaacgactcctttttttctagttgggcttggttgctgaacaagcttcacaaagcgaggttgattccgcgccgaagaggcacgaagatgacatcctcacaaaggcgctcggaaccaacgaacatcttggccggactaggggaattggtagcgatgtgcactggaagcatggactcccacagtacagctcccaatacagcaaacggaaagtctccaaggaagagagggacgctcgtttgaaggccgaacttaaggttgaggtcattcaagaactagaagctagcatgaacgctagggtggaagaaagggttaacaaggtcctcgccgacatgaatataccccgaggcacaacacctgctgtgcatccaactcctcgtgcacaacacgacgcgagtctgtcacagtataggagtagttgtgcatccacagaggtgccggcccctggtctcccggtcgcaccactagctgcagtggaccacatagaggtaattgatgttatccaatccatatctaataaaaaaacatttacacgttccaatattaaattcagactttcacatatgcagggcgtagcacagtgtgtcctactggcgagggtccacccaactttcgctcccgaagtcgctgagggcatggctttcaagccctcggttacagacaaggtccacggcgcagacctgctagctgggtatgccaaggtgtccatcgatacagtaaaggacacctggtcaggctatccgctgcccgtgccccccaatgatgaaatcatgactttgggcaatgcgcgcaagacatttatacaatggcccaaagaagacatagttgtgaagatgactcctcatctaagtcgaccgacggagcttacacctcccaagtctaagctatcaattgaggctccccgtggaccggcattgtcagtacctcattctcctggtggagctgatatggacttggcagatatagctcaaagcttggctctaataaagaccacaacaaaggacgatagctccccaccacttgtcaaaggccagaagcgtgaacgcggcaaggggaaggtcggggagttgccgccggagccaaaaaggggcaagactgcgacgtcgatgccggtgagcaaagcggggaaggtcgtgagggcgccagcccaatttgagctaggcatgccattggtggaggacaatgtgttagccgtgatgggtattgtttgccgagagctacataagcaatacatggagctaagcaatgccaagcggaaaatgagggagtcatccatagttggacatcacgaccaccagccgttcctatcatcgcctgcctatataactataggctttgatgacctcttcgaccttttcaggatccggaagttggacactggtcttctaaaatgctactccttgtaagtgcataccttctatacctgtgatatgattggactatatctcctaattaaattagttctaatacgtaaatgttttaaggttgtgttggatcgagagtcgtcgccttggtaaacaggttgggttccttgatccatccatggtgaacgaggttaatttacgacagagtttcactaaggtggttgactatgtcaaccagtgtttatgggcccatcaagacaaggagtacatcatgtgcgcacacaaccaagagtaagaggacaatacccttcgtgtatattatttttgaagttaagattcttaggactaacgctacataaccactacgcaggcgacattggattctcctagtcatcgtacctaagtggactagggttacctaccttaactccaataagtccaaagattatgatttcactgaaatcaccaaggccttaaatatggcttggggcccatatgtggaaaagggtggtaggcacaaggagggcaaggacgaactttaccatgacaccaagttcgcatgcgcacaacagatcggaaaccaatgtggtttacacgtgtgccacaacatgtcaacacttctaagagaggtgaaagatttcaaccctgaggttgttgctaatggcgaataagctcatttcaataccaacattgctattcaaaacgtgctaacatcttatttattaaacagaaaggtagagctggcctcaagatctcacccatcaaccccccgctatgagaggcgaagtgtgcgccttcattctggtagaaataatgaacaagaaaggacgttttcacgtcaaatagactcatgaacttggctagataatttattgtgatgtaaaaaagatgttttcataatttcttgtgatgtaaaaaaatatgtttttatggagtgcaatgtaatttactttcatatgtgcaatatttatggtagtttactaaattgtcatcaaatttgatcaactactatctacattgtactattcatctattttctcctttttttttccttattgacaggttgtggaggtcgaggacattatggctttaatccatttggtaagtatatgtgcggttatatgagcaacgaccaaaattgtgactttcaaggggtgtgaatttgctgtgcaaaattgtggcatttgaacttcatatgtgaatgatgtcaatttttgatatggatctgtgttgttggggatctctgatgtttgagatggatctgtgatgttatattggggggtgactggaatatatccgtgatgtatcggtgtttgagagggcatggctagcaaatcctgaggctagccaatattcagcatttattttttttttggaattaactcatcagtgacgggtcagaacaaaaatccgtcaaaggtaacatcacctgtgacggactagcaaataaaggcccgtcagaggtgacctacctgtgacgggcctttacttttagggccgtcacaggtagatcgcctgtgacagcttctaactacggagaccatcacctctgacggcctttatttaaagggccgtcagagatgagtcacctttgacgggtcccaactcgccctaggcaagcggagaccaacaccatgagaatatatgacgaaataaagccatgtagtagatgacaaaaaatagatggatcctatctgactcaagcgtccatcaatttagcttttttctaacaattttttgagagcgatttgttttttagtagatggtttttttttcttgcgcggatttttaaaaccattttttttagaaatggcacgttttttctgatagttttttcctcgcatatttttttaaaaaaatattttaccgaccatggaaatatttttttctcgcgcatttttttatttttttattgaagatggaaaacctttttagcgtgttttttttgctttttttctgactttttcctcacacgtttttttgaaccgttttattttctcgtgcatagttagattagattagagatagagaagagatatataccgattagaaatcggattttgtttcaccagggaatgggacgaacttttttagatgtcttttcagatttttttttcgcctttataggaatcggactttttttccgtttttaaaggaatcagatctagtgtttttttcaccactttttttttttgccttttatatgaatcagatttttttcccgtttggatctactgtttttttgccacataggggaaaaagacttttgttgttattgtttttctttattttcttttttgtgtggcttttctttttctttttatgtacctttgtgtctttgttctctcttttattatttttttaataaaaacgacctcaagtaccttattgtaagattatagggactcaaatataaatataaaaattacaaggactcaaatgcaaaactacaaaccaaaaattaaaatcaaatgctctcaacctgtaagttccgttttttaaacagatcttcaatccggcacatcaatttttttcaccaatctagagtcggacttttttttgtttcttacagggaatcggatatacgagtcggacttttttattttattttttgagctatttttttacggacgtaggaagcatctctttttttattttttatatttatataagtagcagagaagatagagatagagaatcggagaggtttttttttaatttcttttgccctttttttaccgcgttaacggagttggattcgtttttcttttcccttattttcgccctttttctggatcagatggatttgatttttcttttctttttctggttttttttgcccggttttttttcggacatatttggtttttttcgcccttttttttccgttcggacagctttgggtttttttgccctcgttttgtttcgcctggttttttttgacggacgatgaaaacacctcttattttcatattttcgaagtagtagagatagagatatcatacatatgtataatttttttctttaaacacatatgtatatttatcatcaaatttctcctcctaatatttgtcagatgtaattacagtacaatcgtagtgtaattacactgtaacttacatataattacacctgggaataaatcctttcacatatgtgtgtgctgtgatttttttctttctcactagaacaaatcttataatagatctaacgattcaaaattacgtgaaacttacatacaagttacactgtagttacatgcaagttacagtgtacttacatacaagttactgtacttacactacgattgtactataattacatctgtcaaatttttagtacaaaatttatcgacaaatgtataggtggtcccatctttaccataattgatattgcagcacgtacacttctccctcctctctcccttcccgagaatgctatccagcgaacagtggcacgccctcctccccgcgcggcgcgacatgtgtcgcgcgcatagagggggcggcggacggcactgcgcggaggaactttttttccttttttttcagtttcgcttcttttttttgttttgttttttttctgtttttcttctcgccttcggtttcatttttttctgtttttttctttccgtatatttttcggttttaatacgtatgtatgtaaactttctatatgtacaaatgcaaactttttatacacgtatataaaatttgtatatacgtatagaatgtttgtatatgcatatacaaattttgtatatgtgtattttttgggttcttatacgtacgcatatcaattttgtacaaatacaaactttgtatacgcttatacaatgtttctataagcgtatacaaattttgtatacgtgtattttttggggttttatacgtacgtacaccaattttgtatacacgtatacaaagtttgtatgcacatttataaagtttgtatacgcatattttgttatacttacatatacaaattttatatacacatattttcaggtttttatacatacgcacacaaactttatatacatgtgtatattttttatacattaaaagtgtatacatataaaaaattatatatatacacacgtatgtatatagtgtatatatatatatatatataaactttgtatacacgtatacaaaatttatatgtatgtatatatggtagtatatgtataggagtatatatatagtagtagtatagactagaggggggcagctgatcgcgcgcgcggagcgctgcgcgactagtcgcccctcctccccttcttctcttcctactacattacaccacaaattttttttttagaaaaataaaaagttagaaaaatttatggatagaagtactatatataaaaaatttgaattcaaatttaaatttgaattggctatgtaaacttttgacttataaactttggatctgtataaactttagatgtatagaaatactatacatagaaaatatttgaattcaaattcaaatttaaatcggatataattcaaattcaaatttgaaacgggtatataaacttttgacttataaactttgggtctataaactttaggtgtataaactttagatgtatataaatactatatataaaaaatatttgaatccaaatttaaatcggatataattaaaattcaaatttgaaacaggtatataaacttttggcttataaactttgggtctataaacattaggtgtataaactttagatgtatagaaatactatatataaaaaatatttgaattcaaattcaaatttgaattggatatataaacttttgacttataaactttagatgtgtaaacttgaggtgtataaactttaggtacataaatttactaaaataggaaaataatgcggtgccaaaaaagaaactaggtggagggaggggggcgctacccgatcgctaccccatcgtcagggcgatcgatcgcccattagaggtttcgctttctttgatcaaacagatacgtaggtgtttcggtcttctgggcattttttttccaattaatgaaccaaagctgccaaggtaagtttcggctatactggtatttcatggcggtactggccgtcctgtgcaaacactagtaaaaaaacccctataggtaccggttgggaaccggagataggtgtcggtttcccagccggcaccaatgacgtcatagaagcgacacctttgtgctctcccgagttaaaaaaaaagaagccggctccaagccgagcagatggacatcaataatccccattcaagcatgattttacagatcacaaatcaaatcaagcagatgaatgataataatcccaattcaagcaatccctaatccagtccatcaccaatcacatatatgaacaaaacatcaacaacaaacaacaataattcccaggccagcaatcacagatgaagaacacaagcaaatgcacaaactcgcttgtcaatccaccaagtcacctctgggtccatctccacgcaaggtcgccgccgaggtcctctccgcacaaggtcgccgctagccgccggagagcgcacgaggttgcctcctgctgctgggtcccctctccgcgtgaggtcgccgctggccgccggccaccgaccgccaggtccctcttcatgctgacgtcgccgcacccatccctctctgtgctgaggtcaccgccggtggggaggttgtcacgccctgaagtttttcccttcttctttccttaaaacttgttaaataaatcgtccggagaaatggttcaaattaacctagagctaattccctaactaatgaatgcaattaataatcggaaatagcgtggtggaatttttcttgagttccccatgccctaatgcattaacaagatttttagtggaattttcataggccgcaatatttaatcccaggaatcctttttcctttttcttctttttattttcccttttttcccacttcttgggccgtcggcccagtccaccccgtcgcccgcgcgcgcccctctccttcttgggccggcccgcgccccttctctcctctttgggacgctgataggtggggcccaactgttaggtcgtccccaacctccagccacccgcgccccgcagcaaccgccgcccacgccggcgccccacctccccacgccgctgtcgtgtcccgccttatccgcgcccccactccgcccgcacctcgcgcccacatcgccgccccactcctccacctctcccgctctcgcgtgcgcgctcgcaaggggcggattcaattttgaatcctctctctctctccactctcccacgtctccggccacataggggccatccccggccacgtccgcctctcccgtgcctataaaatccttcccccgagcctcctctccccctttccgctctcgccaccctctcccgtgcctcctaccgagcccgcgtcgctcgccgctagcgccgccgcttgccgccgcctccagccgcgcaccaccaccgctaaagccgccgccgccgctagcttcaccgccgcgtgggtcatctcggccactgcctcacgttgccgaaaacccaccggaaccccatctccctcgcgagccggtgagctcttccatttccccgtcttcggccggcatccctgctcaccgtggactctttctccccctctaacctctctcttttactctcttagggtgtcccggagctcggccgtcgcccgccgtcatcctccggacactcgccgtcgccgttcgttgtcgccttctcccgcgctagcgaaaccccggtgaggccccccgcctcctcttttcccctttcctctccttcctcccgctgccgccgcacagccgcatgggccgtgcgccgccgcttccgcgccggtcgccgctgcctccctcgccgccgcttgccgtcgccggcgaccgctcgctgccgcctctccccatggccagccaaccggctttgtgccgagccgagccgagccctgccgccaatcacggcgtccgatcggcctcgggccgatccggaccgtcggtcccgtggaccgacggtggaccacccgcgtggtcccggtccacggtggaccagccgcctcatgccgctgacatgcggggcccgcctgctggcgcccccgcatccactgacgtcagccctggtcaatattgcgcaataaattgattaaggacttttctttattagtaaaaacacagattatcttctaaaattcatatctaattcatccgagctccgtttaagtccattcaagtctcagtaaattcataaaaatccctagaatccattaaaaatggttttgtttcctgtttcagtagtcttatagcatgttttgcttgtgtgctttgtttgtcgcgtagatttcggccgtttcgtcgatccgcggtttctcgaagacgttgctgtggtgagagcaaggcaagtcatgcattacaatcgatcatattgtacccaatttacaaatatcccatatttctattaaatgttgcattcttttacaatgtcatgtgggatgggtcctattactcagccatttattgtttaccttatgccattgataacttgggtatcaaaatgactagatgttggtttaagaaatgcttagccatgcttagttcaactagtataaaaatggggatcacattattacagagactttgactattagcatagctttggattggtgccatcgcaatggtgttagtcaattaaaatacactgaatggtgggctgtgggtgcatggttttgctggtcgcactcatggcaattaaggagtgggtaccacaagcgggagtgggtacctgcttgatctgaagtatagctcgaccctttcctaggcaccagtggcgaggatgggcgtgatggagttgggtcgaccggggtgtccagttgtccaactgccagattcatcgtggcgcaagaggggaccgcccactgccttttgaggggtgggggtgaaaccttagcgtggtgtggatggttaggggaggcctatgcggagggtctggtcacgatttccccctttg

SEQ ID NO: 33086 - DNA, 6379 bp, Oryza sativa
  unsure (1)..(6379): unsure at all n locations
gcctgtggagtggagtcgccccgctgcagaagtcaaccttccgagtttagctcgcttttatcttttccgctgcatttgtaatcttttatatttttgtaagacatggatatgtatgtcaacaattgtcgtttatgtacactggctggtcctggataggggtttaatgcatatccagcttggaaattctggttcgtgaatttctgggcgtgacacgcccgttgcgggtgacgtagcttgccggcttggagagggggtggagggggagggggaggagagggtggcggatcggaggaggaggagagtggggagggggccagaccgncagaggggagggggaggggagggcacggcggaggagggggccgcaggggacggcgggggagggggaggggagggcgcggctgaggagtgcggcagaagggctgagggggccgaggccgcagaggggagggcgcagataaggttaaggataaggatggagcgtgtgcgcgtggatagaccaggtcgatcggctcgactcgcccgggtcggctcgacttggtataggtgccctttttttacagaaccgacacctataatatattataggtgttggttctcttaaataaccgatacctatagtattggtaccagttttaactaatgaaccggcacctatactactttgtaaaggtgtcggttctttatttttttcatcttgtggatgtgggaaaagtcctataggtgtcgtgttttacatgaaccggaacctataaggctgatacctataaaggtttttgtagtagtgaaattctgtctgtgaaattataacaagggatttggggcaacaaaccaacagtgaaaatcatttttgctagcagcccacttaagtaacttgcaacaaacatcggtttttgctcgtggtaaggagcactgactatgggatgaaattccctatgttaaaatctcgcaccgatcttatcttctcctactttcacgatcttatctcctcccactctcacttggactctccctgtccttccccacctctcctcttcccttcccctaccctgtgcccccacgttctccctcacctcttgtcttccctccccaaccctgtggccccacctcacccctctctgacttctcttcacgtcagtgaccacggtggaccggtgacggcggcgacaacggtggactacgaggggcgtgggccgtggatcctcggccaggaggggcgcaggcgtggtggattcggccgccacagggccacgggtggtaaatcctatcgtcagagggccacggtaacgttgccctccctcccctcactctctcagatctgatggccaccctgatttcccctctccttcctctctgtgatccgatggcggcgaccttgcctccccccaccccccaatgcgacggcggcttcctgcagtctcgaggttcactcgaagacagcggacgcagcagcgacggcgatggcgacgggtggcagatccggtggtgcgatggttgtataccggctataccctccctctcccatatttggccgtagggagatggcggtggcagtagccgaggggttggcagagaatggaggatcctcaaatctccaacctccattcttgtggcatcctcaatctactggaatatatatttcactgaaaggcaaagttctgtcatatcatactcaactgtctctccttttctggtcaaaattcacgatggagatttggtctatagcttctgttacaacacttcaatagggtgaaaatgaatgaaaatgtgtgcggcccggtgacaggtagctgtcgatgggcggcgctaggccttgtgaccagtgggtgagcagctagttcggggagggcgctgagactcagttgggcgtgattgaatgcgtgggtcgatcggcgacaacgttggccggagatgcgaggtggtcagtggcagtgagtgatggagtaaaacctgatgattgtgatggctggaggcggcacacggtgggatctcgccaaagctgcttgccaagggatgtcgaggaggtcaacaaccggaacaaaatgacctggtggcttgctgggaggttgggggaggatggcaatgacgcgcgagggatgatgacgatggcgtgccatcgagaatttccctcaccaataaaaacaagaggatggggcatgtaaggttgagcctccgggacttgtagtttggagaggtgatttaggggcttccccatattgagggctctagtagggaccctgctggacctgtacttttgatatcaaccgtaaaagaatatttggggactatatttgaggatcccgctggagatgctcttacgaccctgaacactattatgatccacaccttgaatcatactccaccttgtaggatcgaacaatatgaagcaaacgaatcagaggggtgtgaattgttgtagtacccaaaaaccaaaccttccagaggaataaaaaattagatagcgatcggtgaattcgctctggtctgactgcccaccatgtcgttgttgcctctcgccgctgccaatctgactgccatattcccactggtctgaccgcgccggtgtcgtcggtctgaccaccggtgttccataaatcgaaaatctcccaaattagattgaatctttattacttctctatgtgtttacaaagtggaacaacaacactcctcacggaaatctcgactaaacacgaaactctaacttttctcacaacgcaactctctcaaaatcgataccgggaggccataccctcactctctttatacccatggtaggcatcctaaatccacgaaccaaccttgtacaagatgtcctaatcccctaggaaaccttcacgtacaagaaacggacattacaaactccaattgtactaaatttggactactccaaatttgactccacctctcatacgcacacaatatctccatcgtataccatatagaatcttcaccaaccatatgcattgatgtcaaagcttgactacttcaacatctctggcccgagagacagtgtgtgaagacctgatggaccgttggtgcctacagggactatacatgtgagaccatcgttatacagtaaaggggcggggaacggttaacggacactaatgtgtgaatggagagattgttgaatcgtcccccacattgattttggatggtcaagagacctaataagtgggggagcaccataattcattggctatcttttaggtgggaaaagctttttatgattctatagaacccagctgtaccgaacaacgcaatcaattcttatatacgtggcattccttactctacttatatatgacaagacaggaagaacaggatgtgaaggagataaagaaattcgatagaacatcaatgggttcttgccgtggtagctaggatgcaaatcctctacagtactgctgatgcagtagcagtggttgacatgtgggtccgggcccacatgtcagtgtctgctactgcatcactgtggtagctagggttgggagtaaccgggaaccatcttattacacacaaccatcttcctacaaaattctcagctgattatttgtcaggttagtaggcttcagtatgcacatctacccgtcacggttcattgattatattgatctcagaaggacggtacagcatagattagtggaaatttcaaaataggcacaattgcatccataccctcactttgaactctaactactgttttaccccccacattttagggtttgcatttttccctctctttttgaatatgaaccaattgtttaccctcatttttaacgtctagtttaatagtgttagttttagaacaaaaggacatttatacccttagttgatgttgcttttttgccccaacttttatactgcctgcttctcgtgccggaagccccgttgccgtctgcctcgccgcgccggaagccccacggccgcacaggccatcgccacgccggaagctccacaaccgtcgcctgccattgccgcgcaagtgagatggaagcctgcgactgccgcctacctcaccgcacaagggagagggaagtgtagccgccgctacaccggagacctgtcgtcgactcgcgctcaactgctgccgcggccatcgccgcatgcacttcctgacagaactgccgcgcacgctggaatcgacaccatcgcggcggttcccgccctcgccgcgcatgtcggaaccgccaccgtcgccgagcacaccgaagccgttgccggtcgccgcctcaacacaactgagctcagcgaaggaatgggcttgggtccttatccattcactcaagggtacaatagtaaattaaatcctttttctgtttcaatttgtatttttttaacccaaagccatgggtgtcatctaacgggtgtcaagagtgagggcaaacggcgtgttcgttttcaaaaagaggtggcaaaaatgcaaaccctaaaaagtaggggtaaaatagcagttgacattcaaaatgagggcatggatgcaattgccccttaaaaatataagtaaaaacacttcaagcaaagtcaaagtactctgctacttgctaaccgaggactatgtcacggtaatgattcgccatacattccacttgctcatgctttgctccaagcttgtgtttcattatagaatttacttatcatctgctcctccatttgcttccctctactccactaactattcaatttctttgttatatgatgttgtttagttacatgaccaggtgaagtgttttggggatggactgataaaagaatagctactaccccaattttttgttgctctgtcagtaatgtgtatgaagttcagtacatgcattcattcatcccattaaacatcagaatcaaacaaggcgcccattgaactcggctatacaattcttgaatgactgaaatgtttattagacgataaatttcctctgtaccataccatctgatctcctatgctctataaaagagcagatgaagtgtagtagcaacctgtttttcttggctgatgttgagagatatgaacaacaggagctcattgtgtttagccagtctactcactgcttagcttgctacgtacggtaggcctgggtggcattgggacatctcacataagccagcggtaagctgttgactgaccactctgcagttccagtctcaagcaagttacagactcagagtacatcaatggacatgtttggtgttcaagcctgaaccatttgatgttagcaaccggtttctccacaccttgcagagttttccagggttgtttggtacttgcttctcgagtggatctggtcatctcaacgtcgagaaacccatctccggtctactcagttgtcttgcctaggggaacatgaaccttgtaaacttggaacaactgatttgggtgaggcggtggctgaataaggttactttgtgatcattcgcacgagcacggcggagcagagcaagacactttgactgaaacggagaaggcagggttgggtttccttcgcaaaattccagcagtcgccgtcatcctcgaaacctctcgccgatgacactgtgacgctctccacgaacacatacgcttgcaagctaggcgacgcagccacacagcacggcctgtgccagcaacgatgtgtgataattaataagattactgttggagatcgtctaggtagcctcttctatctgataaactggtacctagcatctctactgacaaaataaaactgtcacaaacagaaacatcagcacattaatttggtctcaatttctctttttgcttcagtactacctagctaatagagaataataacagcattagcagtttgttaagcgttcaactcagctgtacagaactactggagaaagcgctcaattttcagaaaggatcctgcccttcttgccatacttataaaagacaacaccaagtattataggccgagggggagcgatgaagaagagtcgatggagattgattactctagtgtcttgcctattgtaggcttgggtgcagtcctattaccgataaccagcttcataccaaattctttgctgatcatgtctcaaatcagaaggcacaagtagggatgaaaacggatcggatacggtcggaaactacctttatcatattcgttttcatattttttctcggaatcgaaaccggaatcggaaacccggatacgaaaacggaatcgaatattatcgaatacagatacggagcgaatacgaatcgaaacgaatacggtaacgaatattaatcggaacataaaaccccctcaaactgaccttcacaaatcaataaagaaatataacttcttgttttttctaatagagcatgttacatttgcaaagatcaacaattaataatactataacgagaaacatccacaaacttgctgcaatg

SEQ ID NO: 33087 - DNA, 729 bp, Oryza sativa
aaccatccaacttcttctccattcccttccacttagtttcatacaagtagccgaaacccagcactaaggctgtgttcgacggtgcaggatgggaacccatccctcctgcacacaaacggagtgatcttttaacacatgatcaattaaatattggctttttttttcttttgaaaaatggatcatatgattttttttaaagcaactttcatctagaactttttttttttgcaaaaaacgtaccgtttagtagtttaaaaagcgtgcactaggaaaactgtcacaccccgaactaatcccgaccggaactagcccgtgacgctccaaattaacctgttaatcgataccagtcccaggaaacagtgctggtatcacaggaagacagattatcacagcaacaaaggtctctttattatagagtaggagtacaatcaagtcgggctgcggacagatcccgagctcacaactgcattacaaaagggaagcggaagccaagacttggaccaaacaatacaggcgcgacctgggaactaggccgaaaccctaaaactcatcgtagccggcttgctcctggaagaactcctcgtcagcgggatccacttcatcttcttcagcaactgggggaggggggattatttatatatagcaagggtgagtacgggagtactcagcaagccatgggaaataagtgtttaatgcaggctccaaagaaagggctgttggttttgcaat

SEQ ID NO: 33088 - DNA, 1858 bp, Oryza sativa
aaattagtacacgatagccacgagtatgtgtggggtaactaagaaacaatctatcggtagaacgtgcctcaaacttatccaaatttttagatttcaagataaagcacttgcaacaaaaacacgcaaatgtgaaactttgggttgatgtcaaaatcgatgttcataagaagtttttccaagtttagatctcaagaaaacccgatttgaaatataacaagcagtattaattgcctcagcccaaaattttctaggagttttatattcatccaacatcgttctagccatctcaaccaaaacacggtttttcctttcaacaacaccgttttgttgcggaacacgaggagaagaaaattcatgttcaagacctctttcgttgcaaaattgttcaaaaaaagcatttttaaactcaccaccattatcacttcgaattcttttcaaagaaccaggaaattcaagatccaatcgaagaaacaaaccacgaaagtgttgaaaagcttcgtccttagttgccataaagaaaacccaagaatatcgagaaaaatcgtcaacaataaccaacacatacccctttcctccaaccaaatggacttttacttgggccaccttggcccttgtgtataacctttcccgggccttcccgccttcacagaaacaataggagcatgtgaagaaacaaccatcacaggtgaaaccagattttcaaaatcagctttaaacactcttccatagcaagaaatattcaacactgaatcaccacaagaatcaaaaactttacttccagttttcttaaagtgaaactcaaaattttcatcaacaatttgtgaaaccgaaaacaaattgtactttaagtcttcacccaaagctacattcttcaattcaaatttctcatttaccttaaccaaacctgtagcgagaacggcacttgtagaaccatcaccaaagataatcgattcagtctttgatgccttcttgagtgaggagaaccaatttttatcaccggtcatgtgccgcgaacaaccggaatccacgattcacacgttctccttccttgccaccaaagcctacacacaagcagaagtcgaagcctcagtactggggttagatgataataaaaatttaggaatccagtactgagacacacgaccagaaatccaatacgcatatatccacgtgcaaaatcaattttagaattttcagaaaaattcctccgaggccgtctgaccgaggtacagtggccggtctgaccgggggccggtctgaccgccgctgtaccgccggtctgaccgatgcccggtctaaccgacactcagtagccggtctgaccgcgggacccactgcggtctgaccggtttcctcgagggaaaaccagatttttgccactttgattttgcaaaagcaatctctctctcctttttctgtttatgagttaatctgaaacaaaaaccaataatatgtccatcttttccaaaaaagaacaagtatatttttcacgatgattagacacattggtagtattagaagatttagcaacacaagcaacaacaggagattttgcatgcacaacattggattttgaagaagatgcactcaaggtagacatgataccagcagatttaaacacagttttgttagtatcaggtttaaccaaaatctcaccacttctagcaccaacacctaacacaacaagaggatgtctagaattatgagcataagggttaaaacctaaaccacgattatgtgtgctaacctttgattgatccaaaattatgttgaggttcttcttaccatcagaaaatcttagcaaagaatttttcaaataagacacctctttttccaaattagcacaattttcacaatc

SEQ ID NO: 33089 - DNA, 24637 bp, Oryza sativa
  unsure (1)..(24637): unsure at all n locations
tcacaaagtacatgtgtgcaaaacaaaactataagcaagagaagatctatttttcaaatcatgtgcagcattaacatctctaatttttgaaatcttattcatgaaaacctcacaattttcgcaatcatcatcattaggaataagagattttaatctagcaatttcagatttaaaagattcaatgataaattcctgttttctatacatcttctcacacttctttttttttttcactcaagatattaatagcttcctcaaaagcacttacctcattatcttcatactctgtgtcagattcaccacacgccatgatgcaaacatcggagatgttctttcccttatcatcatctcgactttcaccatctacatcacttagtggctcgaaggtggcgcaaacttgttgaaaagccttcctgagattctccagcttcctcccttgggatgaacccttcggcttgttgttgttggtcttctcaccatctttgtcttctcttttgcctctcccaagcttaggacaatgcgaacgaagatgatcaattgaaccacattcaaagcaacgatttggaccacctcttttcctgttgctggcattattcatagctcgagcaattctgttagcaaccaaagccaaatccttctcctcgatctgttcgagttgatcatcggatgtggcaataaaaatagcaagaaaagaaggcttagatgaagaagcatcaacatccaaagaagaagaaaaagaaaccaaagcacttgacttagaatcaacttttcgagaaagaacattcatctcatgtgttttcaattttgtgtaaagcgaatccaaagtcaaagtagacatgttaacagactcctgaatagatgtaactttcatctcccaaatagacatatcaagaccattcaaaaagtgacgagaaatctcagattgtggataattagcatcataagaagaatcaacagatctaagatcaatcaaaattttattaaacctagaaagatagtcatccaaagcttctccaggtttcatctcaaatttaatgtactcctttttgaaaatatcacgatgaagttctttaatgttatttgttccttaatgaaaattactcaaagcattccaaatctcatgagcagttcgaaagtgcgcaacacgatcataatccgaacgataaataccactcaaaagaatgttgcgagctttacaattttgttcaaaagcagttttttcagcagcagtattaatagcttcaggaatcacataatgatgagaaacttttctccaaatattataatcttcagccataatgtaagattgcatcctactacaccaatgagaaaaatccattccatcgaaaacatgaggcttagttgaaaacctagcgggagtagccatggcaaaaactctagatcgataaaaatccaaagaagaaaacaaggctctgatatcacttgtaggatcgaatcacaagaactaagccaaccagaggggggggtgaatggttggtatacccaaaaaccgaaaacttttagcagaaataaaagttaccctcgaagtcgacggagatcggtctgaccgaagttgtcttaccgatctgaccgctcggatgccgtcggtccgaccgcccgtatgccgccggtctgaccgccgcttgctgccggtctgaccgtcgcttgctaccggtctaaccgctggtagatcgccggttagaccgccgaaacccggtgaaacacaaattgaaaaactctaaaagtggatgacgactttattgattctctctgtgtttacaaagtggaccaacagcactccttacaaaaattttgactaaactcgaaaccctaactcaaaactcaactcaattgctctctaaagcgataccgggaagcctcacgctccccctctatttatacatgagatagctagcctaaagccatgaaccaaactcatactaagagtcctaatcaccttaggaaaccctctagtacaataaagaaactttacataaccaatcgtaccaaatttagactccttccaaattcgactccgcatcccatacgcacacaatacctccatcgtatgccatatggaatctccatcaaccacgtgcatcaactctagccttagtatcccgcataatctctgaccaccacggacgtcgttttatcccgaagccgactcccggtccatcaccgcgaatactctcccgagacatcgagtcacctacacatgaaataaacaaagaaaccatattccgagaccaagctatctccaacttgactcattagtagcaaacaaccgtattacatacgtatagtatcaatctagaagtcataatcatgaaataatcacggatatccaaacaaacaacccgaaaccgaaaccgacacagcgccggccggtcagaccgcgggctggccgatccgaccgcgcgcataccgccggtctgaccggcatacacaacccagtctgaccggtcacataaaatgatagaatccagcgatcacctgtaaatccaatttatctccaaaaccacttcgtgaataaattccaaataacaaaccaataatctccgatgcccaattgttcatcacaaaataataatcaaaaacacctttgattttacacttccgggagcttactcgtgccaaagtagatggattcctctgtgtcgcgccacgccgccgtcgttgcgcccactgacttcaacaaccaggccgagtaggagcgcgggagcgggtcgactccgtcgtgtctgacgtgacgaaggggcttatccatgatgtcctcctccctcccggctccatcgacggctccatggtggtggtcgttctcgccagcgcggtctacttctcggattcatttgttctgttgtgtgaaggctccgattttttcatgcgatgctgctctgattttggggcgcggtttggtcttccatgcttattggtagcgctcggatttggatgctttcaaggacaacaagggactggcatggagccttccaatgacggcagatcatgctgttttaaaatttggatatatagtatgtcaatttggttaacggtgtggtctagtgaaattttaggaccatgatatctgtggttatgtggtatgtgcttaaacaaatgtgtttcgtgcaacatgaaacataatagattttgtgaaatttactattcggcttattttctcggtttataagcccatagcttaaccaaccaaacagcttccatcgatggtagcgatccaattctaaggtaagctaaaggatattttacttcaagagggttttcttacacagaacacccacttccagctcttgatttagatgtctcctgattgctcaacatataaaatataaaggacatgatcaagtagtacgtagtacagattgaggaagacatgaaaaagattacatggagattgttcgccctaatggcttgctattgacatagtagatagctcggcttgggaggcaccaggaactgttctactatcatgaagaaccagttgactagtacatttgatggtacgaactcttgaccatttgatgctagcaaacccgcttctgcatcttgcgtgcttcttcaggttacattaggtagagggtggtttgatgaggcgatctgatcagctaaatgtcgaaggcacaagctccatggcagcttgctagatctgttcgtaaagccatcgatagatcaaacgcaagcactacatatggtggtggtggtgtggagatgtgatgtgcgatagtgagattattcactagaagggatatcctcatctcaatcgggtggtaagcccccatctcaatcgggcacagcgtccgttacaggctagaagtcactgatgtgaagagttatctcaatcgggcaaacggccgtcacgaatgaatatatcttaatcgggccctaagtaaagcctgtcaccgatagctttgacccagacgaccagtcaaactgtagcccgtcacagatgacctatctctatcgggccacaactagcgcccgtcacagatgactactaacctttatcgggcctaaactagagcccatcacatatgatactcatctcaatcgggcctaaactatagcccgtcacagatgactgatgacctcaatcgggcctaaaatagagcccgtcacagatgactactcacctcaatcgggcctaaactagagcccgtcacagatgactactgacctcaatcgggccttcctgttcttcttcatcggtgggggttcatgaatcgccttgctgtcggcctccgtttggtcctccccaaaatccgtgtcgtactgcaactgcacatcgtaagattgtacatgacgatcttgagcaagaggggctaaaggagcagaggtgggtctctttggtggacgaccgcctggtgcagtggttggcctcgctgtaaccctgatctcaatgaggtccatgggccattggatgaaggtaccacgggcatttcctagtgagaggacctcgtcgttcggtggatacttcagagggaatagctcgtatcgggcttcaccgagtcgacttgaacttttgcatagtcggccctgagttgcgctccatgcactcttgtctctggggttggcttgtacgcaagtccctcggctgctggaaccgtgaaggtcgtcatcaccctaactgtgagggtgcagctcgttggttcctgcgatagattaatcaattttttttagaatattatatatcatatggattcgttaagtctttcatgtattgagtaagttcacggttaccgttatgtggtcgacggcgctgtcgaccgatgttggattttccaccaactcagttgatgcgcaactgctgcgtttttgggtgggacttcctaactctttgtgcgcagcagcagcggcggcctgggggttctgttgctctactcggatctcttgcctaatcttagccctcattgactcgagcttttcgtcgaatttagatgtcagctcagctcttatcgacgcccggattttggcttcaaggcgtgcatctttctccgccttgttggaagtccgcttcgtgtatgttccttgcaatcggagcatgccttctttctttttatagtttgtccggaaagattactgagtgcagggtagtcattaatggtgcagaacaatagaactcttagcttgaagttctcctgaccatatgcatcctaagtttccacaccttctttccaaagaatctccagatcgtcgataacaggctccaggaatacatcgatatcattgtcgggttgccttggaccttggattaacaagcacaacataatatatttccgtttaaagcataaccatggcgggaggttatagttcgcaataagaattggccaagtgctgtgagtactactcatgtcaccgaaaggattcatgccatccgtacacagacatattctcatgtttctagggtcggcagcaaagtctttgtgtttcgatcgatattcctccattcaatcgaatccgctgggtgtctaagcatattgtctttccttctctctgtggcgtgccaacgtactaacttcgctttgttcgggttggcaaagattctcttgaaacgatcaatgataggtagataccacacaacctttgccggaccacccctctttgacttatttccttcgtcagcacttttctttcgcttatatcgagaagccttgcagacaggacaagcatccaagtccgcatattgcttgtggtataatatgcagtcattgggacaagcgtgaattctacggacctctaaccccagtggacacagaacctgctttgcttcgtatgtcgtctcgggcaatgtgttctcaacaggaagcatagccttcaaaattcctaaaagatatgtgaaactcttgtctgtccatccactacttgccttcagcttcattaggtccaaggtaactgacaacttagtgtgttttgctttgcatccaacgtacagaggcgtctcggaatcacttaccaccctgctgaacttcattccatctctctcattctgggctgggtcctcaacgtcacgtaacatgtcttgcagcagatcatgatccacatcaaccatttcaccgcccaatggagaaggtataaatatgtcatgttcatcttcatcttcctgattatgcgcaccacttctgtctgctgctgccccacttcctgattcttgctctccatgcttcacccaacatgtatagccctccatgaatcctcgttgtatcagatgactgtgtatgtcctctccgctatcaaacatattctcattcttgcaatctgcacatggacaacacatataatcactgtttcttcttttccgatcctcctccgcggcgttcataaaatttattacaccctttctgtactccgtagaatgatgtttcaaattttttgcatacatccaacttcgatcaattgctacaaaataaaaaaaacaaattagaggcacatattgtaagatcagtattgcaaaagtaagacatgatgaaattgctcaattaatgaataatattactcacttgattgattcattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaagcccgtaaaaaaagagtgtcatctgtgacgggcattaaacttatctcaatcgggcctctagttggagcccatcacagatgaccctcatctgtgacgggcttcttttagggcccgattgagatatggaaccctcatctcaatcgggcctcaactatagcccgtcacggataagtgtcatccgtaacgggctttagttttatgccgatataccatggttgtgcggccatatcggcccgattgagattacttccttgtgacggcccgcaaattctagtcttgttatgggccgtcacagatgaaaggatctgtactagtgattggaaaatccgtcatagggactggcttataggtgccattttatttaaaaccagcacctattgatattttcctaccttcagcgggataaacaatagagaatcgacacctttgaacaactataggtcactactataaaaatcctcattgggaccggcttattggtgccggttcatttaaaactggcacatatagaacttttcccaactggggggaaatatagaaccggcacctttaaccatgctagagccagcacctataatataggtgccagttttttaaaagaactggcacctataatatattataggtgttggttctgtatcggttaattaaagaacggacaggaaccggttgtttttaaaaaccggcacctatagctttgagccaagccgacgagccgagaccatccatgcgtgcactgcgtaccgcacccaccgcgtccttatctactccatccccttctctctctcgcgcatatcgcgtctctctccccctctctctcgcagcggctgcctggcgtaggtagggtggtggcgggcgggctcccgcagccagtggcggaggcagggtggcgacgggctggctcccgcagccagtgtgggaggcagagtggcggtgggctcctctcctccgcctcccctccggcccccctgctccttcacattatcctccacgccctcccctccccctcccccttccaccacaaagatgggcagcgtccccatccccctccgctcccccgatgggcggcgtccgcacgggaggcgcgtggacaggcggtggatcctgtgcttctttggccggatctagcctcccatggccggctctggccggtgtggtctgtgcctggtgaaggggaggcggcaagctcccgcggccacgccctcccctccaccagatccggtggccggcctcccgcggccggctcctgtgggcgacggcgctggggtcggttcgagtgctgatctagggttggtgtgttttttttatctctttcatgttctctcgtttaatttgtctcatatgtgtaccgagaatgaattgttgttattgacgtgattttgattttggatgtggggatattgatgtgtaccgagaaggaattgttgttattgacgtgattttgattctggatgtggggatattgttctcgatctgaggatgtggaggggatcatgggatgtggggatggtttctggattcggctcgattcgagccggagtattttttggctcgtgcagacataaaaggtgccagctcaatttaacctatgggtgccggtaccatgtataagtgttgaccaattggtgtcggccggaaaaccggcacctattgccagttgccaaccggcgctaattgggctttctgtactagtgggtgctggttctaaattattagagtgccacgtggtgatttagcagtgtttgtaggagaccacgtggcagcataggagtgtttatagggtgtttcatcaacttttaagtatactaggaaggtagcccatgcattcgcacgggcatgcatcgtagactatgtttgagaacttataacgatgaaatattaatctgaaatttcattttatatatttagattatttgagcacatttagaaaaaaaattaagtaattggactattttctctaattaaaggaactcgatgttttatgcagtggctcagactattcatatttcagtttgttattttttttacaaagtgtacgtttaatttagctatacatgtttcaaaacatagcatggtgcgactctatgttgttgagttatttctttttcttttggcaaattaaatatgaaaattttattctggtactatttatttaatttatctatgcatgtttgtagaatttttcataatgacatattatttattgtcaaaattttaaggtatttagatgtggtgcaaagtgcatgggtggactgtgcccaaatgctataattcttatacagcaaaatatatgcatatataaatattacattgttagtttaattataaatagagaataattagatataaatcagacacgtatagcttataaaaaaattgtagttgtttcaacattggttgtttctcgtctagtttagtagctacaaaaataaggaatgggagggcactgttctctacatgtgagacggaggaggaggtggaaggattttagtgaaaaccgatgtgagatgtttcttttttctcagcatttcttttgttgtttctataacttgtaagacatgacacgtgttgtcttatgtttttttttctaaaaatagatgacatgtgtacttatggttcattcaaaaatagatctaattgatgaaaataatgaaatccatcgtgttaagttggatcgttttctattttttgagacatgatacgtggttacttacaagtgtaatatgggacatttaatcaaattttatcaagtagactgatttaatataacataatgcatatagtcaaccttttagaaatgtctcattcgtatttgctttccatgcaaaacataggtgccaatgttcaaatgatgtatttaaatttataataagaatatggataacatggtacttaaattatttatttagttataaataaaacaacaattgaaacaaactaaaaataagagaggatttgaagggagagaagcagagataatgtacgtatggagacgtcacttgaacacatacatgacgtgtgaagggatgggaagtgggtcttttccgtttttatattgttaagataccaatagaaaataataggtacaccatgtttaagttaaaataatcgatggttaggtgtatgatgtaatttctttagaatttctaggatttattgtacactattagagaaaccatctttggttagtcgcccaaaaaccataatagtcctagttcgaatagaaaccgggactaaaggttatttttagtcccggttaaaaactttttgatctttagtcccagttgatgttatcaatcgggactaaagatcatttttagtcccggttcaaagaagttattggttcgagttaggccccaattatcttagatcttcagttccggttctttataccaaccgggaccaaaaatcctcccgagcgcacgtcgagtcctctctatcggtcttatcgataagaccgataaaaaccatctgcacttcctctctcattaaaaaacatctccactctccagcctcctctgtctgatccccctctcctctccccttcctcccacttcccctctcctccccctccccgcctcctcctcctaccacggcctctctggtttagcggcggctggtcgaggtcggcggcagcggcggccggctggccgggctggggaggcgcgcacggcggccttcggaattgattttcttttttttgaggatttgtgatgattgtttttgagaatttgttatgtgattaaatgtggggaaaaaaaccaattacacagtttgcgtgtaaattgcgagacaaatcttttaagcctaattgtgccatgatttgacaatatgttaatactgtaaacatttgctaatgatgaattaattaggattaataaattcgtctcgcagtttcctggcggaatctataatttgttttgttattagacaacgtttaatacttcaaatgtgtgtccatatatccgatgtgacaccccaaaacaaaattttttgggaactaaaccaggccttagtagagttctttgtggaggttcagtattcttttatctttattaatttataatcggatgaattcatattgttttaatttacttaatactatcgttctaattttttcgtgatggttttttaaaatttgtgatgtaattttttttagaatttatgatgaatttgatctgtgatttggagatgatttggagatttctctattaggggatgtaatgattagtgaaatcaatttgaaaaaatacaattaaaaaaactgccaaccgccggttctggctctagcagttttagtctcggttagtaacaccaatcgggactaaaaattgattttttttgtcccggttatttcaccagggactaaagattcatactcccagttgcaaaactgggagtacagggggttacaaaccgggaggaaagaccatttctccaccagtgatagtatcacatggtggcttaggtgtgttcgtaggagtcccgcgtggtagtttgagagtattttgtaggaattttagttgacttttatcatataatggatagatatggcatgcaagttgtcgaaatgtgcctaatatatatctacatgtttctttagggaatatatttttacaagtaaaattatactggtgtaaactacatttttctgacattgtagaactattttagttacatgccagtgaagttattatatagcatgaacaatataataatgtcacttttttttcataatttttacaagctaaattatagttaagaggtgtattaaattataatttgtgattttagtcataataatgacacaaatagaacatgtaatttcatccgatagaaaaaaaaacttccttaaaagagaaacggagaggagttatgtaatgcgtatgcacgggaagaggggtgcctctttgtaagaaatagaaaaatcaatctaatccaagtatccaacggcttggagttatggtcctattaattttagtgaaatcaaaagctaggtttttcttctcagattttttctaatttattggaaagccacatggcaatataggagcatttatataagcatcatgtgacagcttagaagtatttataaaaaatttcacggacttaaatagatagatttgatatcatcgatataatttagcgaaacatatttgtgaaattatttaaggtgacgtataatatgccaattagagatgaggggagagagggagtacgtaagtacaggaggaggccaggaggggaatatacaggtagtggggaactgtgtggagaggaggattttatattttatttcatctagtggttaaaaatgttggacccatcaatttaaaggaaaatcaacggttagatttttagactgccacttgacgtcttaggagcgtttgtacgagaacacatggcagcttaggagcgtttctaggaagtttaatggacttttagtatataatagaatagatagaagatagatagatagatagatagaatagaaaaatgcccgtgtgttgcaacaggtaaatgctattttaattttattattgttatacggtttagctagggtaaaatttactgtagaaattcgattggatttattatttcaaaaaaatcatgagctacaataattaggtgtacaattaggtggcggcggctggagtctccgagagcgagtcgcgtggtggcggcgatgagggattggggatttgggggaatgaccgagtggacatccactagacttaacaattttggatccaatatttcttaaacgaagccagatcggtccaaaccaaaacttctaggcaccgaaccactccagcccaattgtggcagcagcccatttccccccatccagagctgctcgaattaaaggaccgaaccgtttggcccatttcgccgcaaacctctagcatgccccaaaccgtctggcgtgaggggaggcaacgggctcccgaggtcaggggcaagttttatagtggaggtgagtgccacatctaatttataccatatcatcttctcattaattaagaggtaacaagtacaacatattacctctagtacacaaaccccaatattagtttactctcacatcatcttatatttttcttggagattgtgtggaggttaccccttgtatgagaggtggctcattctctctctcctaacttctctcctccaactcatcacctaatcctatatgataaatttaggggcaacatgaaggagcttatagtacttgccctcagcggcttgccagcggaggcgacgccccttgcctcttctccctctcccctggctctcctcctctccgccgcggtgtggacggctagatcgacgacgcgacgacggggagaccggtgattcttatcttttttgctgagtttggacgttttttttgtgatactgtagagtaggtccgggagatgtcaggttcgccagtggtctgattttgcctgaccattctgcttagcatgtttcataccgcagtggacatgtttgacataggcgcaacacatgaccgtttgatgctagcaaccagtttctacattttgctttctcgagtggatctgatcttctaccctataattcaccaactgatgtttacatcctcattcctcattgaacggttaggattctctcgctcgaatccaacgtcccaaatcgctcccaccatctcctcacacggtcacaccgcttcgtcacctcaccctagtctcccgtcattcacgcccccaaatcgcgcccctcgatcgaaatcactgcttcccatccgtttcctcacgcacaatctggcgctccctctctcccggagcacagccgtcgtctcaactcgccactggggtcatcgccttcgccttgcctcgcctcctccaatctcctcaccaccgaaaccctcttgcgccgcaaccggcgccctctccacaacaccgccagtcaagtcggcttcgatccctcgtgcgctgccaccggcgccctctccaccgtgccgccatcagttcgtcgatccctcgcgcgccgccaccggattccaccccaccgcgtcgcaagtcaggtagtcatcgatccttgtcgtccactctcagtagcgccacccctaggactcctcgccatcgcaggtcatcgagcccgccggctaacaaggtaattaggtaaccatcgcaattttgcattttactatagaaatgcaaaatcgttatatcagtggatgtgattaataatgcaactttcatgtttcttatgtgtgtatgcatatcccactactaaactatcaatgacgatttcatggtttaatcaactttattagcatctgcatctttttatataatgcaaatggtttaacttgattatgatatgcattgtgacattgtttacttctctcatgattgggatgtttatatctgaaaattcagagaaagcgcttaaattagcagcgttggaatgctgcaacaaatgaattctgatcgaactcataaaatgctttttttttttacttcattgcttggtcagcaacatagcccaggaaaccaattaaattgatagacatgttgtgtgctcttttaagagaacaccatccgaattgacatccaagttaaaagaagacatttaattatctgaataatgatgccaatattcagagcttcttttacttttagttgtatacattattctgtgatgtgtatcgaaggttatatacagaatgagaatttacctcaatcctggaattgtgtagtgataacttccttcaaaaaatgttagatttgtgcactgttatttttttcctctaaaatgtcaaatgtggtttacatttttattcatgacacctaaatatgtacatatcatgcattagtaatgtgcaagcacttatcgatgtattgcctaaactaacactttttcagttaattagcgaacttatgaaaaaaaaatcagatgtttaatatctgaataaattcatattctcttctgatctacttcatgccttcatcaggacgaggtagttagtgttgtactgtagttgacaaagtgattagagtttgttgcattgatctaggactatatttgcataattgtctcacgtatatacagaggaaaatgtgtgtcatttcaagctcttaattcctgtggactgaatttcctgtttcaagtctcttgtttctcactgacagcccgtgatatgccttcttcttagacaatctcccccaaaagtcaagctcaagggtacgcatcctcctccaatttaaagaaatatattttatatttcactcagaaaaataataaaaaaaagagatgacataacagaagatgggccactttgtttcttgagccaactaagcaagctagctaccgtgcatgcagcagcagctcagctgtccttgggcctagcccatggcgactgagcagtgccgagcagcagcagcagttgcaagtttagtcccacctcgcctagctagcttgaggagcatcagcatacaaggatgcaatgctcgagattgactcgggtttattttttcttgtgtgagcgaggatagtgtagatgtagtgcaactgaatgggctggatcgaaaactatgggccctagcttgattgatcgattgaaaatctggctattttttttggtgagatgatcttattcgctgttgggtgagatggttatgatcctgttcgctgtcggtaagatggattgattcgttggtttcttaggaatttgtagcacagtagcagtttcatggagttcatctatgggtgggtggtggacagtaatatgtgtggtgcgtcagtcttaagttatgctaattctttttttaacctgtggttttgctttctgacatgctctttcattgcaaatggtttcagtaattaaccattctctgttcacaaactgtatcttttgttaaggtgtttgcaaacagttatgcttgtaaaatctcttgcccttttcccctatgaatgttaaatttaataatgttatgctctggccttttaggattttcccttgccaatagcattggtggaaataagtggaaggtgcaaaactaatgaccatgggaaaaaagtctgactatctcattatcttctttgacctgtattaaagtatgcattgaggttgccatagaactatttgagcttcttggtattaaatctgggaggtacttgtatgagctagattcgcatttggatattcgtacttgtatgtgcagatgagcgcacgtacgggttggtgtgggtcctcgagaccgggggcgtagctgagagactgatgatgaacgtggtgctttttatgggcgatggtgatctggtggtgctggtgtttgacacagaatttttagataaatagagtagcaaatttttgatagacaaacaattctctgaatatttggtttataggattgcacttgaaaaaattcaggatatatggtatttgttggaatatctgtatagcccatacatctgaagtttaaatttacagcatgttctataaactaattcatatggacaaacagactaacaagttcaaactataaaggacaaatttcaatttttatgatccagagtggggaaaattgctcttgtactctctaacatgctttatgaagacatgaaggctggtccagacagggttcttgttgtttatgatcagacgagttagacaatgacttgtaagtctttagaaaataaactctgcataattgtaactttctatccagctcaaatttgtctcctgtgattaatatagtttataaaataataaaaattcttttgcttgtaatatgaagtttggtttgtattacttctacgcaatatgtttagtttgtattcctaagcgcataaggaattagattgttttcaaacatgaaaaaaaagttgcaatttgagttttctcgttggtatcaaattagcaacagtataataattctttttcatattgccttagtatatcttgattttcattacaaaatataaccgtagcgttagtacgggcatattactagtcacttgaggtgcgacgatgccaaatggagcttgcaaagcagttcaccttatggtgaacttcaactactgtttttgctgagacgcgtgatgcagtttatttagctgctggttcttagctctatgaaattggtgatctgttcgtagtaggtcatctttcacaatcttgtccagatctctgtggttcagccaatgcagattactcgtactacaattttgttaagcattgaagtcagctgtactgaacagagcactcaattttcagatatcatgatatgatcatctcctgtttggtctcatataaaagataagaccatgaagcacaagcttgaggaagagagatcaacaagagtcgatggagagtgttactgctatggtaggcatgggatgcacccggagctgtcttattacatattgcgccctttcttctaaactaggacggaagcccgcgcatctgcgtgggcaatttatttattgtctataaaaccaatactaaaagaagtattatctcaccatattcactataagaaatagcccattgatatatactaaatgattaaaatggctatcattctgaatcaagaatcactttatcccggttatatataaattcagcattcgccataacttattttcattgtcttttttatagatggaattaatggctatcattctgaatcaagaatcactttatcccggttatatataaattcagcattcgccataacttattttcattgtctttttcatagatggaattgcagctctatccaaaactaaaccaaatacatcattaatagcacaaaaagttaatctccatatcatacccaattgcccataactcacagatgtctaaatttatatataaatatttaaaaataccgcttctaccaactaataggctgaaacaattgaacttatatatgaatgctcctctcacaatcgggtgaagctaaggagttttctctaacgccttattcatgggtcccgtgatatagtcgtgcttctcaagatgagcgttgaccataattttattggtaaataggttagttaaactttattgtagatggtggataaaaataatttgtggtatgatttagatgttataggtgttgaattgttcagcacaaaagttttttttctaataaaatatgataataggagaataaatgtgtgtaacaataagaagaaaataagggaataagggggtggaagtacgtacgtacctactatccttaaaaaaatgtacgtatacatacagtaatacgtacatgtcggtggacccggtttggggttaggaaattttctttgataaatctaatggcagtaaataatgggtccactaatttaacgaaaccaatggctagagaattcactaaattatagtgctatgtggcgacttagagcgcgtttgtaggatgccacgtggcggcttaggagagtttgtaggatgtttaatggacttttagtatataactaggacggaagcccaggtgcgcatgcaatttatttattgtctataaaaacaatactaaaagaagtattatctcaccatattcactataagaaatagaccattgatatgtactaaatgatcaaaatggctaccataccaaataagaatcacttttatcccggttatatataaattcagcattcgccacaacttattttcattgtcttttttatagatggaattgcagctctatccaaaactaaaccaaataaatcattaataccacaaaaagttaatctccacatcatacccaaatgcccatatctcatagatgtctaaatttatatataaatatttaaaaatgccgcttctaccaattaatacggtgaaacaattgaacttatatatatgaatgctcctctcacgatcgggtgaagccgactattgccgctaaagagttttctctaatgccttattcatgggtcccatgatatagtcgtgctcctcaagatgagcgtggaccataattttgtcggtaagtaggccagttaaactttattgtcaatggtggattaaaaatttgtggtatgatttagatgttatagttgctgaattgttcagcacaaatgtttttttctaataaagtatgataataggagaataaatgtgtgcaaaaataagaagaaattgagggaagaaggggtgatagtacgtacgtacttaaaaaaatgtacatatatgttgacagtcgttatcgatcagtttcgaccgttaatattaccaaaatagaggagaactagtgatacttgcaatgcataaatatgttagagcaataatattccactagtattagatatactaaccttttgcagagaatgacaataaaatgaaggagaatcgacatcaatttcaacgataaatcaatcggacgatgtcgagagatagacttatgtatgaatggaccaagaactcagaattgacacaacacaatgggccaaaattcaaagtctacggagaagaacaacagaggaggccaccttctgaatatgggccaggttgggccggcccctggttcggccgaaccaggaggttgggccgaacctcccgtggcgccgatgggtgcagggtttggatggacggctgggattgacccccaatggcggttgaagggtattaccgaccattccaactgtcacaaccatcattacctgtctataaaaggagctcctcttctcacttcacacacacacctcaagcaagttctctctcattcctctcaagtttagtttaatagtatctagctggtggaatcgaaatagaataggaaccaggagtccggaagccatcggaagagttcgggcatggctctaatagctttcctttcttcttttataagctgtgtacttttattagaatactcttcgatatacatttatggtattgaaatactttacgagtatatgagtaccaactttacattatgttcttgttatactgaatatacggctagattatctgggagatgctttggtgctggtatagtgtttacttatgcaattactctatgtcatgacgatgatattagaatagtatctggtagtttagacgtgttttctagattacgagatatcattatttgaggttatattaatatacttcccgcggattgggaatgtggtaggggggtggcgcgacgcgaagacgcgcgaccgcatcggtcccgcgcggggtgacgcaccaaggggtgttgccgcatgacaatcaagaggaccgacgcggtcccgcggattggttgcgcggcaccggtgcagacataatattcttgtttcactgcctttgttcaattcgagctgctagtgccaagaagtcaagcatgcatgtgcatgtcagagtagtaaacgctaaagctagctactgtagctgttaatacaatcaaagttctacgagggcatgtttatttcgcgaaaagaaaatatttaggtgtcacatcgaatgtttgaccggatgtcggaaggggttttggacacgaataaaaaaactaattttataacttgcctggaaaccgcaagacgaatcttttgagcctaattaatccgtcattagcacatgtgggttaatatagcaattatggctaatcatggactaattaggctcaaaagatttgtctcgtgatttccccctaactgtacaattagtttttttttaaaatctatatttagtactatatgcatgtgtccaaagattcgatgtggtgtttttagaaaatttttttggaaaactaaatcaggcctatatcctctttttattgcgggatttgtcggtggtggtgcagtcccggacgatgaatccgcgggacattggttccgcgctactgttatgcggcaccgcgcctggtgctgcagggcgcgaaatgaacgccatcgtcgctagtgcctcgagggatcgacgcgatcacgcgtgttggcgtagcgccaccgcccctcccattggtcaactacatggtgctgtgtttccaatccgcgtggtgctgtgtttctaatccgcgggaaaggcgtatttttcgtaaaatttttaaatgcatgtatatttgttcaaaatcgaagaaaataatgcatatttcaaaatttaattagctagatccagacccccacgcaataaaagcggctaggccatcattatatatgacagcgatcgtcaaagtcatccctgttcagcaacaatgacgcggcgactgatttcagaagagtaaccacaacgatggtgatgggcgacattctcgtgataacaatggaaaaaaaaactataagcatctatttgaacttctgaaaaacagaattccagtccatctgtttatatttttttaaatgttctcacaagttcagagtaaaatgcatgagcatgcttctgtttgtacaaataactactaatctcatgcattttcacccttctctgtgaccacgaaaccgatcatttctattctgtgctctcatttttttagtatgggaagtggcattggtgaatgttaattattaacagccatagagacgaaggaaaacaattcaatgattcattgatctgtcatcatgtcgtcgatcaccttccactacatatgtttggggacattgatctgtcagaatgttagacagtctactctcagaaatgcatgaacaagacgtgcctccagtttttccagagcttagttctacactgaactggaatttactgcacttaataatatcaccagatcagatgagatatatagatcggttggcacatgtgagcaagaaatgatatgtcgagagagaaggatgaagagtgttcatggagccaaaggaaaagcgtgttggtgaatttgttttccattgttgtgggcctaggaggcatcaggatctatcatgtcacttatattcatagttgaggtgccgcaaaaattccatataggtggggtgactgcaatttttgttgccactattgatcccactgttctcttcctctacctcttcctgtttttattcagctatggaagtacaagagaattagttagactagccgtcaacccgtgcgttgcacgggttactgtgattaataattaaaatattattactttcaatggataatgataaaatatgttactttgaatgaagctgacagttgccaaaatcttaattagtaatttcatatataatccattctaatatttcttctattactttattttttttcaaaattacataatttaaaatttcaatattagaaatatagatttatactcgttttgttgctcttgttagcatttgctataaaataatttagcaattttcaattaataagtacagaaataaaattagtctggagttaagctttttcatgatttaatgattcctatattcataattattaaatatcaagttgtattttgtgtggagtctcaattataacatcttcataatttgattttaaaattcgtaactaaaaatattatactcggtttgaaatcttatttttttgttttatcatgatttaaaaattgttccaaattttcgaatcaatagtagttctttcatgatttaaaagtatcaaaatttgaaagtaattaatatatatcgctacacttgatcggaagtatcagttatttctataatttaatatttatgaatttaggaattaactggtacctgtttgtccttgtgttggtctcctaatttggtataatacgctagatgcatgaattttagtggcatttttacatcatcggtgtgttgtaaaagtggcccacatcattacagtagacataattcagaccaaatagtccttaaaactgacaaaaggcataactactcctagttagaaatcatgcattcttactccttattagtctgctaaattgaatttttgatgaaatcatacattcactgaaacaaatgtatttggatgaaacatatatggagcagatttgttagtgatatatgtttaacttatcttgtcatcttggttaaaagaatagcccacatcatcgacaattgctaattacacctgacatagataatgcaaattaacacctgtaaatataaaaagagaaacattaaagtaagtgcttgtttgtttcttattcataaatagataggggcagcagctacgttcccttgtttgtaagcatacctgacctagacaaacttgtcaaaatattatgtagctgttttacgcgtggaaccaaataaataattaaatacacagtaaattattcatgttaagaaaaagatacgcagtaaagcctattggttgcttatgaaggatgtgggagaatttaacttataagtaaatgaatatacctgataaactccatccaaatttatggctatcaaattgcgataccttaaaatctgaaatttatacatagtttagaatagatgagaagcatgtaaaaaatacttactgaaaccctaaatagattgaattatatcttgcttgcttgagtatttaaaatagcaatcatagctgcaaagatcaatctgaatagcatctgcatcgataaaatagtgaactggagatcggtcgatggagctcatcggcggcagggtgtgaaggagatcgacgtatagcctgtcgtatcgtcatcttgtcgtgtgtggagtcgagtccggtggctgagatcgacatggacacagtttgtagactttgaaggaagccgatatagattaaatggtggcctagatacatgtttctctcgttgggcctttaattaaaagtccatggttataatatttaatctatggtcatgattttacgatctagttaatcaatggccagattaatctgattaacatggaagctccgagaaagtgcccaattagtatagatatagatagatatagattttattttatttctctctcccatagattaccacgaattccaccagatatatacggtgaaaatgtcttcccccaggcgctcgatgggccagggaaatatcggtcggtcgcccagatggtgggccagggtgccacgtgtcggcgccgaggaaatcgggagctatacctccagcgcgcacttcggcacctccatgcgtctctaccacacacgtcgttgcaacaaatcacccacatattttggaaaccctctattaagcggattcattccattttttgttccactaaaaatttttcacctattgtactcacaatgtttcacttattgtactcataatgtttactatgtatatatctaatgttgcagtgaacgaaacattcttttgcaacaaatcacccacatattttggaaaccctctatcaagggaattcgtttaattttttgttccaccaaaaatgtttcacctagtgtactcgccatgtttcactatgtatagatctaatgttgcagtgaacgaaatattcttttgcaacaaatcacccacatattttggaaaccctctattaagagaattcatttcattttttgttccaccaaaaatgattacctagtgtactcataatgtttcactatgtatagatctaatattgcagtgaactgaaatattctttcgctatttgctgaaacaatgttttttatataaggtgaaacaacacccgatttaaacgattgaaacattttcgatctacttagtgaaacaattccgatatacttggtggaatatcgtgcaacattttaaaataattcaataataagctaaaaaaatcgttggaatatatccatgtgttcttgttttgaagatttaattgcaacgaatttaatggtgcaatcggatcatgatttggataaataatttaagagaaaaattaatttaaagtggttttgcacgtatgcgtggcgctaacgtcagcaatttttgccagtttggattaggcgtctgattctaagtctcctctgatatacggttaagtttaaattaataattannnnnnnnnnnnnnnnnnnnnnnnnnnnnnnnnnnnnntaagaactactgta

SEQ ID NO: 33090 - DNA, 651 bp, Oryza sativa
atgctcgccctcgtcttctccaccacacttaaaaatttttgccccgaacgacctctctctgcttctccttcaccgccactgcctaaggcatccccgcgccgacgcctacgtcatatctcgccatcgtctcacgcacttcgtcttcgacaccttcatctactccgcctccaccgaatctctatgttgagagccgactccccatccctttctagctctctctctccgatctcgatctctctctctctctccctctctcccaaaccgccggcggccgccttgccacgacgccgccgcggcaccgcaccgtcacgccgccacgccgctgccgcgcaacgccgccgccgtgccgtgcgcgtcgtcgccgacgtgcgacgccgtcaccgtcccgcgcgccacgctcgcactggcccgcgcaccccgccgccgtcacggagcgccgatgccgcgcgcgccaagccgcagccgcgccgccccgccgccgatccgctgccgccccgtgaacgaacgaacgtgaacgtgaacgtcaacgaatgtgaacgagcaaacgaacgtgaacgagaacgtgaatgaacgaaacgtacatgaacgagaattgaacgtgaacgaacgagcgtgaacgaacgtaacgaacgtgaacgtggacggacgtaa

SEQ ID NO: 33091 - DNA, 3709 bp, Oryza sativa
  unsure (1)..(3709): unsure at all n locations
cccgatggtcggggatggtacaaaacagcatcgcatggaggttgaaatactcttgtgcatatgcgtcccatgtccgtgtgccctcattccatagcctttcgaagtcatcgattatcagttcaaggaacacatcgatatcgttgccaggttgtctcggtccttgaatgagcatggcaagtataatatacattcttttgaagcacaaccagggaggaaggttatagttaacaagcagaactggccatgtactgtgacgactgctcaaatcaccaaatggattaatgccgtccgtacacattgcgaaacgcatatttcttgggtcatttgagaattcctggtaaatcctatcgattgtcctccactgtattgaatctgctgggtgcctcagcatactatcgactttccgttcttcggcatgccagtgcactagcttagcttgttccttattcgcaaacattctcttcatgcgctccgcaattgggagataccacaccacctttgctgggactcccctctttgacttacttccttcaccttcactctttgctcgtttatatcatgatgcccctcagacagggcagacatccaagtcagcgtattccttgtaatacaaaatgcagtcgttcggacatgcatgaattcttctgacctctaggcccaacggatataatacttgcttcgcttcatatgtcgtctgcagtaaattgttcccctctggcaacaggtcctttaacagctcaagaagttctgtaaaactcttgtccgaccagccattactagccttaagcttcatgagttccaacacgcatgacaacttgttgtgcttcgacttgcatccatcatacaagggcatctgacaatcttccaccaacttactaaacttctcaaaatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcatcacctgcgacatcaggcgcctcttgctctccatgcttgctccagcaggtatatttcttcatgaatccattcattatcaaataagcatgcacttcatcgctatcttcgatcatctgttcattcttacagtccctacatggacacaacatgtgcatgctcatcctactttttctgtcattatccgcaaatgtgataaattcagtgaccccctctctatactcagtagacgaacgatgcgcatagtacatccatctacgatccatctgaaatcaacaacatatgaagaaaaatatatgatgatcaatatattgagaaggaatgaagaataatgtgttttttaccttgaattttagcaaaaaatcgcccccttgccctcccaaccgatttgtgaacaatgaattggtcgggatagaaagcagttggcggtttgggggtatttatagacccaacacacctcaaacgggttagattaaaaaagcccgtcaaatgtgttggtcatacctttgacgggtttcaattgagttgcctgtcaaaggtattgacctacctgtgacgggccgtaaaaaaaatccgtcacaggtggcggaccaccacctgtgacggctcataattccacggcccgtcacaggtgaggggataccagtgacgggttgggagaaaaacccgccacttcctcacctgtgatggcttttccttctggcccgtcacaggtgaggggatacctgtgacgggccacggccggatgccccaccgatgacggcaaacatagcgacccgtcaaaggtgacggtcatctgtgaccaattcataagaggtttccccaggtnccacctttcactggtattccgtcacagatatgggttctggcgtagtgacggatcgagaagagatatcaatgacctattgatcgagatggatgttgcatttgttcatatatagtatggccaatctatacactggcttacttaggttgacactaatatgcgaggtagggcgtacatctagctaggcaggcttcagaggcatcaagaatcgatgatgtgctgcattacgctgttgaggggagttcctatgctcggcagctcgggcactgtctgcagttggctcatacacgcgacagtcttggatcctggaagctctacctagtcctaccggactgaaagaaagctgtcgttcccgtgtcgtgactcgtgagtaaggtttgatccggatcatattatcttccgacaccgatcctatgtctaaaagacgttgacgttatacatttaactttggacgtaactacacaacaagtggtctaaatcagctaccactccatctataagagacaccatccatctatacttcaaatataattttctcttaaactactcatccgatctacgatccgattataccgttgtattcgtaacaattaaatctttacaacaagatctcacgattatattttgataaaaaatcacaaattagttttatgatatatctaaactacttttagatttcgctaagttacttcttatatatataaaagtaaattcagtaaagcctaaaagaaatttacatatattatagaagtaccttagaacaaaacgaaggtaaatttggcatgtcatttgaagtaaatccgttgtagatataaaaatatgactctatctagaaatttaattaatcaacacaacttatgaaattaacttttattaatcacctcagagcattatgaatgtataggaagtattttaatcaaatttaaaggtaacttatatttatatatatgataatttgttcaatgaaaaaaggcattaattaaagttactataatatatgtaaattacttttaggctttactgaatttacttttatatgtctaagcagtaacttagtgaaatctaaaagtaatttagacatatcataaaagtaatttgtgattttttatcaaaatataatcatgtgagatctttgttgtaaagatttaattattacgaacacaacggtgtaatcggatgagtaattaagagaaaattttatttgaaacttagatgataggaatatttctcctagttacttaatggattaggactataataaagtaagattcttcaagttaacacatatctgaataggagtcgctcgttacaactaaatcgagagtgccctcgatttagattttgtgtttaactttatagtatcatggtttgatatagtatcttgcccctttatagtatctttatagtatcttgcccctttgatgtaacacttagattgtgaccaaccgaattgaattcctgccatactggtctgccttgagaatccatctgtcttcagcctctccaatttttcttttttgttgcgatttgatgggcaggaactatggcagcccatattggtgggctcaggcctgtctagttcccaaatttttttcccaaaaacattgcatggaatctttacacatatacatagagcattaaatatagattaaaaaactaattgcacagttatgaggaaaatcacgagacgaatcatttaagcctaattagtccatgattagccataagtgctacagtaacccacatatgctaatgacggattaattaggctcaaatgttttgcctcgcggtttccaggcgagttatgaaattagtttttccatttgtgttcgaaaaccccttt

SEQ ID NO: 33092 - DNA, 22314 bp, Oryza sativa
cgcctggaaacctgttgatggaaaaaacacactgctctaggagatttgcttagctccagtgcaggtccaagacgttgatgcgatgtcggggtgccagttagtttgatcatgcaactgacaagatatgtaaacaatagataaaatagacgatcggctgacaagccgattgagtaattccagctgatagccgatattagcccgatgcccgattctaaaccgattttcgataggagttttcaggcacgatcctgttttattgtccaatgttagataatgatataaaaaccatcggttgatgataattaaatataacaataatataatccaatagaaaccaattggctactaataatatgataggataagtaccgatccgatggttaaagtatacatcggctaaaagtctgatgtccttaaatctacaagattagaaaaacggtgaaactttttattgcgatcggctaaatccaacttgtatataatccttataagccgatacaatgtccagataacttatcggctagcaccccgataaaacagtaacatgaacctattggtttaacaagatttacattatcaacaacaatctggtaggtcgaacctgaccgatgcaacacgagattacatataacaaatactcgatgagccgatagatctgtctaatgtgatgaatataaccaatataattatagcagcattgtgattgtagagatatatcagctaagacagaagatctaaactaaccgagatagtaccaactaagccaatgcgtctctaaacacaatgcaattagagatagaattggaaaatcaggtaggcaaatatatcaacaaaaccagaatgatccaagagatcaaaacgatgcagccttgaacaacatcaatgtagtcgatagatttagcacggccgacggaacgtaggacttaccccttcgtcggagatcgaacttaaccgatgcagccccgcgtcaggtgccaaattccgcccgttgataagtaaaacctcagaaaagagggtagcgatgtgccgagagtagtattgattgagagatcaattacaattacctctagtgtacatatttatacccataggtagatactagtccttgtaggacaagaaagaaaccttcataaagataaaaggaaaacataaattacttaacggacactaaacatactaaactaaaccctgcctaattaatatataaactgccatgtcgcatcctccttgaactcggactcttctagatatgcttcctttaattgatctttacccgaatccataaaaaatacaactgttggcaattgatagtttacatcggttgatctaggaatttgaagctgatactgattctaagccgatgattattccgggcttaccaaattttgtcgttaacaaaacaacgagacgaatttattaagcctaattaatccgttattagcacatgtcggttactatagtacttatggctaatcatggactacttaggctcaaaagattcgtctcacaattttcatacaaactgtgcaatttgtttttttttaaaaaaatctatatttaatgctccatgcatgtgtcaaagattcgatgtgatgtttttgagaaaaaaacattttgggaactaaacaaggccttacctagttgcgggaacaggatcacctacattttgaggtattaatgtggcccatattggtttgtcatatatcactatttgcactccacagtataggcttccggttgtcgctgctatctacccaactaaaaatctatcaaactaatgaccggatgcttgtgattcatgaagttttaagactgacaattctgcagctaatctatgcttcctataaagatacaacccactaattctaaagcttaacatacaaccatgccacatcatcatccactagcaataattacattttcaacctcatacaagtaatatcatctacaatctatttaattctacaaatcaacatgcaaacatattcaatcatcacccctcaaatcatttccacaatatttttacaaatatatgtatcatttttatagtaatatttaacataaacttatcaatatgttccacattaaagcgcgagattcaattgtttgtttcatgataaatactgataagccttgatattttatttgttttccttttacctttagcttgattgtcaaaaaaaaaatattgaaaagtacttagtaatccccgcagcaagacacacagggaatcacctagtatatcaattaaaaactatggatgttcataaatactatatgttggcatgcagaacagggatgtatttagtatagaaaaacagccagcacagtgtaatagaagctacaaacgaaatctccaccgtgaatataattttgaagagaaaggaagtgtatttagtttctagtaagagctagcgtgtagttgtgctgatcagtgtgtatcggtatcccaattacaccatataatgctatagggctttggaggcatggggaatttgacatgcacacctctagcttctttgacatccgcctccttgattgcgagagtacaggcttcccagtgtgttgccggcacagatgctctcacagtcacgtcggtgtcaagctaattttcttctctactccccaaagccaatgcttttgccgggctctatgttttctacggactatatatatatattccttctagacaaggggactcatttgctctgtaggacagctagcttcgagttaatcactaatatgcatgagatagttttttcacgaaaacgacttcgttcattggagggtttttctcgccccttttctttttctgtaagatattgggagagtgatcgtcatcgacaacctagctagcttggcttcataaattattgggcgtgttatatttgtgagtgcaaatgtgtaaaaacaggctagctagttaaatacataaattaaactttgttggatcgtatttgtaaatgcggagaacttaaaatgaacaaaataatttctcaatgaatcatgcttgttgtttttgtagtaaaagaactgaagagtacataggctaaatatataatgctcatgaggacatttgtactggtgtcaagcactatctcggccatctctggtcccacagccagggaagctatctctgctggtagccttcagtgctagttcataaacatattacacaaaggaatatatatagagaggggtgtatcaatggaaaatggacactcaacactacatgcataagttggcaatattaacctgaaacctaaggaaatgtcatctaggagctagttaggcttccgaggcatcaggaaccggtcaggcgtgaaaatatgcaatggagagtagtgcctacgctcaaccgccgtctacagctcgagcgtaagtatgctctgcaactgtcgcataagcaccctctcgattcgacgttcgcaaagtcatgactcatgaccgtctgtgcgttatcactttccgatgagcctatacaagtgacagctatcagcgaagcgtactttctagtatctatatatgcatccatcgtggacctagtctgatgactgatttctagcagtaagtatgaagggttcctcgaaaatttgggtgatttcaatgggaccgaaatttatgaaattccgtattttcggcactttttaaaccgagacatttttgaaattttgacagattttaactgaacttgaataaacttttaccaaatccaacaaaaaatggagaagacccaacaatttcagtcgatatattgatttcctggtggggtccgaaatttcgaaccgaaattgcaataaggtgaccgtattgactagatccatctctatatgaatattattatgtgttaatttgttcctctaaaatattgatggattgctaaacaacaagcgctactgcccctttcaatactacaagaatttttgaacattggttgatggtcatgggatgtgtatttcaacaatctggttgttatctaatattaatattactttaaaaatgacttacactccagcatattaacactattttttaataaagcgagtagtcagatgttattgcaaaagttaacggggtcatctattaaagacggatggtagcactattattaatgtccgacatgttgagtccgatgaacagaaagagattcacctgtggttgatcacctcatctgtaatctacgcaggtaccgctgaatttgcatcttctattgaacacattctcaggtgtattatgccaagcatacatgttctatttggctaatcaagacatccatgaatttgtttttattttgattgaaataataaattgtgctgataatcttatacttattgaatatctcttatctcaaaacacataagtgcattgacggcttaaatctcatgctcactctaaaatttggattatttgatcttaatcttgaaacaaataatatatattgatctattttttttctgaataaaaactaacaactgataactaatttccagatgtgctgttcatattatccatatgcgtactgtatacagtcggtggcatattattgatattcatgtcattggattttttataggtactattaattgcgatggtatattatatagagaattcgtgttagacagaacatggcatggttgataccaaggactgttcattcctataaaactaagaatcaatagatatagagctgtatctattgggactttatcaatttaattttgaatttccaaactgataattgcaaattgtaactgacattatcatcctaaaccctataatttgtaaatgattttgaattcgtaaatatggagtacaaatcttggattcttaatttaactccctagctatattaatttagttctaaaattaatagtcagaaagttgtaaatgacaggaaatcttttttattctaagccactacaaataaccaacatatttaacataaaaactttttatatgtaacgatagcctgtgcaatgcacaggttggcaactagttatctttaatttctaaagtgttgcattggctcatgttcaaatttatacaatcaatagttagattaatctttattaacttgaaccttatattgtctcggattggtccaatatatctatcaagattatttctaataaagaaagatctatatttgtttatatttgttttagttctgatgatagcataattcatctagtttcctaattaatcaattctcaatcggctagtagccattgattccaaccccgtcggcatctgctgggtacacgatctcatattggcccctctatataatctaatacaattgtttttctatcttgttagttataggatcgaagtaacctggcacgctctagacttatttttagaacctgcactagaggggttcagatcccctagagttggggcaaactccaccggtggatttggctcaatcttaactgttcttctgacttctacggctgggatcatggcccctactcttcttctaatcaactatcttaatcatatagatttagaggaaaacatttagttttttaagtgcttcccaccataaccatgattattctccggccaataatatcaataaaacaacgctgtccatcacaaaaccatctaaacaaacattagcattatgttcttgaggtggatacccttgaatcttcagtttgactgtttcaggcaatgaagaacaatatgccaatattaacaccatagctgaactaaagttcgatgacaaagactaagctgtctgctgcagtgctgctttggtacttgtaatttaattaggaaaggaaagaaacacggttacagagattagagaaaatctcagccgtataagtcaaaaggacggttgagattaggccaaatccacccggtggagttggtcccaactccagtggatctggagctgcactagagttaagcaaatgtctcggttttttcgtgtgttggacaaattttgtggcaacaggtgcatgtggattcacggtggcttgtggcacctgacgagtggacgacaaggaatttgttatgggatcgaggaagggaagacatatatcctactacaacttacagaatcgtccccaagcaaataccatataaatataattaattttcgtcctttttaaatttatattgttcgactatatattgatggtgcaaataaaagtgagccggccatgcaatgtgcatgcatgggctgacactaccatgcaagctaaggtaatgcccatcaatatatctagttgggcttgggaggcaccgggaaccgatgagatgtcaaaatacgccatttagaatactgcatgcactcggcatccgcatgctgttttcacagatgctccacaagtaatgaagccagaagctgtactagggatccttgatggagcggcaaatagaggttgtgtacagggtggtatcatttaaccatgagacctgcaggatcatatgcacgtaaccgagcatacgacgcatacaaggtgtcccccgttgcgttgcgcgtacaccagactgctgtgtgttgtgtgatgaaacaccggttttgagctatctgttgtaacgtccaagcagagacgaccatatatatctgtacacgatcagtgtttagattttattaaagaaaaacacattaattgattcatatatatgctgaagaacaggggtcattttttcattgttttctacgggttatagattaattgatggatatgctgaacaacggatgattgtacgttgggtgcgtggtctagcaacccggttgtgatataagctgagcaggtgtactaggataatttaaagtgtacatcatgacagtgtacaaagtcctgtactcctgtttggtgagaatggccggcgtgtgccaacgcgctgcttgtgctcattttgattaattaacggccggttcctgcccaaatactgagcagccgtgctatatagtttcagtttggccatggcgattgattgcggccgcccatatgcttgtttgggaagaaaaatcagataaagagcaaagccggccatctttcttctcaccctatatctacatgttcgtactcgtagtctccagttggggtttgggaggtatcggaaatatatccaactcgatatgcgtgcggaacattattgtttgaatgttcttcagtaaattagcaggaccaaacaggtagtcatgaggacatttctactggtgttaagcaactctgttaggtccgaagaaggccaagagcatgcgacatctacttactggcacttggtgttctccaagtacgtacggtcgtgaagctagtccaatgaccggttttgacctatgtattgtatcatcaaagccgagagtaccatatttcttagattagattttttttaaaaaaagaaaagattaattgatgggctgaatattttctgagttatgggtgcggtctctctgtgtcttcgtcgtacgcgtcgtcggttcaaactatatattcggatactcggattacattcgaggtgtgcttgtgcgatatattgacgggttctggcccaaattaacactgagtagacgagtagtcattccatcgtttgattaatttgccacttaatttcctaaaaaatcatggagtaattaatcatgtatgatgagcttacctacgtatatgcgtgttaaatttatgagtggctagttaaacaaggaaatgaaagtgtggatcgtatttgtaaatgcggagagagaagtaggtatgaaaaatataatttctcaatgagccaagctatagtttttttaatagagaactgaagagtacatatataggctgaataatgttcatcaggatgtttgtactggtgtcaagcacttacgcacggactcagcttcggtgacattggataggcaagtcacaacgtgacattggatagatctgggccatctaaaacacatccaacggagatggcgcttgggcccacctgcaggtcgaaatatcgccgcccgccgcccattcagctttcctgcgtccgaaacggcgccctcccccaatccttcccgcgcgcgctcgcatcgacgtttcgcctcgcccgtatccggccgtcgcctcaagcgcgagccagctaggaggctcaccgccgccgcgcctgcgccaggccgccgtgctcgccgcgagtggggatgggactggacggccgtgacctgtgaagtgccctgccgccgcgaccgggggcgcgtggagcggccggccgtcgggcctgacggcgtggtggtgcaggcgggcgaccgcccagccggagcctgacacgtcgaggggatgtcctggaggaggccgcgctgctccaggctcgctgatgctagatgagaaattggtaccagaaagttcagttcagttacttgaagcaattgcatagctcaattttcacatggttaaatctatttgaaatgccatattgccatggatacaagataagcaaaatatatttctcatttcacacaatcaagagaaaatgtaaaaaaaaaagatgaaattatgcaatatgccctattttttcagatagtgaattatttggaatacaaattcagatatttgtttgatactgtgttgatcagaagtctccttcacttctacacttagaacccctgcacgtagtagacccgcagcgcgtacaccgccgcggccacgagcgtgccggcccaccgccccgccgtgtgcggcgccacccgatccaggtagtgctgtgctggaatgcccgcgacgactctgtgcgccaccgctccactgacccggaggcggacccaccgccgccaacgggggagggctccatggtcgccggccgcgctggttgggggattccgaggcgaggcgaggcgagtcggtggggctaggtttcgtggcgttgccctgggcgatgggagcgctgcgcctgcgctgcgcatgggttggatttggtcaaagcgaaagcggagaagaggaggagaagggatatttcgacctgcaggcgggcccaactgccatctccgttggatgtgttttgaatggcccagatctatcgaatgttacacctgtcaccgaagctgagtcccgcacgcactagctctgcgatgtctgatcatcctggccagcaaaacgagctgctgacttataaatcacattacacccatagcgatacactggtggagaaaccatctttggtcagtcgatcagattttacaatagtcccgattgtgttataaaccgggactaaaaatatctttagtcccggtttaaaagctacagggtactttttcaatctttagtatcggttggtgttaccaaccggaactaaagatctatttatagtctcggttggtaaaaccaatcgggagtaaagattgacgcggagatcagagaagtgtgcgcgatcggatcgaggccggtacctcctcctctcctttaactcctctcctcaaccttatctcctcctctcatctttaactcctctcctcaaccttatctcctcctctcatccttatctctattctcctccttctcctccctactggcaggggcgcgagggccgcggatcgcgagggcggcgggtcgcggagggccagccggcgcggcgcgcggtgaggcggcggctggaggcggggcgcggagggccggcgcggcggctgcgcgcggcgaggcaacgctttctccctttttttttttgaagaatctgagattgttgtgtgatgtgtttgattggatctgagattattgtgtgctgtatttgatttgtgtgtgatgtgaatatgtgatgaattttgtagaagttgtgatgtaattttttttaagattttgtgatgtatttgagtatttgagatgatcgatctgtggatttggaggcaatttgaggatgattgatttaggattttggggacaggatggagtgaaatcaatatatttaaaaataatgaagaaaagaaaataataaaaaggaaccggaaagagcaaccagattagcctctttagtctcggttggtaacaccaaccgggactaaaaatggatttttacccccggtattttcacccgggaccactggtagagaaaccatctttcgtcggtcggccgaattccaaaatagtcccggttgcaataaaaaccggggctaaagatgatctttagtcccggttaaaaagggtaacgggcatatttgatctttagtcccggttcaaatgctgtcaggtcttgtcaggcccccccgggatctttagtcgcggttggtgttaccaaccgggactaaagatcgtaattaccaaccgggactaaagatcccggggatccaaccgggactaaagtgtcacccctatatatatgtcttcttcctcctccagctgcccaagcaagcttcaaaatttcttcaaaaaagaggggaggtcatgccaaaatttcaagtgaatttattttggtgattatatacaaatcagaggtgactaaaaggttagcaacttcatcctccaatgttttttttgtcatattacatttggagctatgttttgcacacttttttgtctccaaaatttagctgtaagttgatgagagagaaaatttgtgtggagaagaaagaatatatagcaatttagttgatttgctaaagaaggttttataaaatagttgagaaggaaaatatagtgaaagttaatcttaaataatagaaaacaaactaaaatgaaaattaaaagaagtaaaacacattaattaatattagtttaaaactttagaaatagtaaataagaattatttggtataatattttatgatttttgtatgaataaagatatgtcattattgtatgactgttgaaagagtttgtaattattttataattattgtatgactgtcattattgtaagaataattttttgtgtacgattttttttcatgtcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattctgcatccaggactattcatttccacttgtttgagtcggggttcatgccaagctataattgttggacataccacagagagcaaggtgttgaaatggaagaagatgaagtgtaagacgacaatattctggactttgctcagtacgttggatttaaaggaaatcaaacgggtgaggaggaaagggatgctgatggtaacgacgttgcggatgatcttggtcagatgttgcaggacgccaaggaggactgcgaaagtgaaaaggaggcccataaattggacaagatgttagaggaccacagaacgtcgttgtacccaggttgcgagcaggggcacaaaaagttggataccactatggagttcttgcaatggaaggcaaaaaattgtgttagtgacaaggcatttggcaatttattaaaactcgttaagaacattcttccggagggaaacaaattgcccgagacaacgtacgaggctaagaagatagtctgccatctaggactggaagttcagaagattcacgcatgtccgaaagattgtatcctatatcgcggtgaggagtacgagaacctagaagcatgccatgtttgcaaagcactacgatacaagattagacgagacgatccaggagaagttgatgggcagctagcaaagaagataattcctgctaaggtgatgtggtatttccctataataccacggctaaggcgtttgttcaggaacaaggggaatgctagaatgatgcgatggcacgctgcagagcgtcaacaagacgggatgctgagacaccccgccgatggttcgcagtggcgaaacatcgacagaaaatttaaagactttggaaaggacgcacgaaacatacggtttggtttgagtacggatggcatgaatccttttggagagatgagcagcggccatagcacttggcccgttacgatgtgtatctacaaccgtacgaagcctaaacatcgcagcggaaaaacagtgtttgctatggttaaagatcttaaagtagtgttcagaaaggggcctggaagccagcctatagagagcgaagatggtcacgccgcgatgtggaaaaagaactctatattttgagaattaccctattgggaattcttggacgtccgccacgcaatcgacgtgatgcacctcactaagaacctttgcatagacctttttggcttcctaggtgtatatggaaagtcgaaagatacactggaagcacgtaatgatctgaagcatatggaacaacgcggcgaccttcacctggaaccaaaggagaaaggaagccattacttgagtccagccagctacactcttagcaaggcagagaaggaaaatatgtttgaatgcttggagtgcataaaggtaccgtctggatactccacgaatatcaagcgaataataagcatgaaggagaagaagttcacaaacctaaagtctcatgactgtcacgtgttgatgacacaactgctaccagttgtaataaggggtatccttctagacaatgtccgggcaacaataacaaagctatgtgcattcatgaacgcaatttcgcagaaggtcatcgatccggatagattagaagcccttcagaatgatgtggtgcaatgtctcgtcaattttaagttgatattccaccttcatttttcaatataatgacgcatctgctttgtcaccttgtcaaagagatccgtattctcgggcctgtgtacctacacaacatgtttcctctcgagaggtacatggacgttctgaagaagtatgttcgtaaccgtgctcgtccagaggcaagcatcgccaagggttatggaatagaggaggtcatcgaattttgcgtagaatttatcgaagaccttcgcccaatcggggtacctgaatcactccatgaagggagactacggggaaagggaactctcgaaaggaaagcaataatgagggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggtaacgagtcgatcaaccaacaacttgccttccaggcgaggggaccgtctgggtcgatcgcgacattccagggatatgagatcaatgggtacacattctacacgagagcccaagacatgaagagcacgaaccaaaacagcgttgttcttgtcgatgccatgggacatgatggaacaactgccacgtattacggtgccatcgaggatatatgggaacttgactatggtcctctcaaggttcctctattccggtaccaatgggttaggttgactggtggaggcgtaatgattgatgacagtggtatgacaactgttgaccttaacaaggttggatactcggacgaaccttttatccttgccaatgatgtaacgcaagtctttttcgtgaaggacatgtctagcaaaggaaagaagggcagagggcctaaagagcctaagcgtcaagtggttctcccaggcaaaagaaaaatcgtcggagttgaggacaagactgacgaggattacgatcagttggatgggcaaccccctttcacggtgatgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttagatgtattggttatccatataaatcaattgatgtatggcataatttactatcattcatatgctacatttaattgaatatcattcatatgctaattataattgactagagaatttttaaaagtattaaatcattcatgtggcatttacagatgttaattagagtttttcacaatttaatttactatctttcatatgctacttatatatgactattcttatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtactttaaataatgttaatacattaacttctattttagaaacacatatgtaagcgaaaataatatgcagtgctataatctttagtcccggttcttaaccctaaccgggtttaaaaagaatttggaaatagcgggaaaatatctttagtcccggttgatatttactcccggttgttctcatcaaccgggactaaagatcgagggctatatatattcccgatgcgcgccctcgtcttctccaccaacacttaacgttttcggccgatcgatctctctcggcctctctccttcgccgccactgcctagggcaaatccccgcgtcgacgccgccgtatctcgctgtcgtctcgagctcatcgtcctcgccgccgcctccgcctcctccgccgccgccgcctctcccttcatcgcgatctccgatctcgatctctctctccgtcgcgccacccgccacgagaagccgcgcgcgcaacgctgccgccgccacgccacgccgccgccttcgccgccgcgcaacaccgccgccgcatgcaacgccacgccgccgccgctgttgccacgccgccgccgccgccgctgccgccacgccgccgcgccaagcgccggcccgatgctgccacaccgttgttaacgaacacgtgaacgagaacgaacacgtcaacgtacgttgccgtgagaacgtgaacgagaacgagaacgatcgaacgaacgagagcgagaacaagaacgatcgaacgaattaacgtgaacgagaacgacaacgaacgtgaacgagaacgaacgtgaatgagaacgagcgaacgaacgtgaacgtgaaatgcaatatatatatgttacttctcatttatcctaatacatattttttgtatcttgcagaaaagacatgttgtcggagtcgtccctcaagccggagtagaagagctagccctagaaggaattcgtgcaggcaagtgacgtaataatataaatgattgttatatttgtaatgcaattaagaatattagacttgtaattagacttagcatataagattgtgtagtgttctaattttatttgagttttaatataagattattttattgcaaattagacttagtatgtaattattgactacagaattggttcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttattgcaaattagacttagtatgtaattattgactacggaattggtgcgactcctagcagttgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgcggatccaaaccagtacttgaacgaggaagggaacgtggagagggatgcggaggggaaccagcaggggcacgtgaaaagggatgtggaggggaaccaggaggaggaggctagtggtagtcaaccctccgttggacagaagagggcacgcaggcaatgaggtgcagcgaagaagcttgagagtcggcacatcataacggaagtggaagaagatggacgtcctattgccccggccgaagccaccaagaactatttacgtcacagcggttgggttgtgcgggataacgtgcctgttagtacggtgtactggcaaagaacaagggcacgtggagatcatgagagctttgtctcagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaagaggcagacaccgaacttcgacacatttccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaaccgccaattggccagaacgatcgaagttctggtactatgctcacggtggaacgctcaacctagctgatggctcactggtcttcggcgatcagatacgagaggctgcgcgacgactaacagatacagtggaagcctcgtctcagggcacgttccgaccaaacagagatagggacgagctgacactcgccctgaagactccagagcttccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacagggcaggtaggatcatagagcatggacgctatgcaaacacaggacgaatcgacctgtcccgttgatgacatcactcagcggacaccatgtgagctgcatattccttacaagaacttatcaataaagataagctcgtagtttatatattttaaatttagccattccgctagttgctgcttatatatgttgattactaataaataatctctcacaacataaaggtggcgtcgggcatggccatcccaacggacccttcaggtacttaccactgcaggccgattccagcaggatactcgaaggtcaaagttgagttggtcgaaggcgcgtacgaggacctccagctggattaccctggaggagacggtgagacgcatctacgagacacaagccatgccattattctatggcgcaggcggtacatcatcatcccttggcgacaagcggcgtctcgtgcaccatctcctccggctccaccatcaactcctcaggatcctgcaccgtctcctcctcattatccgccagcaccgtctccacctcaggctccagcaccgactcctcctcagtatcctgcaccgactcctcctcgggctcctacacctactcctccgcaagctcctcttttggcaccttcaaagtcaagggccctcccagctccaccgcctgcccccacaagggcaacgaagaaggcgaaagttgacgccgccaagaacaaggacccggggtatgattgcacgcaagaggagcttgacgctcatgtggcatcagaagtcaggagacaattgaagcctcgaagtccagaaaaaaagattcctatagacccgagtgtcaggaacttcttcaggggtatgtctgcacctgccaaggaggccataaagctattgaactatgagcgaaccctcaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccttacccacacaaatgtacaagttccatcagctttacatggagatgagcgccaccggtagagagatgatcgaagcgaggatcagggacacggacttcttgcaaggagatgacattctctggatcaatttcaggggaatctacgaactataccagctggacgccctcgacatctctattatgagttgctggattttgtaagtatgtcgttcagttagatttcttactatacgtctcctttaattagttaggtccttgtatataagtagactatagaaaataatatactcccttttatcattgtagaatggagattcaaagggcccgacggcggagggttttcgatactggattcatcgacactcggagagtaaacgtcgcaatgctcgaccaatatccacaagaaacagtggacaatctcgtccatctcctgaaggtgcagcattccaagacgttcatactgttgccgtacaacacagagttagtttaattttactgtcttcctacataccaaatttcattcccgtatgaacttgctaagtgtttcatatgtaatgcatcccacgcacattgcaaattccactgggtgcttttactcttcgacctgtcggcctgcaccgtcaacgtatatgactcaatggataaaaaagagtctacgtttgacaaggtttatgaacttatagataggtaccgtcataagttcctctgttaattaagaaaatcttgttatgttaattgctactacgaatcatagctttaaactccatgtagtgcttggtatcggttccgtcatttggtccgcggcaaatggagagaaagacttaggcggaagttcaaatttcctgtgagtacacatgctctacttttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgtagaccaaatcatcaccacaagagagctcgatgtacgtacaaataaattcaaaatttcattacgtaacgatttcttgtttaattgctaatcaatttcatacattcatatagtttattcgcatgagggataacctgactacacacaaggaatttatcgcggcggttcaagaacaactcatgggattcatcaacgaagaaatacttgatcccaagggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatatatatatatatatatatatatatatatatatatatatacacacacacatatgcatttgcataacatatatattatgcatgtacttatgtacttatgtactgaaccatatatacatatataatatatatatatatatatatatatatatatatatatatatatatatatatatatatattgaatcatatatatgcatggtttatatatatataaaccatgcagcaacagggccatgaaaaaaaaaaaaggtcagctcgatctttagtcccagttggtaataccaaccgggactaaagatggctcagccacgtggatctttagtcccggttatttcacccgggactaaagatagcgatctttagttccggattggtactcccggtttaaaaaccaggactaaagggggttacaaactgggactacaaagggtttctccaccagtggctggttctagctatagattaatcttggttttgagtatcgcatttgttgtctagtctatgatcaatgtcaatctgtgtgttgccgaaaggaattttttttatctgacttgtttatgttagcagatcgagtctactcccaaaaaaacgcgtggtcacaattcgagtagtaggtcagaaggcaagtcttgttcgcttcctaatttcttgcgccaacagaacaggaaagaccgagattttcttcctgtgattttggtttattccaaaaaaaaaaagaaaaaaaaaagagctgctgcgtgcatatccatgcaaggaaatttcattccagtgctagcttgagtcttcttgtaatttaattagccggttgttccatttgatagccgccacttgttcaaagaaaaaaaaagaaaaaaaaggcaggaggtgcaaaaaaaagagagaaaaagagccgcaccaaaaaaaatcagaaaaggaaaaaaaagaaaaaaaatcagaaaaagaaaaaaaaaagagaaaaaaatcagaaaaagaaagtgtggaatttttttgttggaatcttggagagagttgcttactatagcaagttgtggattgttcgactgtgatcatttgcttgcttaagttaggattgagtctagactacggcagcaattttgactagtactttggactagtattcaatttcgcaaatctgtttgatttttgctattccttgtgatatagttaagcctatcaagatccacatactactaacctttacaggtccggctttgcaattgctccactcatcaagcgtgtcattgtgccacgaaccagccacggtgattgacctgttttgcattctttgagaatattataagaatttggtgtatgcttgagtgttgagtgccttcaaaagctccacatatctatagattgttaggaactgatactttcttgtgagtttcttttgcttgctaacgatgtcaggtacaagttccaatgaaccaacactggagaatgtatcgcataaactgaagggcatggaaagttggtatgaagagttgatgcgtaatagtaaatcatacaaggaaagcatagataaacatttaaaaaccttaagtgaaagcctggtgaaagtagtggatcaaattgagcaaatgaatcgatcacataaacaattaactgaaaacattcagaatatgaatattggacatgaaaatattgtgcgacgcattggtttacttgaggctgcaggtgaagaaggtgcaggtgccactgctcatcgacaccaaagatatgacgatgaagacgaagagaaatatgttgctgatgatgagtaggaagacgagagtgttggaaatagaagacgatgtcgagttagggagaaagatgattatttatctaaggtaaaatttactatgccttcttttgatggtaagtttgaaccttctatttatctagactgggagctaactgttgagcaaaaattctcttgctatgattttcctgataataagaaagttaaagctgccagtagtgaatttacctcctttgcatctctatggtggaatgatatatgtggtagaggacttagacctagaacttgggatgatatgaaacgtacaatgaggtctagatttgttccttcttactatgcttgtgacatgttaaataaactgcaacttttaagacaaggtcccaattctgtagaaacatactatcaagagatgatgattgctttgtcatgctgtgatttgcagaaactgaggatgctagaatttctaggttctatggaggtcttaatagagagattcgggatatttttgaatataaagaatacaataccgtgaatagattattccattt

SEQ ID NO: 33093 - DNA, 9229 bp, Oryza sativa
aacaccacgtcaatctactgctgcctttcgtccagcttcttccacaccacctaccttcacgccattccatgttcaagaaacaagcaaaaatgcttcaattcaaactctagccaagagtgaaacttcagtagtttccactggacgtacctgtgatactacatgtcataggggccatggcattggacacattgcatgtgactgtccaaatcggcgagctttatttgtgaacgctgatggtaagtatacttctgctagtgattgtgatgatgaatatgctttagctgccactgaccatgcaggaggacaagataatgatgacatcgaggaagtccatttgcatccagagtcgctagatcagtatcctagcctaattgtcaagctagcacttagtgctaaagagaagtgtaaagagcaaaaccaacgtcacaatttgttccaaagcaaagttcttgtgaaaggccataccgtgaaaatgattattgatagcgagagttgcaacaatttagcaagtgaagagatggtcaagaagcttggcttgactacccatccacatccacatccgtatcatattcagtggtttaatacatgtggtaagatgaaggtaacccgcttggttaaaatacctttttctataggctcctaccatgatcaaattgaatgtgatgttgtgcatatgcaagcttgttctgttattttagggcgaccatggcaatatgatagagaagttgtttttgatggtaggactaatacatataaatttatgttcgatggtaaaagagttgttttgcattttatgactccagccgctgctttgaaagatgatcttgcaagacttgaatgtgaaaagaaagcgaaaagtgaaaatcagattattgctaaacatcctgcttcaactagtaaaatagaaccaagtaccacaaagaatttagttttgtaatttagttggtattagagcttcagttgactagtgaggattttaattttgtaattttttccccatcatccactatacagccacaacacttttccgttcaccaaaccatatatttgtgccttgcgattatcatcctatttgcattattgaattttcgtccctcgtcgtgtcagtgctggtcatagctactgatgacgctctctctcgtggcccgatcttctggtgaggggataactctcgctttgatcgagtgcgacatttgcgacatagctaccaaaaagaacaagtccaggacgccgtgcaatcgctacaccacaaacgatgtcgtaccaaccgtgacgcgcggttgatgatccctgcaatgtaaacgagaaaacactgcaagaacaagataagatgcaatctaaatattgcgaataggtgattaagcacaaggaatagtttcgattgaagtggtagatctaatcgacccggcaaatcaacacaccaactattgggggctctgaatctaaagtcgccgactaatcgaacgagaactagagataaggtaaatggcacttggcaaaattcaactaaacaaaacccaattgtttttgaggatgtacaaagctatttatagaggaaaataaagctagggttaagtgctaattcgtggagctggagggagacacttccgatatgggcctagtctattataaggcccaaggcccaagttcggtttcagcaacaccactgtcttgttttggcgattcctgttgactcgagacgaatttggacatgagactggatgcgtttgaaaggtagtgagataagctatccacgaagtccaagatcacccaaatcggagttggcatgaagacgctaggtccgtttgaagtcagtgctgtctccggaggccgaactggacttggacttggaattatcattggaacatgtgaagttatgagcgtatccgacgaagtgatgtcctcattaatatgtgtgccacatgctatacttgtggtatctatgcttggtgccctctagggaaacaaagagaagattgatatcatgcaaatagctcttcagttcttcccataaaatatagtttttttatgttttgtttagacacaattttgtttatggtgttaatcaaaactgcttatttttttatggtacaaatacaatgtaatctttagaaatgagtgaggttaatcactaaaaatatatgtagctaaacaaacacgtgaccgtgacaactgtagtagcatataatataaaagttacaattttgtgataatttcccacgctattgttgcagcaaactgaaacatgtcgctaattttgcagcaaattgatagttttgttttgcagcaaactgaaacatgtcgctaattttgcagcaaactgatagttttgacgctaaagttgcggttttgtaaaatttactcttgtttatattcaagaaagatctatattttagcatcttgtttgttttcgtcacttgttgtccataattgcatgatacacctttagtaattctaaaattgtattaatttcccaaaattatttataataactaatttgttgaggtgtacttatagttacgtcactatggtatggtttggtttatgattgttatattataattcctcaactataacaaaatatatggtgaatagttttatactcatgctataggattgttcatttgttaccaaacctatttgacaaagaaaaaacgtatatgctcataattcttgtgatggattaaggagtcatattatagcaagatcattgccggagcataccaatccaatagttatgaaaaatttaaaaactttgagaatctcaatctcacacaaactaaaattaaatcagatattgtcacgcccggaaattcactaataatttccgaactaatttgtgcataaaatcctcgtccaggaatcagccgaggtacacaaactgacaatttaatatacaaatccatcataataacgttacatacttacaaaagaaaagaaaatagcagtggaataacggtctagcgatggcttcagctctactcccacaggcagctcaactggggtataagccaaacgccttctccttctggatcctttttcttcaactgaggttgattaattattgcaagaatgagcatatgacatactcaacaagccacacagcaaatatgcaaatgcacaaggataccaaaggatggcataatatagtcttatttgcgaaagcagcatttagcaaagagctaagagtagtaaaatagtagagtaattaatcagaaattttaatcaacactgaacagcacacccatgctgcacaggcccaaccatcctgaacaaccatacccggctatacagatctaactccaaaccaggagctaaacaaattattaccagttatagcatcaataattattgtgagaggtgtgagactaatcacgaaaaacattgctcaacccgcccataaccgcgggcacgactattcgaatagttttactctggccagaggtgtaccactgtacccacaagacacagccccacagcatgtcaccatgcgcctcaataccaccacggtaccttggaaaggagctgtgacagtacccctcgcagaacacaatccaccacagcgcacctttcctggatcataatcaccctcttataaaacaagacatggactctccagcgacccccgtgggcttatctccgccacttctcagtctggtgctctgcaatgaaccatgctatacaaaaggtaaagccattgcccacgctggcttgtggttggcacggttaatgtttcacaaaagtagctcgcgaaccggtccttaattgtcatgagcatgactctcaaaaccatgtgctcacaacctaccattatcaagttttagttggcaagtaattaattaaccaatcacgattgaccatcgtgaactatcattaagccatcattaaataatagtaagtcataagttatcccaatagtgtgctaatgtttctaagcatggctaagaatcatatataatatctagctgaaccaatatatacaaagctcaactagtcaaattataatatcccaaggtatcaaggaatagagtaatcaatgcaaacaggccataacaaaggaatagatttacaccacccagtgacattcgaaaataaatgcacagttgaaataaatagagaatttaaatataggatcaacatgctcaaaggattgtttgggatctgtgtgacttgccttgcaataatcggtcttcaattaatcttctgaacacttccgacgcactgacgaaccttcgcaataacggaaacgacaagctaacacgcaaaacgaagaaaaagactaataaaaaccaaataaacagtacaaaaacaagcataaacagtacatgtggatatttttaacatgttgatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaggcaattattacgtcagcggctagggtttgcggtggaccgggtgcacggcggcggctcacggaaacaaatggccgagattcatccatccaaaacggacggccaagatccaacggtccacggccagaccacgagagacgatgacgatgacgtcaccaccggcggtggctcgggcgcgcaaactcgccggcaaacgacggcgcgacgacgcgaacggaggacaccaacacgtagagggcgatgcggcgaactcaccggtgaccaaaacaacggcggaagatcaacggacggcaacggcgtcgaggaagaagcggcggcgaccttcggcttgacgacgacggcgatgctccggcgacctacggcgatggcggataggcggacgaggtcggcgatggcttggtgatcacgacagcagccttcccgagcgacgacgacgacgggagcggcggcggcgcacggctagacgaacggcgatgacggcggcgctagactacacggtgctagggctctaccggcgacgagaggcgaaagcgagggtggcggcgggtagcggcgggcttgggggtccttttataggggcaaggaggcggcggcaaaggcccacggcgaccagcaacgcgaaggaaagtgtagggttcggaggagagagatcgatccgaatcgaactcgaatccacggatttccaaacgattttagccgatgattccaaaagagaaaaaggtagaggagatcccgaagatcatttcccctctatagatttctccggagaaggaaaggcgcgagcgaatttggaaggagacggcggcggcgcagctcggctagggttccggccgggcgacggcgcgatgaggacgacgagtccgacaggtgggacccacctgtcagcggccgagcgcgcgcgcgggcggctgcgggctgactgggccgaagaggagagagagggaaggttttgggccgactttcggcccaaagccaaaagaggacttctagaaccttttccaattaaaataatcacttaaattatatttgaattgttaaaaatacttccaatgctcaaataatttcaagaaaaatcctgaaaatacttggacactcgaagtacttaacaaaattataattagaccatctaatgattaatttaatatgtgggtaattactgaaaagctctttgtatgattaaaaaaaattaggaattgagctccgaaaaaatccgagaatattccagagagtataattaaccatggagaatttaataaaaattaaatccatctatgctttatatttaggaagttttatttcccacctttaacttcacttgtaaattaatgaacatttaatataaattctaataataatttattaaataatttataaatcctgaaagaaaaatcaggatgtgacagatataattaaaaaacataacgttgcttcatttttcatgcatttagattccagtttgtgttatataattgtcaagtgatatttgaccataaaatataatgttaaattatttcgaagattatcatgacattatttattatattctgcctaaattattttaaaaagtattatgatactccctccgtccgataatataagggattttgagtttttgtttgtgttgtttgactacttgtctgattaaaaaattacttattatatgtcagctccaggtgttgtaatgtatttagcactataatataactatgatatgttatcaagatttgaatgcacctgattataagttgactataaaatttaaaaataatctaaaaaatcgctgtttaaacacatttaatttgtttttatatcgacatagtttaacttgcatatttatatttggagtaataaattttattttatcgtatataaaatcctattttgaagtccgtctatatattttttcgatggttctaccaacttatattagtatttttcgggctttatagttttattatcgcgcgttcgtatgtttctttgctttttttcaatcgaacatccagtaaatggtttctctggtatacggtatacacaggagattaaaaggaagtgggctaatcttatgatccaaaataatgggtccatcattttgaatgaaatttgacaacgaaattatatagtaccacgtggcattctaatagtgcttgctgaaacaccacatgaccatatttgtggagtgataaattttatttttatagtatagcaaatcctattttaaaatgaccgtatattatgtaccttttttaacggaacagtactatatagccttatttttactcgtgcatacgtaagtaattttttttcaagtgaacagtatctttttaatagctgctccctccatcccaaaaataagtgcagttttgcactattcatctccaacgtttgaccgtttgtcttatttgaaaaatttttataattactatttttattgttattagatgataaaacatgaatagtcatttatgtgtgactaattttttttataaatttttcaaataagacggacggtcaaacgttggacatggattttcatggttgcacttattttgggacagaggtagtattacataggtaattttttttcaaatgaacagtactgtacgtacgattacacgatgccatcgtacgtgcgtgtgcgtacctatgttgaagggctagtttctttccatagtacgtacgcaagtttttatggtgtaaacggtttcactcatatctataaaatattaagagcgagcaatatatgtattctaatggtcttaaataacggacccattaatttaaatgaaaattgatggtgagattttaaactaccacgtggcaacctagaaacaacatttgtaggagcgccacgtggtggcttagaagcgtttgtagaaaatttaatggacttttagtatataatagaatagatatccacatgatgatgttgtgtcaacttcttcatcgacgatggtaatcagtgggcacgaaatttaaatctcttgggtggctttcgaataatgtcaaggttcttggagattaatcaatcccagtacgctttgtttgatctttcaagtggtgatgtcaaagtgagcaggcaacctacccgttggaatgcggggtatgaaaagaaagaataatatttacgagacgagctgagttgcattggtttgattaagattccagaattcttgaaattttggcaaagagaaatgggattccatcgagctagaggagcaattaacactggtagagaaatcgtttttagtcccggttcgtaacccccctatagtcccggtatttaaatcgagactacgaatccgggactaaagatccctctctttagtcccggttcaaatacccgggattaaagatcgatatttagcaccaaccgggactaaaaataggagtggcagtcacggttagttttttttttcatttattgctacttactatctctaatttattttctcccaaattaggtgggatgcatatccccaaatcaaaccccaaatcaaagtcaaaccccaaatcaaagaaacatcccaaatacacaaatcatgtacatctcagatccatgcaataaatcacagattctaaaaaagaaattatacatctcaatccatacaatgaatcacaaattcttcatctcaatctatacatggatcacaaattcttcaaaaaaaaaaaggaagcaaagccgccggccggctgagccggctgctgcctcccctcctccccggccgccgccgcgccgccctctgccggccggcccgccctccccctcctgctgcacacacgggaagggataacaaagaaaagagataaggaggaagcgaagaagggaaaatattaggattagagatgcagagagagagtagtttgtgtggacgggaaaagagaataaataatagggattatatagtgcgctttgatctttaatctcggttagtaacatcatccgggactaaaggtcatcgtgatctttaatcccagttagattaaagatccgatctttactcccggttggtaactccaaccaggactaaagatcctaaaggggcctgacaacacgactaaagattctctggaggggcctgccaacacctgatagtatgtgaatcaggactaaagatgatctattaaaaatcatgtagtctcgttctgcttataaaccgggactaaaaaccatctttagtcccgatttttattgcaaccgggactattatggttttggtcgaccgggcaaagataatttctccactagtgtaagtagcaatggtacttgaagcatatagctaacaatctcttgctgcatccattctcatctgacgaaggacgatgaaaatgctgagcacggacgagctaggagattgtcctactggccgtttgttggtaagaagaagcagcatgaatggccagcatgcggacgtgtatatgcacttgtggctccagctctcatggcggatgtttggtcgattcatcacatagaggcatgaccaccaacaagcatcaaaagcgtctccaagccatatcgatccatgacattgtccgactgctcatcaatggctcctagtgccttccatgcctatggggatagaggacacagagcctgcgaagagcatgtatcgagccacgatgttgcatgggctgaaagtatgcttcagtcatttctctgttttttatgcgtaggagtatttataaggattcctgtaaaaaaaattataagtacgtacttgcgcacttgcag

SEQ ID NO: 33094 - DNA, 9361 bp, Oryza sativa
aattacaaaagataattctataccaatatgttctcataccttctcctatcttagtaaataaattacaaaagataattctataccaatctgttctcataccttctcctagtaaatgaattatgtggtgatgttacaacaaaatttttcttttaaaataaattaatattaaccaatggttctcgacataaaattattatgccgatagttgtcaacatattaatcttgctacaaaataatatttgcacgttattggccttctcttagtaaataaattacaaacgcatacccataacatttctcttagtaatacattgacggatacctaaacgatttcggtattcaaagtccttcgacgaacaaatggtagtattttttttcctcaacgatatacacagctgttattctggcagtaaaaaagttcctaattgtcatgcctggaatttctatccaaaattccaaacgcttacatgtatgtaaaccctcgtccagtaatcagccgaggcacacaataacaaattgataatagagtacaattattactctaattaataagcgaataaaatgtcattacaggggtagatagttcccctcaaacaataaagttctaagcagtggaaaataaagaaacagcgcaggcgactcctctccacatgcagcttgatcagggctacgcctaatcatccacaccatcagcatcactgtagaactcctcctctgatgaatgattgcaaggtgagtatatgacatactcagcaagtcacgcagcaaatatgcaagtgcacaggataacaaagaatatcatagtatagtctcatttgcataaatagcatttaataaatattttagaatttaataaaacagttaaataataattaaacaatattaatccaacgctatacaacataccctgttgcataggcccaaccattctgatcaaccaatcctggctgcacagttctatctccaaaccaggaattaaccattccaaaccaggagctaaataagttattaacatcaatatggtgagaaatgtgagactaatcacgaaagacattgttagaccagcccataaccgcgggcacggctattcgaatagtttgaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcataatcacccccttataaataatgtatggactccccagctacccccgtgggcttatctccgccacttcacagtctggtgctctactatgaaccatactatacagaaagtaaagccgttgcccacgctggcttgtggctggcatggtaaatgtttcacaaccgaaaatcgtgaaccggtacttaattgtcaagagcacaaccatcaaaaccatatgctcacaacccaccattatcaggttttagttggcaaattaattaattaaccaatcatgattaaccatcatgagctatcattaagccatcattaaataatagtgaagcataagttatcccaacagtgtgctaatgtttctaagcatggctaagcaattatatctagtatccagctgaacccatatataaagctcaactagtcaagttataataacccaaggtatcaaggaatagagtaatcaagaacaaaaagggctataacaaaacaataggttaattccacccaatgatattcgaaaataaatgcaatagttgaatagaaacaatagctttaaacaggattaacatgctcaaagagttgtttgggatctgtgtgacttgccttgctggccttgaaattcctcaaaatcttctcctgcaaattcggactctccgggaacgtcagaatctaaagagaaaagaacaaaattgtcacgtcccaaaacgactctaaaatacatcctctaaattatgcctagaataattaaaatccgtgtgaaagcctccaaccattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctccccctccctctcctgtccccgcggcccatccggcctctccccgcgcgcgcgccgctgacgggcgggcccgcccgccaccctcgctgatgggtggggcccacccatcatccccttcctcccgctgcctcgcccgcgccctagcgccgccgccgccgcgaatcccgccacctcccgccgtctccgcgtgcaataaagagggggaaatcactccccgtgatcccctctccctttaaccccatttttccctctctctctcgcgttcaaacgggcggatttgcccccgcatatctcgccggcgccattgatggcggccggacctcccgcgccggtttcctcccttccccggccaccctctcccgacccagctctatttaaaccctccccgcacctcctccgtccgtttccgcctctcgccgcccttcctcctcgccggaatcgagctcgcgccgtcgctctctctctccgccgtcgctgtcgagctccggtccgccgccgtcgtcgccccggaccacctcccaccttggcgccgcctccttcggcttcgccgcatcctcgccgacctcgtccacccctccgtttcgctcgccgaccgccagaacgccgtcgacccgagccgcgccgccgccttcctccgctccggccgcctttttcgtcgtcgccgtcgacctagggtgagccgtggaccgccgcttcttttcccccttcccttcccctctctcggccgccgctccgccgtgcctatggccaccgccggcgaccataggggcgcgggcgctgcctcccgccggctgcgccggcttggccgccctcgggcgcgccgagtggctgccgcgtggggcctggccgtcagccgcccgcgcccttaggtgcggctgacgcgtgggacccacggcgccggccgatgtaagcccgggtgcacccggtccaccgtggaccgtgaggctgccgcgtggaccccactctcgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgtttaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttttttaaattcccgcgttatcattgttttatctagccatgcctatgtacctttgttatgaccttattatccttgttcaccctagaataaacaaaaccccaactagtggacactctactcatggtaccactagtatgattttagttagatgcttcgctggttaattaggtaacattaggtggtttacaactctagaccttgggaatactcttattacctggacactatggaattgttggattattgtggaattggattcacacctccccctctattcaaaatcctcaaaatggttttaggctgggctcggggtgcatggttttgatagtagcacctcggccatataaggaccggtcttcgggcctctgttgcaaagaactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcagtactcttgtctatggcaaggatgggttggaaactatgtcacgtcttccgtccgtataccgtggtggtatggggcacgtggttacacgtgaggaagatgtgtcttgcgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttgggacgagctgggacccagggtcaggttgctagttcggtctaaatcatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctttatattataacccccttgtactcccttgcatttatcctgcacttgtgggtgtgtcttgttgaatacggtggttgtactcagtcttgctcaatttttccgaaacccagaagaggagcccctggaagatgaaggctttggtgtctagctcgcgcctgccatcaagcgcctgtggtcgtcgccctagccttccgctgtttcccatttgtctttgtgtgtgctgggccttcgccgcccatgtaataaattaattaattacgcttcagcttgtaaactctgaattgtatcaacttttggtgtaccttgcctcctgggacaaggaataatgcacgcacgtaaggaacgcccgttgggttatttccggtcgtgacaaaaatcaccaaaacagcacataaacaagcatgaacagtacatgtggatatttttaacatgttgatctcaattttagaaaaatttatagacttgaaccaagtaaatccgagctaagatgaattagttatgaatttttaaagattaaatcggattaaatcatttatatagattttaattgaattatgacgcaataatgaattatttttgaaaaggaaaaagagattattgcgtcagcggactcggctcacggtggaccgggtgcacggcagcggttcacagaaacgaacggccgagatcgatctatccaaaacggacggccaagatttaatggtctacgaccggtctacggcggacggtgtcgatgacgtcagcggtgacgtcatcaccggcgacggctcggacggcgcatcctcgccggcgaacaacggcacggcgacgcgaacggaggacacctacgggttgcgggcaacacggcgaactcactagtgaccaaagcagcggcggaaggtcaacagacggcgacggcgtcgaggaagaagcggcggtgaccttcagcttgacgacgacggtggggctccggcgatctacagcgacgacggaggggcagacgaggatggcgacgagatgacgatcacgacgtcggccttccctagtgacgacgacgaccggagcgatggcggcgcacggctggacgaacgacggcgacggcggcgctaggctacatgacgctagggctctaccggcgacaagagacgaaagcgagggtggcggcgggtagaggagacaccgggggtccttttatagcggctagggggcggcggcgaaggcccacggtgaccggcggcggcgatggaaaggttagggttcggagagagacaaatccgattcgagatcgaatccacggatttccaaacgattttagccgatgattccaaaagagaaaaggtagaggggatctcggggatcatttcccctctatcaatatgaccggagatggaaagatgcgatcgaatttggaagagcggcggcggcgcagctcggctacggttcggccgggcgacggcgcgaggaagacgacgagtccgacaggtgggccccacctgtcagcgggcgagggcgcgcgcacgcgggcggcgctcggctgcgggccgacctgggccgggaaggagagagagagaggtttgggtcgactttcggcccaaagccaaaagaagactttttaaaacttttccaatttaaatttttcatgaaatgcaattccatttattaaaaatacttccttggctcaataaatcccagaaaaatctaggaactatagaatcaagcaaagtatttaataaaattttatctggcccaattttatattggaatttattatttaaaattagatcttctcttctaggcttttaaaattatttctaataattccaattaaacaataatttatatatttgagatttttagggtgtgacactaatacattttttttagataatggaagtattattaatctcagtaaaattctatcaagtgatacaattattctgagagcacctccggcttctgcacccaaagagtgcacacagccaacaagaaagaaacgaaagataaactcatcatccaaatagcagggacaaaaagaacttcaggagccctctaaccgtagcctagaatgccacccatgcgccggggtagaaaactccatggccactagctccaattgttgacaagccggaatgatagttccctgcaaattgaccttctgaaggatagcccatgagcggagccaatgtgtaataaaaaagataacctgcaaaggagaagatatgtttttttctttcaaaaaccacatcatttctgcaaagccaaatagaccaaatagttgttgttgccctaacaagaccaaaaatctcaaattgcgtggttgtcttcttatccaatgcccaaacatatgagttgtactattaggtaaactaatattcgaagcaaactggattaaataccaaactgcgcgggtaaaacgacaatcaaagaacaaatgattaatagtttcatctttatggcagaaagaacaagacttgtttcctctccaattcctttaaataagattatcttttgttaagactactccacgacgtaagtaccataagaagatcttaatctttaggggggctttgatctttcagattcttttgtttatattgggaacattggtctccaccaacgcaagataaagagatttaaccgagaatctgccatcagtggttagattccatttaaactcatcttggtcgtgagataatataatattagcgatgcgtgagagaaggtgattccgcgctactaacttagagccagtaaggtccctacgccaagaaaagcttagaggactggtttggaaaatttctgaaatagttgcatgtttatgcctaacaacgttatagagacaaggatattgttctcttaaacaggcattctccaaccatttatcttcccaaaaccgaacttgagagccatctttgatgttgaaggagccaaacctgagaaaatcaggcttagccttcattagactagctcaaaagtgtgagtctcctgctttccactaagcttgagacaaaggctgtgaccccaaatatttgttccttagcatttgttgccacacaccatctgtagtgagtagtttatgcaaccacttgctaaggagagccttgttcttaatttcaagatcttgaattcccaacccccttggtctttaggacgacatatgatgtcccaccttgctagtctatatttccttttgtgtccatccccttgccaaaagaaccttgatcggaaataatcaatcttcttgatcactcctttaggtatttccaaaaaggacatcatgtacattggtaggttggtaagcactaaattgattagtgttagttgccctccaagtgataaaagtttgcctttccaacttgccaaccatttttcaagccgttcaatcacttccttccactccaaattacgaagtctcctatgatgtataggaatgccaaggtaacggaatggaaaagaaccaacctcacatttaaaaaggttagtatattgatcctgaactgtttgggcttcaccaaagcagtaaagctcgctcttatggaaattaatctttaagccagataattcttcgaaaacattcaacaacattttcagattacaacctttctctagatcatgttccataagagtacagtatcatcagcatattggaggatggacaatccaccatcaatgagatgaggcaccactccaacaagctgtcctgcattaattgctctctggatcataaccgctaccatgtccgctataatattgaataaaatgggagatagcgggtcaccttgtcgaaggcctttctttgtttgaaagaaccgtccaacgtcatcattaactttgattgctatacttcctcctgaaatgaaggactcaatccaagaaatccatcttggcgagaaacctttcatgcgaagagtttgtagtaggaaaggcaattttactttgtcataagccttctcaaagtcaatcttaaggatgaccccactcaattttctgcgatgcaactcatgaacagtttcgtgtatgacgacaaccccatctaggatgttgcaacctctcatgaaagctgtttgagttggactcactatacggtcagccaccgagtttattctattagtggccaccttagtgaaaattttgaagctagcatttaggaggcaaattggtctgtattgttggatacggttagcttccttgactttgggtatcaaagtgatcaccccaaagttgaggctgaagattggcaactccccagcatgaaattcattgaacatggtcaacaaatcgtgcttgataacatgccaaaacttctgataaaattcagctagaattccatcaggacccggtgccttatttgtctccatgtcaaagattgcctcccgcacctcctcctcggagaaaggggcaatgaggtggtcattttcagcctctgtaacttgggggatatcatcaattctatttgcatcaaaagagagagtacttgcatcaggtggtccaaagagtttcttataaaactcagtgatataattcttaatagcttcattccactcaatcttaccttcctcttgatctagactgaaaatacgtttcttccgatgtttgccatttgcaatcagatgataatattttgtattattatctcccaaacgaacatcatcagtctttgctctttgataccacttgatttcttcctcccgaaggagttgtgctacaaga

SEQ ID NO: 33095 - DNA, 3904 bp, Oryza sativa
cccgaaggagttgtgctacaagatccttaattaacatatgaacttatgacagtacctatctataagttcaaaaaccttgtcaaacgtagactcttttttatccattgagccatatacgttgacggtgcaggcctccaggtcgaagagtaaaagcacccagtggaatctgcaatgtgcgtgggatgcattacatatgaaacacttagcatgttcgtacgggaatgaaatttggtataggaagacagtaaaatgaaactaactctgtgttgtacggcaacagtatgaacgtcttataatgctgcaccttcaggagttggacgagattgtcctctgtttcttgcggataccggtcaagcattgcgacgtttacttttcgagggtcgatgaatccagtatcgaaaaccccccgccgtcgggccctttgaatctccattctacaacgataaaaggaagtatatattatatatagtctacttatatataaggacctaattaattaaaggaaacgtaataagaaatctaactgaacgatacttacaaaatccagtaactcataatagaaacgtcgagggcgtccagctggtatagttcgtagataccctggaaattgatccagagaatgtcatctccttgcaagaagtccgtgtccctgatcctcgctccgatcatctctctaccggtggcgctcatctcaatgtacagtttatggaacttatacatttgtgtgggtagggactacagctgctcaggcttgacaagcggtttaccgagttcgtacatgtatttcacttccgccttttcagttagtgcgcctcgtagctattgatccgtagttagcccggtgtcattaataaagtcttgtattccaaaatcttcaccggtcaccaacggctcgatctcctggtttggttgctctccaagctgagggactggtttggactttccaaaagatgctttcttgagtgttcgctcatagttcgatagctttatggccaccttggcaggtgcagacatacccctaaagaagttcctgacacttgagtctataggaatcttcttttctggacttcgaggcttcaattgtctcctgacttctgatgccacataagcgtcaagctcctcttgcgtgcaatcgtaccccgggtccttgttcttggcggcgtcaactttcgccttcttcgttgcccttgtgggggcaggcggtggagcttggggggctcttgacttggaaggtgccagacgaggagcttgcggaggagtcggtgcaggagcctgaggaggagtcggtgcaggaacctgaggtggagacggtgctggatcatgaggaggagacgatgaaggagcctgaggaggagatggcggagccagaggagatggtgcatcagacgccgcttgtcgcccagggaagatgatataccgcttgcgccatagaataatggcgtggcttgtgtctcgtagatgcgtctcaccgtctcctctagggtaatccagctcgaggtcctcgtacgcgccttcgaccaactcaacttcgaccttcgagtatcctgctggaatcggcctgcagtggtaagtacctgaagggtctgttgggatggccatgcccgacgccaccttcacgtggtgagaggttatttattagtaatcaacatatataagcagcaactagcggaatggccaaatctaaaatctataaactacgagcttaccattattgataagttcttgaagggaatatgcagctcacatggtgtccgctgagtgatgtcatcaacggggcaggtggtttcgtcctgggtttgcatggcgtccatgctctgtgatcctacctgcctcgttgaggcgcatttgctacgatttcctgaagggctcaccatagcaggaggaatggtcggctggggatcatgggaccgatgtgcggctatgcgttcatcaaccttccttgccacctcctcttgcatgctgagctcgtagctcgataccctgaactcaagatctgcaatcttcgcctcggtatctctcttgctcctcatccgactcctgtacgtgtggatgtcctccttcaacccaatcttccaaggaatcactcctttccctcgtgttcatcctggatgctctggagtctgcagggcgagtgacagctcgtccttctctctgtcgggtcggaacgtgccctgagaagaggcttccactgcgtccgttagtcgacgcgcagcctcgcgtatctgatcgccgaagaccagggagccatcaactgggttgagcgttccaccgtgagcacagtaccagaactttgatcgttccggccaattggtggtggccagttcgaaacccctctcaatcaagctagcctccatctcctcccacttcggcatcgcgattctatagccgcctgaccccaagtggtgatggtacttcttctttgcagcattttctttgtttctttccatcatcgcctgcccttgttgatctgtcttatatgcaacgaactcgtcccagtgatcccttagctttgggaatgtgtcgaagttcggtgtctgccccttcaggatatatttctggtacagatctcccttgaagctccgaaactattctgccattttctatagagtccacattttcactttgtcctctgtacccgcgggaagggtgaatgtctcgagcattgtggtccacagcatctctttctccgaatctgggacaaagctctcatgatctccgcgtgcccttgttctgcgccagtacacagtactaacaggcacgttatcccgcacaacccaaccgctgtgacgtacgtagttcttggcggcttccgccggggcactaggtcggccgtcttcgtccacttccgttatgatgtgccgaccctcaagcttcttcgcggcacctcgttgcccgcgtgccctcttccgtccagcggagggttgacttccactagcctcctcctcctggttcccctccacatccctctccacgtgcccctcctggttcccctccgcatccctctctatgttcccttcctcgttcaaatactggtttggatcctcgttcccctcttcttcgttccagtactggctacttccctccgcgattgtatagtacaatatctgttcctcatcgcgatcagccatctgttcatacaggaaacagttgctaagtcatgagacatttttgatttaacaatcttatgtgctaacaatcatatatgctaagtcatatatgctaagtctaactgtcgtatatgcgaagccatatatgctaagtctaattacaaatctaataatcgtatattaaaactataataatcttatacgaaaactcaaataatcttatattaaaactcaaataatcttatgctaagtctaactgtcgtatattagaaccctacacaaccttatatgctaagtctaattacaaatctaataatcttatattaaaactcaaatagtcatatatgctaagtctaggaaacgtatattaggaccctagctactcaataattatatactaagtctaattacaaatataataatcttatattaaaactataataatcttatattaaaactcaaataatattgtattaaaactctaactataatgctaagtctaagtgtcatatattaaatctaatagtcttaattgcattaaaaatataacaatcatatatatatttacgtcacttgcctacgcgaattccttcgagggctagctaccactccggcttgagggacgacgacgataacgtcttttctgcaacatacaaaaagatgtattaggataaacacgaagtaacatatattgtatttcacgttcacgtttcgttcacgatcgttcacgttcgcgttctcgttaaggtcacgtttcattcacctacgttcgttcgttcacgtgcgtccacgttaac

SEQ ID NO: 33096 - DNA, 1445 bp, Oryza sativa
tagaaaataatgcattaaaattatttagagtcaaaaaattaatgacaattacttcaaaaaattattgttgtctgtagtaaattaagtggataaaacgtagtaaacaaatatatgatttaagattaataaaaattctaataatcatatatactctaattaaacatatgtatatacatacgccatgcatgatttaaaattaataaaaattctaataatcttatataattagcatatgaatgatattaaattaattcataaaaactctaattaacatatgtaaatacatacgacatgcatgatttaaaacttttaacaattctaataatcatatataattagcatatgaatgatattaaattaattgttaaaaactctaattaacatatgtaaatgccacatgcatgatttaaaacttttaaaaatttgaatagtcatatataattagcatatgaatgatattaattaattgttaagaactctaattaacatatgtaaatgccacaagcatgatttaaaacttttaaaaatcctaattatcgcatgtaactagcatatgcatgatttataattgttaaaaactctaagtaacatatgtaaatgccacatgcatgacttaaaacttttaaaaattctaattatcgcacataactagcatatacatgatttaaaattgttaaaaactctaagtaacatatgtaaatgccacatgcatgatttaaaacttttaaaaattctaattatcgcatataactagcatatacatgatttaaaattgttaaaacctctaataatcgtgcgtaattagcatatgccatacaacaattgatttatatggataatcaatacatccaaaatagtttacatcatgtacacaataattacggcaatacatcggcggtgacggttgaccgcacgtactttctcctcactattgttccctccttgtgatcgctacatgagtaaggtgtgtcttcatttgataggaggatgctagggtcaatcgtcaccgtgaaagggggttgcccatccaactgatcgtaatcctcgtcagtcttgtcctcaactccgacgatttttcttttgcctgggagaaccacgtgacgcttaggctcgtcaggccctctgcccttcttttctttgctagacatgtccttcacgtaaaagacttgcgttacatcattggaaaggacaaaatgttcgtccgagtatccaaccttgttaaggtcaaccgttgtcatcccactgtcatcaatcattatgcctccaccagtcaacctaacccattggcaccggaacataggaccttgagaggaccatagtcaagttcccatatgtcctcgatggcaccgtaatacgtgccagttgttccatcgtgtcccatggcatcgatacgaacaacgctgttttggttcgtgctcttcatgtcttgggctctcgtgtagaat

SEQ ID NO: 33097 - DNA, 257 bp, Oryza sativa
  unsure (1)..(257): unsure at all n locations
tggaagattggttttaaggtggacatccacacgtacaggagtcggatgaggagtaagagagatatcgagggaaaaaggagaattttgggccaaggaaattccctttaaggggaaaggtttccttggggtatctgaggctatgaanncttaggtatgcaagaggaggtggtaaggaaggttgatgaacgcatggccgcacatcggttccatgatttagtgaccattcttcttgtaatggtgagtctcgtcaaggaaac

SEQ ID NO: 33098 - DNA, 397 bp, Oryza sativa
accgccgtggggaaggtggcaaccccttaaattttttccttttttttttcttaaaacttggtaaataaattctcccgaaaaatggttcaaattaacctaaaacttattcccttacttatgaatgccattaataatccgaaatatcctggtggaatttttcttgagttccccatgccctaatgcattaacaaaatttttaatggaattttcatatgccgcaatatttaatcccaagaatcctttttcctttttcttctttttaatttcccttttttcccacattttgggccgttgggccaatccaccccggtgcccgcgcgcgcccctttttcttttttgcccgggccccgcccctttttttttttttggacactgatatgtgggggcccaactgtta

SEQ ID NO: 33099 - DNA, 703 bp, Oryza sativa
  unsure (1)..(703): unsure at all n locations
taaattccccccaccacctagtgtaactgtatcccactgttcactattttggtgggaggctgtaggggcgattttttgtcctttttccaaggaaaacagaaattaaattcccaaaagtgatcaaaatgaatcaatcaagtgagtaatattattcattaattgagcaatttcatcatgtcttacttttgcaatactgatcttacaatatgtgcctctaatttgttttttttattttgtagcaattgatcgaagttggatgtatgcaaaaaatttgaaacatcattctacggagtacagaaagggtgtaataaattttatgaacgccgcggaggaggatcggaaaagaagaaacagtgattatatgtgttgtccatgtgcagattgcaagaatgagaatatgtttgatagcggagaggacatacacagtcatctgatacaacgaggattcatggagggctatacatgttgggtgaagcatggagagcaaaaatcaggaagtggggcagcagcagacagaagtggtgcgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33100 - DNA, 706 bp, Oryza sativa
agggtggcggcgggtaaaagaaacccccggggttcctttattaccggttaggggccggcggcaaaggccacggtaaccggcggcggcaatggaaaggttagggttcggaaaaagacaaatccaattcaaaatcaattccacggatttccaaccaattttacccgataattccaaaaaaaaaaaggtaaaggggacctcggggatcttttcccttttatcattttaaccggaaatggaagaatccaaccaattttgaaaaaccggcggcggcccacttcgcttccggtccgcccggccaacgccccaagaaaacaaccaatcccaccagtgggccccacctttcaaccggccaaggccccccccccccggccgggcttgggtgtgggcccacctgggcccggaaagagagaaaaagaagtttgggtccactttcggcccaaagccaaaagaagactttttaaaacttttccaatttaaatttttcatgaaatgcgatttcatttattaaaaatactttcttggctcaataaatcccacaaaaatctatgaactatataatcaagccaagttttaataaaatttatctggcccaatttatattggaattattattaaaattagatcttctcttttaggcgtttaaaattatttttaatatttcccaattaaacaatattttatatatttgagattttagggtgtgaca

SEQ ID NO: 33101 - DNA, 742 bp, Oryza sativa
atcaccggtgatggagatcggccggtggtactaatggccggacatgggagagaaagagagaaagagagcttgaggactcggtttatgtgaaggggaagaggggacctcctcatccttttataagccggcaaaagccgtggcgtaaggcggttccgaggaaaaaaataagagaaccccgcgaccggggcgtggaaaaatggaacaccgcgcccgctctattcgttgattccgcgggtccaatccgcggctgacctccgcggcgtgatgtctcaactgacgtttgtgacagatcctttccggtcaaaggaaaaacacagcggcggcgcaaaaccgcgggcggcatccggaagtggccaaaccgcggcgaaagcggcgccctgtgcgtgcgccaagtgcacccaaaagaagagggagcggctctgccatgggcccaatttggccggctcggctcggctctgctgacaccccaagaggggggaaggagacatgtaaacttgtgctgattgggttaattgaagggaattcggcccaaaatgaatatggggtttaggaattttgtgtggagggatttgaaatggaatttcccaggagatgaaaactaatggaaaatttgaatggaggggtttaattaaattaaaaaaagaaatatttgggggttcttttgaataaagagtttaaaagcaaaaggagtttgaaatattttttaaaaaaaaaatcaaagatatttattttaagaaataaa

SEQ ID NO: 33102 - DNA, 1181 bp, Oryza sativa
  unsure (1)..(1181): unsure at all n locations
atgactctaaccctttgttcaccacttgcaactgcactttcgcataatcatatggaatagtgttatcgtgataaattcttcaagggatatccattccaatcgcagccacaagggttcttccagctctaccatgtgggacgtattctctttcaagcctgttgacggtcgttatcgataagtttcgaccatcaatatagccaaaatagaggagaactagtgatgcttgcaatgcatatacatgttagaataataatattccactagtattaggttcactaaccttttgcagagaataaaaataaagtggaggagaatcgacatcaacatagatgataaatcaatcgggcgatgttgagaatcagacttatgtatgaatgggccaagaacttagaattgacacgacaaactgggccaaaattcacaagtttgcatagaagaacaacggaggaggccgctagccgaaattgggctggattgggccggccctagatttggccgaaccagggggttaggccgaaccctcatcagcgccatctgatccagggcttcgcctggacggtgtggattatcccccaatgacggttggagggtatttctgaccattccaaccatcacaatcgtcattgggaggctataaaaggagttgctcttctcacttcactcacacacctcaagcaatagctctctcatattctctcaagtttagtttagtagtatctagctagtggaataagaatagagtagaaatcaggagtccggaagccttcggaagagttcgggtatgactctagtagctttcctttcctcttttgtaagctttgtacttttattagaatactcttctttatacatttatggtattgaaatactttccgagtatatgaatgcctactttatattatgttcatgttatactgaatatactgctgcttatctgggagatgctttggtgcaggtataatgtttgtgtatgcaattactctatgtcatgacgatgatattagagtagtatctggtagtttagacgtggtgtctagattacaggatatcattatttggggttatatgctgcggatgagaggtgggccgctgatggcaatagctcagtacgggtattcctccgnnnnnnnnnnnnnnnnnnnnnnnnnnnnnnnnnnnnnnnnnnnnnnnnnnnnnnnnnn

SEQ ID NO: 33103 - DNA, 593 bp, Oryza sativa
cttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggccttaggagtggcgtcatgcccgaccgtttcccttaaagagggcgatcgccctggcataacgccgggggctactgtcggtgacatgggatcaggagtatcatgactggaggtttgaggcagacacaatcgcacacgtggcctggcacccccgagggacgtcgggcccgagggtgatgtgttcgccctcctcttagtccccccgagggggtcgg

SEQ ID NO: 33104 - DNA, 1136 bp, Oryza sativa
  unsure (1)..(1136): unsure at all n locations
agtgcagtgcactcgtttatccggtctgtgaccagtcacagactggtcagatcgcgggtttggtggcgacaggcgatctgacgcacgcctcgccccatccggtcaggacgagggcttctaggcgctcgtccccagctggagctagcgtgttacctcccagagatggcacgttagtcctagtcagatatatgccaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccacgattccacgtcgcatctgctcccggcgaaagtggaggtagttgtgggccgtctcatcagatggtgactcggacggcaactatacaaatctccgtccatttatgaaaaggtgaggtaagtccccacaaaaaagagagaaatggtgcatgtggtatccccttaagatataaaaggaggaccttgcccactgggaggggggactggacttttccagatggggaacccagaacaagggagaggctggctcatactttgtagctccttcatacacagatctcccaaaacacaggagtagggtattacgcttctcagtggcccgaacctgtatacatcgcccgtgtcttgtgtgtttcctgtctcgcgagccttccacatacagagagcttagaatctcaccctgagtccccggccgaactggcaaaggggggcctgtgcggtctcccggtgaggagccccacgctccgtcaccgtctatcgttgggaaaagatggacataaactttgttggtgcatggtgcctatgagtatgaacacacattttttacacaaataaataaatatactacataagcatgtgattagtattaacgggtttttctttataggatgcaatacatggatgcttagaagaccatggttcccatcggttatctagatccaacaaggatctgtcaatcccagcataccgtaacgctatcagaaaacactgaacagctcaagaacatgacgcctgaagaaatagcggaannnnnnnnnnnnnnnnnnnnnnnnnnnnnnnnnnnnnnnnnnnnnnnnnnnnnnnnnnnnn

SEQ ID NO: 33105 - DNA, 392 bp, Oryza sativa
cctgcaaagcaacaaacagatgaatttctgcccgatttcagacaataagcctaaaacagaaagttcctgtctagacctttgttggaaatatatacaaagcacatgccatcaggttttgacagagagattcaaggactggaatgttatagcacagagactttccactagatgttgatgttgcaatggcaacatgccttccagcaatggaagagtgtatagctcgagactgcaatcaagtaaatgatcaacataatcggtgagcttctacaactgaatgcaccaaatagatggcacaccctataatacctggtggctgtacaacctagatactccaatactttttaatgcttccctcgtagcctctgaaagatgattaggaagttctgcaaaag

SEQ ID NO: 33106 - DNA, 700 bp, Oryza sativa
ccttttatttgatgagatacagtaattgttgtggacttgaaagcaaagttatgagttcatcacagtacaaagggacgatgtttaatttttaagccaaaaattgtaaacatataattgttctgtagtggcatgtaaatgtgttagttattgcagtttaacacttcagcattttgtttcttatggcatgccagtacagcagtgtttgtttctatattcataattttcttataactactatgtgtaaagatacactaataatttgtatttcgtgtattagtccaatagttgaggtttcttatctattatctgagatggttcagcacgggcttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggtcagtattctgttctgtctcacctaatgtcttctttcattgtacttatcaaattttttattgtttcttagaatgaattttggtttgataaaatatgcctcatttagaatttcatcgtgctctcgaactgtatgga

SEQ ID NO: 33107 - DNA, 779 bp, Oryza sativa
  unsure (1)..(779): unsure at all n locations
nnnnnnnnnnnnnnnnnnnnnnnnnnnnnnnnnnnnnnnnnnnnnnnnnnnnnnnnnnnnnnnnttctgcggcactggagactggaagataccacctctccttttgcatggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatc

SEQ ID NO: 33108 - DNA, 643 bp, Oryza sativa
cgccatccttcattaatcagcaatcaacgtattatccttctgagagtttgaattttagtgctgtggttggttaatctcctagattataacacccagatttcccaaaaagagattaaaagaaccagataataaacatggaacttataaaaacattgcaaccaactcttcaaaggcttgtttagattacacgtgatgatgtggttcttgcagtacccgcagcagaaattgatggtttcttccatctcatcagaagggaaaactgcagatatcttaatcacaggttcaaatctttcgacatatttcttcacagaagcttggggatcgcaggtggcaggcaatttggggatcccatgacctggttcaggataaacagaggtggtggttacaggatggcaacaaaataaaatatacaattgaaccagaaataatttataattgaatgggaactctggttagagctacatttccgtatgataaccaaacaattctaccatttccaatggagaaagccttgtgaagaaaatattaatatggctcctgtgtcaaccaaattcactcgtcttcacgaagacgtcaaaagttaaaacctcatctcactccttggtcggaaccatctctttttcaaaatatgatctttcatatt

SEQ ID NO: 33109 - DNA, 315 bp, Oryza sativa
tctcccgctagggaatcaattttcaactgtaatttgccccgctttctgccggtgagatttgcaggtgcgcaatatgtaattcaccattttcatcgctcatcgctctcttgctcatttcacccggttgtccgatgcaaagtggcaaagcatagtacaggagataaacatgtctgccattgaaggggcgcccacagccgccggcgcgcggggctcggggtggtgggaggaggggacggcggagggcagtgcttggggcggcgaaggggcgcccacagccaccggcgcgcggcgcgttgaggcaccggaggggatgct

SEQ ID NO: 33110 - DNA, 746 bp, Oryza sativa
agtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcagaactttcaaaatttggatcacatatgggtaatgacattggattggatggatacagtgaacctgatagctttatgggtcacaatctggtatgcaattacttgtaactttgcatacagtttgttctcatctttattagcgttttgattttttttatattgttaggggaaagcctgtag

SEQ ID NO: 33111 - DNA, 592 bp, Oryza sativa
  unsure (1)..(592): unsure at all n locations
nnnnnnnnnnnnnnnnnnnnnnnnnnnnnnnnnnnnnnnnnnnnnnnnnnnnnnnnnnnnnnnnntacctgattggtttcactgtatgaaacatggggacccatattctgtccatttgttggaacttggaagttggaagagaagagaagagatgcctatgtggagtacagtaaaatacagtgctggtacgtgcatggatgaggctgtccgtgcaatgtgttttggtcggccagattcgtttgtcgatcgatcatatgtgtccaatcaaacggccaatcaatcagtacaaaaaggagaatgcaaagtttgcaactgctgcctacctcctctcggaagcaagaactcatgcccaattagctattgtattagcttaatcagactcacagcctggtacagcaagaaagcagaagctaaaccaaaaacctgcggctaacactacactagctagaagctctgattatcagagagaaggcttctgggaagcgtaaagcagaacattcctatcctatggaaatgaaaatgaaaatgaaatgctgccatgttttgggatgggaccccttctttaccattgttcaaaagctaaagaagcttt

SEQ ID NO: 33112 - DNA, 238 bp, Oryza sativa
caaagcgcttcccaaaaaccttatgccgccttctcccggtgcagaacgtcgaaggcagaggttccggagacctgctctcccgatcacaggtgcacgccggcgagcgggatggagtaatctacgagcgacgcgcagcacagagtcggaggcaaaccctagattgatttcgcgtgtgttgcgtgaaggcggcggctcggtttatatagagaagggtcgcttgataagggcgcccgcacga

SEQ ID NO: 33113 - DNA, 544 bp, Oryza sativa
ttaatctgatattttagagcaactttcatatagaaagttttcacacgaaacataccgtttagcagtttgaaaagcgtgccacgagtataaaaagtttatctccatgttgttggagaaacgaacaagaccatactaatcttttgtggtacatgcattgagattgtcaagtacttgtacagaggccgtgtttacccctaacttctaattttccatcacatcatatcatattcaaaaattttctacacacataaactttaaactttttttttccaaacttccaactttcctcgaacttccaacttttttcagaaactaaacacagtcacagtcagaaacaaaaagctcgtccagactcagagtttgctttgcgttgactgtaccatcgtactcacactacacagtgcatacatctattgtagcagctacctgctctctgcattaagttgtacctcttctgaaacggacacatatcttatccgcacaagtaatctcgtgtacacactatgtatatgaagcaacaaaaaaatctaaccgatttattata

SEQ ID NO: 33114 - DNA, 987 bp, Oryza sativa
ccaaaacaacaatggacccacatgtcagcctctactccgcttcttcctctctcccccttctttcttctctttccttcttttcccctttccttccttctcgtcgatcacgctgatgccgatagctcagcgcacggcgggaggcgggaggcggcgtggggaggcggaaggcggtccaccaacgccgacgctcgccgaggtgctctcgctctccccgccaataactctccgcaaccgagcgccatcgagctgccgtatctacggtgacggacgaggtgggaggtggcaagcgacggcgacaacggcttgggggggggggaggggggcggcggtggagctcagggaggggatggcgatggcgacaacggcttgggggggcggcggtggagctcgaggaggggatggtgacggcgacaacggctttgggggggggggcgcggcatcggaggtcgggcgaggatggcgacggcaactgagcagaggctagcgacggcggcggcggctctcgacgaccgaggcgcagaggcggaggtcgtgcggtcggctgaattcggcgggggcggaaaggctcggcgaagctggtagcggtgaggagtacaccagccgccacgccgaccggtcgttgctgcgggccaccgtttggcaaggcgttttggttggccaactctagccagccagtgagcaagtttgaccaacgggatggcttggccatccggttggtcagtctgttggacctcctttttgtgcttgaatgacgaaaatttggcttggagaggttgatagagaggctgcattcagaagcctctgttcctatcccaggctgtgcgcacggaaaacgaagccggccattaacgtgtgattaattaaatattttctttttttttaaaaaaaaggacaaatataattttttaagcaacattcgtataaaaactttttttaaaaatgtacaatttagcagttttaaaagcgtgcgtgtggaaaaggagagga

SEQ ID NO: 33115 - DNA, 4279 bp, Oryza sativa
atagtaaatttgagataaaaggagtcctcgactatcttctccttcctttcacctaaaggaaaatctcgcgtctcgtctcccctccttgcgccatctcgcggctgacagggtaggggcgccgatctccatctggcgagcagagcagagcaggcgaggggaggggatcctgcagagcatctacatcccctttccgattcatctctctctctctccccccaccgggagtacttttgtctggaattttgcttgcgttgcgttaaccccagcttctcttgtagatctggaagaagctcttctcttaatttcagagccttaaccttagtagaactaacagtttgtttgttctcccaaaagtttgccggttcaactcaacccccatttcccaagttggatccgcccctgctagtagtaagatctggaagcaaaaaaaaaaaggggggggggggttggatctagttcgcaggagatctctgattatgttgcactgattgaataacctcttctttttttccacttctggcaggtgcataattcttgaatccattttaagtgcagcaattctgagtaccaaaaaatccattcaaaatggtatgcctaatggtttattattctttgtaatattaagaagggacattctgacatttgctcttttgctggtataagcaactagttgattcgtttaggagagcttattattgttttttgtgtaccgcaggtggttcttgctgcttccatcatttcaaagtccgggaaaggttagctggcttgaaatattctgttgttaatatattgtattgcattattctcagtgaaaaaaagaagtctttttaaatttatattcttatgttgtaatcaaaacaaattcttttgtgcatagaaaaagaaactgttgtatttgtataagtttttacctgtcacctgtgctcataagattgttagctcatatgcaaatttgtggaacccaaatactaatctagccgttgtcgtgttgcctcagtagattcttaactcctatgaccctaaaatcctatgtagtgagcacctcttggttaccaatttgctgatgcttccttccagaaagctaatgtgattagactgaatgctgtttcttctctgcgcttttcaactgcagcacttgtttcaagacagtttgttgacatgtctcgcataaggattgaaggattacttgcagctttccccaaactggttggaactgggaagcagcacacttatgttgagactgaaaatgttcgctatgtttatcagccaatagaaggcctgtacttgctacttatcactaacaagcagagcaatattcttgaagatctggacaccttgaggctgctctctaagcttgtatccttttttcccatatgttcattgttccagttttttgacctaactaacctatacaatcctatcctatgaaacatatgaaacatggttttttaacctacacatatattgctctgtagtgaataaatgtatatcagataatgttaccaacgtttgttttgtgggataaaatgaagattataatgtctcggtatagttgagcttgtcactatataccaccaaggggacaaaatatcagataatgctataatatgaaacatataaaatttttttcttttaacctacccatatattgcaatgtacagactaaatatcagataatgctattaatgtttgttttgtaggacaaaatgaagattataatgtctttgtttagttgagcttatcattatatgttaccaaggagacaaaagaaaagtaattattgtttatcatagttgcttgggaaatttggaaacactataatgactgtgtattcaattgagcgaatccaaacgttatgtaggcgttgcgggcagtgtcaacagaagctacgctttggtgcctggctggagctcttgtgctccaagttttcctttgtaggtcgttatcttaagggcactaggctgtcgtagggtggttttttggtcatgtgtcgccttgtgtgatgctatttgtggatgtgttttggatgaagggcttgttagcgcttggttgtatgggtggtttgtttttccttcttaatgaaatgaagtgcagctctcctttgttttctaaaaaaaacaaagaaaataaagtcactacattaacacaattcaattttgataaaaaacaacatgcaagctatacaatcatgaacctatcatatttttttaatggaatctgttatgttttggggctttatggatatccaccgttagagatgctactacactgcattggttttctttgttggcaataatcaagtactgtgatctccttaacagttccacaggtgcctgaatattctccctctcttgatgaggagggtgtttgtaaaacagcatttgagcttatatttgccttcgatgaggccatctgtcttggaaataaggaaaacgtaacagtccaacaagtcaaacaatattgtgagatggagagccatgaagagaaggcgcacaagctgatgatgcaaagcaaaatcaatgaaacaagggatgtgatgaagaagaaagccagtgagcttgataagatgaaggtctgcactgcacctttcttcagattaaaaatacatattatatcttcagagaaaataaatgacagttaatgtagttgactttgaccattaggaaaatcgatattacattattattgctagtttgaccttatgactctgtgctgttttactgccagcttgtcatttctttggttacaattgatatcagttcgcgcaaactttagtgtttaaaatacaattgcattgccgttatttcttaatgtctaagaggtgaattttgtggtcggtgttcatgcagatggaaagaggaaaacttgacaaaggaggatactcggcaatatcaggtcccagggtagttgaaaaagcatttggtgacatgagcattactggtagtggatttggaagtggttctggattaggtggactgagcatggatatggactcatttgctagcaagcctaaaggtggtaatttaaaaactctttgcatttctcttggcagatattaactctttgcattaggggaaaatttactacgtaaagctctgggttttcttcttgcagtacttgatattcagatcttcattcccatgccagtagtctcctgattatgtctatgtttgtctatataattcctactttccattttaactgctcgacaaagttcaatcaactataatatattgcttatgtttgctagcaatgtttgtacaggccgtccatctgcagctgctactgctcctggtaaaggtcttggaatgaaattagggaaaacacagaagacgaatcagttcctggaatctttgaaagctgaaggagaagtcattctggaggatgtacaacccagttcagttcagtcaagggtgtcgcctcttccaccaagtgatcctgtcacagtgacaattgaagaaaaactcaatgttacagttaaaagagatggaggtgttaataattttgatgtgcaaggaacccttgctcttcaggtccttaatgatactgatgggtttatccagttgcaggtaacattctttctgaacctctagcatcctgcttgatttttttctacagaaattttcacaagcagatcaaagaacatagcacgacagtttttgtttgaacctatacgatatttctactaagtaaatgtaatgcatgtgttatattgggtgaccttcctgctaagataatccatgtactgttttttttgtagtccatgtcatatgatatccaattttgctatcacatttgtgcttgtgactttgtttatgcttatcatgccatgtttttgttgctgaggaatattatttctttttattacgttcagttacatctatgattcttgcaccatattttgcattgcggacaagaaacattgtttggtccatgatactgtttgtcggagctgattatttgatacttgtgtcttatagattgaaaaccaggatgtacctggacttagcttcaaaacacaccccaatatcaacaaagatttgtttaacagtcaacaagttgtgggggcaaaagatccaaacaggccattcccaagtggtcaaaatgaaactcctctggttaagtggagaattcatgggatggatgagtcatcgttacctctatcaggtgcacaatcactttactttcttctatatcacattgaagatcatgccttttcttttcttggttgcctcctacttttattaacttgtgtttttttcgctcagtcaactgctgg

SEQ ID NO: 33116 - DNA, 3745 bp, Oryza sativa
  unsure (1)..(3745): unsure at all n locations
nnnnnnnnnnnnnnnnnnnnnnnnnnnnnnnnnnnnnnnnnnnnnnnnnnnnnnnnnnnnnnttgtttgaacctatacgatatttctactaagtaaatgtaatgcatgtgttatattgggtgaccttcctgctaagataatccatgtactgttttttttgtagtccatgtcatatgatatccaattttgctatcacatttgtgcttgtgactttgtttatgcttatcatgccatgtttttgttgctgaggaatattatttctttttattacgttcagttacatctatgattcttgcaccatattttgcattgcggacaagaaacattgtttggtccatgatactgtttgtcggagctgattatttgatacttgtgtcttatagattgaaaaccaggatgtacctggacttagcttcaaaacacaccccaatatcaacaaagatttgtttaacagtcaacaagttgtgggggcaaaagatccaaacaggccattcccaagtggtcaaaatgaaactcctctggttaagtggagaattcatgggatggatgagtcatcgttacctctatcaggtgcacaatcactttactttcttctatatcacattgaagatcatgccttttcttttcttggttgcctcctacttttattaacttgtgtttttttcgctcagtcaactgctggccatcggtatctggaaatgaaacttatgtcaacattgaatatgaggctgctgagatgtttgacctgcacaatgttgtcatatctataccattgcctgcacttcgggaggctccgagtgttagacagattgatggagagtggaggtaatgtttcaaattcatctctatctgtactgaacttggctgttatattatactaaaataattgtccaactaattgttagatgacaattatctccttagtattgatgctaatattagaaaaataacaagtgatagctatgctttctagctattgttcctggcactgtcatattggcattcaaactgttaagggcccctttgatttgtaggaaaagtgtaggaaatttgaaggatttcaatcctatggaaaaaattcctatggaagcctttgaaattaaggattgaatcctatactatcctttaaaattcctatggaatggctaatcctatagagattttggagaaaagttagcaagaggtccaacctcttggaaaaattcctttgagtctatctctctcatccgattcttgtgtttttcctgtggtccaatcaaacggtcattcctgtgtttttcctgtattttccaatcctctgttttacacctgcattcctgtcagaatcctacgtttttcctattcctccgtttttccattcctgcgattcaaagggggatgtgttttggatttatcgggatttagtccaattcccttggatgaactggtcctaaatgacactttgtgtagatagagctaaacttttatttccttgatgctaataaggtagaacgcacagcgaaagctgattgttataatgcctatttcactttcattttgcatacaggtatgattcgagaaactccgtgttggaatggtccattcttcttatcgatcagtcaaaccgcaggtcagtgaaatacgagttcatataaccatgttttattttgttttttttttcctgtggctctaactcttattttttcccctgtttgcagtggctccatggaatttgttgtccccccagctgatccatcaacatttttccccatatcaattggattttccgcatctagtacattcagcgatttgaaggttggttttcccttattagatgagactcgtggttctatgtttgttgttccttctcattttattgtatggtaatgttattttctgcataccttgcaggttactggaattcgtcctctaaaggatggtaacccaccaaagtattcgcagagggctcgtttggtaacagccaattatcaagtggtttaacgcccaaataagggagattacctcacttcagcacacatgtttgcgggcatttcctttcggcaatgagctgtttagaagtcatggagaagaaggattgttttgcatttataaagaatgtaattttgtctgtttcatatgtagtaacatgtttcaccaaattgctgttaatttgtactgccacctgatgagaaataaaagcatgtcttttccttagacgccggttggctgttctttattttgtacgtcttgtttctctttctgagaatgttagatcattttttgtcgatgccatatttatacagttctcttttttcatgaaatgactacagtgcattcagccaatcgctgacatgactattggcgttctcattttcagttttcagcaaattgaacgccttgtcaacctgtattccacataaatcttgaatttaccttctgattaccaaggttgatagggggacaaatccatcaagtgaaaatttagggcttagtttggtttatagccaaactcaaccatgctaaataattggcaatgctagaaaaaaattggcacctattttgtttggaacaaaaaaaatttggaattcatctatagctatacaaatttgaacttatggtaactttgcccaatattttaaacatggccaaatcttcccattgccaaaagaatttggcaagggttatggcttaaccaaactcaccttagtttgcgtgtagcctggaagtgtggaatttactaaataagaaaatgagaagaaaaacctgctaaatccgacctgccggattcgaaccagcgacctaaggattaactgcaacgactacagtcctccgctctaccaactgagctaaggtcggtttcatgttgtttttcacttgagatttataattgattggtctaatttaagaatgacataccgccagtgatcacgtctacaaattcttttaagaatattttgacaagaacacaattaaatggattctattgagctacatgcactttggagagagctggttgagcacacttgttcatcaggttatttcttaagtgcttctctgccatggtatcaggaagaaaagcgaccttttctgctgccaaattctttttctcttggtgttttacgttcaaagatgacctccatattaataaatctctatagaaaatatgacatagcaagatgcatattcatgatgtggttatttagtttcgaagtggagaagcacaattcacggagacactcggcgattttcgaaggtagtgcgaggtcgactgggggcaatggcgaatcaagggggaggtgcatggcgtgggcgtttcaatccaaggccgatgcgaaacttcggcgaggggagaaagccacaagctccgacgttttcaacgggaggtgagtcgctgcaggggattgggggaggagctttgggggatcaagccaaaaccatggctgcacgaggagcaacaaagcagcagtatcgccctattcagcataaggaaccagccaaggaaacagagaagggtgatacctctgtgctgcagccagaacaacctctgcaatccaatccccgtgctggtaacaatcctatcccacaaagatttttttgtcagagatgcaaaaatgtgggtcatctggctagggattgcaacgtttctgttttctgcattaactgtgccaagccatctcatagaactgaggattgtttgtatgacaagcaacccaggccagcagctnnnnnnnnnnnnnnnnnnnnnnnnnnnnnnnnnnnnnnnnnn

SEQ ID NO: 33117 - DNA, 2493 bp, Oryza sativa
gcatgcaagcttgcccaatgaagccggatcgataaccttttggtttatcgcattgaagaactggcacaacttgatgattgggtcttggaccttttctagaaggataccctaattgcgaccggtagcagttgcgtcataagaacatggcagtcatgtgacttcattccaaccaacctcttatctttcatgctaaccagtctcttaatgttcgcacagtaaccggatgggactttgacaccccacatgcattccaacatactcgttttttctgcagcactaagagtgtagcatgccggagataggtaatagcggtcatttcctctgtcctgaggatgcagctctttcctgatgcccatgtctttgagatctttccgtgcttgcgaagtgtctttcatcttgccaggtgtgttcaacaataccccgagcacgccttggcacacgttcttctccacgtgcatcacgtgcatcacatcgatcgcatgacgaatatccaggtcttcccaatatggcaagtcccaaaagacagacttctttttgaatagaggggtctcaccgctcgatgtggatgcacatgtgcttccgctcccttgcataccgggcattactccaaatctgcaaattcaccacgatacagaatgcaatcatttagacaagcgtgaattttctgtatgtcaagactaaggggacatgtaacttttttgggttggtacgtcgattctggcaagacattgtctgtaggaagaatttctttcaagagctctagcaactcatgaagctcttatcagaccatccgttgctcgccttcaagtgaagcagcgataggaccacttggagcttgctgtgctctgccttacatccattgtaaattggagttttggagtccttcaccatggttgtgaacttgtgatattccctatcatcagtgtcaaatctctccccgtcgcgcaacatctgatctagattaggttcaccgtgatcgacacatgtttggtcctcctcctcctcgtagcctacatccgcatcatgcccatgacagttgccagcacttccctcaccttgattctcctcgctaaggaaattgtccataaaaccccttgtaaggatatgtgaatggacccgctgagctggaagttgtctgtctttcttacaatcatggcatggacaccaaatatattctggtgcatcgactaagtttgtgctggtggacgtggcaacgagagccgttactcccctgaaatactccacagagtcacgatccgctatagttatccattctagatccattatatccagtgggtacctgcggttattatcatttattacaaaccatgaaggaaaaaaacaatgaagatttcatcatttacaagcacattagaataaaaacaactaggaatgaccattttaccctacgacaaaatagaggtttttgcacacacccacgtcaccttaattagatagtcatggctaacaaaaatattaaaaaaattctattttttgtcaatccgaaataatatttggctaatgtgaaacattaatgacgatggcatagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattgtaattttgttaagtactttgagtgtccaagtatttttcaggatttttcttgaaattatttgaacattggaaggatttttaataattcaaagatcatttaagtgattatt

SEQ ID NO: 33118 - DNA, 4889 bp, Oryza sativa
  unsure (1)..(4889): unsure at all n locations
nnnnnnnnnnnnnnnnnnnnnnnnnnnnnnnnnnnnnnnnnnnnnnnnnnnnnnnnnaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctagttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcctaatttttaatcatacaaagagcatttcagtaattaaccacatattaaattaatcattaaatggtctaattgtaattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatcgccaatttgcattgattactttattccttgataccttgggttattataacttgactagttgggctttatatattggttcagctagatattagttatgattgctta

SEQ ID NO: 33119 - DNA, 1951 bp, Oryza sativa
aaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacacaaacgccacaaaaaaaatggagcaaaccctcctcccctcctctagctaatcaggcaagaaggagaggcaccgctctcttcttgctcaatcagctcgagtggcaagggatggagtataagtacaactgtcggaacaaaggtgctggttctagacccaaaaccggcacctttgtcttcctaaccggcacctttgtgtggggcatgaaaagcactattggaagaaaggtgccggttctcgatccaacaacggcacctttgtgtgaggcatgaaaagcactatcggaacaaaggtgccagttctagaccaaaaactggcacctttgtcttcacatacaaaaaaccggcacctttgtgttgggcccaccaacggctagtgtgggagggagaatattaaaggtgccggatttgggctgagatccggcacctttgacttgtcataccaagaaccggcacctttgtgtaggacccaccgtcgggatgaaaagcattagtgaaacaatggtgccggttttgggttgagaattggcacattgtctaaaaaccggcataggttaggtgggagggagaagattaaaggtgccggtttagggtctagaaccggcacctttctctgacacaggttttaggtgccggttttaaaatgaaaccggcacctatttggatataaaggtgccggtttttgaatatgtggagcatgggggtgggcgtatgggtgggcaagacattataggtgccggttttaagtgtgccggcacctatagtggcgacacctatttgcctttttgtagtagtgggcccacctctcatccgcagcatataaccccaaataatgatatcccataatctagacaccacgtctaaactaccagatactactctaatatcatcgtcatgacatagagtataattgcatacgcaaacattatacccgcaccaaagcatctcccagataacctagcaacatattcagtataacatgaacataatgaaaagttggcattcatatactcggaaagtatttcgataccataaatatataaagaagaatactctaataaaagtacaaagcttacaaaagaggaaaggaaaattactagagccatacccaaactcttccgaagacttccggactcctgatttctactctattcctattccactagcttgagactactaaactaacttgagagaatatgagagctcttgcttgacatgtgtgactgaagtgagaagagcaactccttttatagcctcccaatgacggttgtgacggttggaatggtcggaaataccctccaaccgtcattgggggctaatccacaccgtccaggcaaagccctggatcggatggcgctgaggaggattcggccgaacctggggccggcccaatccagcccatttttggctggcggcctcctccgttgttcttctctgcagacttgtgaattttggcccggtttgtcgtgtcaattctgagttcttggcccactcatacataagtataattctcgacatcgcctaattgatttattgtctgtgttgatgtcgattctcctccactttaatgttatt

SEQ ID NO: 33120 - DNA, 2111 bp, Oryza sativa
  unsure (1)..(2111): unsure at all n locations
tgacatgtgtgactgaagtgagaagagcaactccttttatagcctcccaatgacggttgtgacggtggaaatggtcgaaaaataccctccacccgtcattgggggctaatccacaccgtccaggcaaagccctggatcggatggcgctgagaaggattcggccgaacctggggccggcccaatccagcccatttttggctggcggcctcctccgttgttcttctctgcagacttgtgaattttggcccggtttgtcgtgtcaattctgagttcttggcccactcatacataagtctaattctcgacatcgcctaattgatttattgtctgtgttgatgtcgattctcctccactttattgttattctctgcaaaaggttagtgaacctaatactagtggaatattattattctaacatgtatatgcattgcaagcattattagttctcctctattttggcaatattgatggtcgaaactgatcgataacgactgtcaacaaaaccccccaagcttgaacctgtgcagctcatttacctcaggttcccagataattgtttgctatttatatttaacctttgagagagcacttacctatgaacctatatataagagatataaaacagagcaactcttcatcatttcaacaaagagaactagcttgtcttacctagcataactcaaacctatcctatctttttttttggtattttctattttgcaaatttttatgttgtcttcaagtttataagatgcaattggaaagcaaatatgtaattggaaagggaaatatgcaattggaaagggaaatatgcaatgtgatacaagttacctcagtggggggagagatatctccccccaagcttggctttccctcagggtccttgataaggattgaacccctgaaagcggaagtacgcttgaacatcatcgtgctgttgctgcatcatgttgttgatgttggcaaactgagcatcagcagattgttgccattcttacgtttgagctatgtgttccgtgaggttgtactggatctcccccgtctgcacatcaagggtatccattctcctagtgatttcacccaagtcccatcgagaagaactcgagcgccattcacttggagatggaggcataccacttgatctaagacgttggttgtccccccattggatatcatgaggcacacgccaccggtcctcactggcacttgcccagcttgagactctaatgctgtggcgtggaacttgggtccatccgggtgcatccccagttggttcccaacctgcctcatacatctgcacgagtgttgaggatgatgaactttcccgttcattccttgtcatgttgcgtgtctccctgtatgctccacttgcacgagattcttctatgctctacaggggaatggttagttcatgtcagttatacaaatgataccctgcatttggcaacgggattttatttgtacaaccggggaaaaagtaaatcaaagatccatccactccatacttcagaatatgcccttgcactagataggtctcatccatacacggacgagcggctgagataaaagcaattttgttgctaacgacacctaccccttttgctatctgagtaatcagagaagtgcactcaacaggagcagagaactttatactttctaaccattgtcttatcatacatttcacaggagcaattttgatctttctaaccatggcaaacatgataatcaattcatcccccctaatggtctaagatcacctctaggaaacaaagtcatagcaatccatttgtgcatgagcctaagtgtaggattatggatatcattcatcataggtttcttgcaaattggagcaccagaaatatcttcccaaaacctatttttctcgaacccagaaattcctttctagagatcgattttacagcaatcgtgaaaaccaagaagtgtgcttaagcttttccatgtaagtgtaaactccttacggaaaaagcgaaaggaaaatccatcttctatttctttcaaagtgcatagaaattgcaaagtaagcaaacgagaannnnnnnnnnnnnnnnnnnnnnnnnnnnnnnnnnnnnnnnnnnnnnnnnnnnnnnnnt

SEQ ID NO: 33121 - DNA, 6442 bp, Oryza sativa
  unsure (1)..(6442): unsure at all n locations
nnnnnnnnnnnnnnnnnnnnnnnnnnnnnnnnnnnnnnnnnnnnnnnnnnnnnnnnnatcgagaagaactcgagcgccattcacttggagatggaggcataccacttgatctaagacgttggttgtccccccattggatatcatgaggcacacgccaccggtcctcactggcacttgcccagcttgagactctaatgctgtggcgtggaacttgggtccatccgggtgcatccccagttggttcccaacctgcctcatacatctgcacgagtgttgaggatgatgaactttcccgttcattccttgtcatgttgcgtgtctccctgtatgctccacttgcacgagattcttctatgctctacaggggaatggttagttcatgtcagttatacaaatgataccctgcatttggcaacgggattttatttgtacaaccggggaaaaagtaaatcaaagatccatccactccatacttcagaatatgcccttgcactagataggtctcatccatacacggacgagcggctgagataaaagcaattttgttgctaacgacacctaccccttttgctatctgagtaatcagagaagtgcactcaacaggagcagagaactttatactttctaaccattgtcttatcatacatttcacaggagcaattttgatctttctaaccatggcaaacatgataatcaattcatcccccctaatggtctaagatcacctctaggaaacaaagtcatagcaatccatttgtgcatgagcctaagtgtaggattatggatatcattcatcataggtttcttgcaaattggagcaccagaaatatcttcccaaaacctatttttctcgaacccagaaattcctttctagagatcgattttacagcaatcgtgaaaaccaagaagtgtgcttaagcttttccatgtaagtgtaaactccttacggaaaaagcgaaaggaaaatccatcttctatttctttcaaagtgcatagaaattgcaaagtaagcaaacgagaaccaggctcatctaccacagcaaatctctgccaaccaacagctttccaaatagcacgaaattcaacatccatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatggggtggaattccctctcggccggctggtttttatagggtacccacaactgtcagaaaagacatgtgggacccaatagccgttgcccagccaaaaatggtaggtaactgttgcctggccggttcggtcgaacccctcgtgggcccaaccggcaccactttcggccgttggattccaacggttagtgcagtcgtggcacagtgaattttcgttgaaaattttattttggtttgctctgaaaaattcatttgaagattttcctcaaaactcaaagaatcctaaatggaaattttgaaattcaaacatgtgttgatgcataaattcaaattgttgaaagcaaaaatgcagatacataccaatttcctatggcgaaggtcgcgtcatttaaaatccgacgtgcaagactgtacctccttctgattcagttcgtggattttccacccgtctctggaggtgatggagcgggcgtgtttggcttttccctccacaccttccatggctttggtgcagaaggcggcttcttctcagccgactgctctgacttcttggccggtatagttggttttatcaacgtcctccaataacggttcctaggcatcgttgtttccttctctaggaaattctgcatgaacttcaccaggctatccgtcttgggtggctccacttcgaccacttgaatattctgcgggttcggcccgtactttatcctgaccatggagcattgttcgacccttggttgaaactcaaacttttcctccttcccgttaatatgaaaacggatacttcccgctcccacgtcaatgttggcttccgtagtgctaaggaatgggcgccccaggatgagcgacatctcttttcccgtgtccatgtctagcaccacaaagtcaaccgggatgaagaaatcccgtatcttgactggcacatccaccgccatccctgctgggtaacggactaacgagtcagctagttgtaggcgcatcagtgttggtgccaacaccgtgaagttgagcttgtcaaagacgtcttttggcatgacgctgacactggctccaagatcgcataaggcctggtcgaactgctgtaccccgatcgagcaggacaccccggatctttcttcttctttgggagcttgtggagtatcacgttgctgcattgctccgtcagcttaaccacctccgttgttgggagtggtctcttgttgttgagtatgtccttgagataacgggcatatgttagtacttgcatagcatccaacaacagcacgtttatgtggattttctggattacttcaacaaaacgagcgaattgctcgtctactaacggtttcctactccgttgaagaaacgacagcaaccgtgcgtcgtagtactcctgcggcatggtcttttcttgctaaacctctttgtcagctgagtcactagatagcgcttcttttgtaatcccgttagttcgtgcagggttaggatatggtggatcacgagtggacttacctcccatcgtcgtgatcgccttaacattttcaagggaggagtcgggttgccccggaatcctcccagtttcttttgcagggactaaagatgccaactgagctaggtgggtttctatcattttattaaagctcagttggttttgaaaagcggaagcaaaccatctagcttaacatttatattttcaaggatcttgtcattggcagcgagctttttgtttagcgcatcagtggttttagcttgtgcaatgacgagatccttcaaggagggttggttagaaaagttaccattgttgttacccccttgataatataggcgtggttggttccacccctggcctccttgtggacgatacccgttgttgttgttgttgcccatatacatcgcctcctcacgggtttcccggcagtcgttcctagagtgacccgtgttgccgcagacctcacatgtaacgtgtgagtccagagccttgacagtgtcttgaggccgtttgtcgtggtcgtctaagcgcttcatgaggaggtcaagcttggcagcaagtaattccgtctccttgactatgtgcatgttgggatacgcgtaggctaagatagcataaatcaaaaatttctatcgcgtaaaccaggaaccatgcaagtattagatcatagatcgttaccacttgatagattatataacttgtgattgactcctcaatcacctttgccatggccatgcacttccataatctataacattgagggacccagagatatctctccataggaggggcaaatcccatcttgattattcatatcccacaacatgtttcatagcatacccgaaaactacttttatagctacccatttacggagtagcgtttagcagtccctaagtaagctactacacatgttgagaagcatgataatctcaggtctaaggattcaacaccaacactaaatgagatcactgatgacacaacacatatggctcttgcagtgtctcatgttgggtctatccaacaacatgttcaccaacatgtgtccatattattaatttggtatctctataccatgatccatgagacatgatcatcaattaatatatgtgctgatcatataaacatatttgttccacatatgatatttgatcagggatcctttagaaatagtaacaaacaacataatgattctcatgaaagaatcacatattcattaaccaataaggagttatctatttcaaggaacaatgttggataaatatgtaaacaaagtatgtgatacaatcatctctataattgcctctagggcatatcactaacagtctctcacttgcactagagtcaatcatgaacgtatcatatacccattgccctagtgtgtgcctcatgcttaggctgagggagtggctttgtcaacggatctgcaacattcaaatccgtatgtattttgcatatcttcacatctcctctacccactatctcgcgaatgaggtgataccgccgtaaaatgtgtttggacttttgatgcgatctaggctccttggcttgcgcaatggcaccactattatcgcaatagaggtccattgggctagaagcactagtcaccacacctagtcgagaaatgaatttctttatccaaacagcctcctttgctgcttcagaagaggcaatgtattcggcttctgttgtataattagacactgtatcttgcttggaactcttccaactcacagcgcctccattcaggcagaacacaaatccagactgtgatctaaaatcatctttgtcagtttggaagcttgcgtcggtgtaaccatttacaacgagctcttcctgtcctccattgactaggaacatatccttagttcttctcaagtacttcaggatattctttacagctatccagtgactctcacatggatctgattggtatcggcttgttgcactaagtgaatatgaaacatctggacgtgtacatagcatagcatacatgatgaatctgattgccaaggcatatggaatcacactcatcttgtttcgctcatcagtcgtttgagcacactgattcttgccaagattaatgccatgtgacatcggtaagaaacctttcttagaatcttgcatgttgaacatcttcaacacctttcaatgtatgtactctggcttaatccaattagcctctttgatctatctctatagatccttatgcccagaatatatgttgcttcccctaagtccttcattgaaaaactatttttcaacgatgtcttaacggattcaagcataagaatatcgttcccaatcaataatatgtcatctacatataggattagaaacaccagtgcgctcccactaatcttcttgtatacacaagcctcttcttcgtttttgacaaagcccaacgccttgactactttgtcaagacgaatattccaactccgagatgcttgcttcaacccataaatggatttctgcaatttgcatatctttttagctgattgtggatcaacaaatcccttgggttgtgtcatgtacacatcctcatcgagatttccattgtggatagctattttgatatccatttgccatatctcataatcgaaataggcagcaatcgctaaaacaatccgaatagattttagcatggcgactggtgagaaagtttcatcataatcaacaccttgaatttgtctgaaacctttcgccaccaatcgtgccttgtagatgttaaaatttccatctacatctgtctttttcttaaagacccatttgcactcaatggcttttacaccattaggtggatcaaccaatagttccaaacttgattgacatgcatagattctatttcggatttcatggctccaagccatttctcagagtctggtcccaccattgcttcctcataggtagtaggttcatctttgtctaacaacannngccgctttgtcctgtagttaacaacgcatacctcgcaggtgtacgtcgtatcctatcggatcttcgtgaagccggtgcttccacaactggttcaacaacaacttgttcaacctgttgaacaacatcttgctcagcttgtggttgtgtggacgttgaagcgttttccggtgtttcttgaatttcttcaagttgcaccatgctcccactatcctgtcttgaaataaactctttttccaagaaaacaccgtgtcgggcgacaaacactttgccctcttcccgattataaaaataatatcctttcgtttccttaggatatcccacaaagaagcatttatctgatttaggtgtgagtttgtctgattgcaaacgttttacatagaccacacagccccaaatctttatgaaagacaaactgggacgctttccagtccatatctcatatggtgtcttatccactgattttgatggaaccctgtttagtgtgaacgcaactgtcttagagcgtaaccccaaaagct

SEQ ID NO: 33122 - DNA, 3421 bp, Oryza sativa
tccttaggatatcccacaaagaagcatttatctgatttaggtgtgagtttgtctgattgcaaacgttttacatagaccacacagccccaaatctttaggaaagacaaactgggacgcttcccagtccatatctcatatggtgtcttatccactgattttgatggaaccctgtttagtgtgaacgcaactgtctctagagcgtaaccccaaaagcttagcggcagatcagtttggctcatcattgatcgtaccatgtccaacaatgtacgattcctccgttcagacaccccattccactgaggcgttcctggcggagtgagttgtggaacaattgcacattcctttagatgattgccaaattctaggctcaagtactttccaccacgatcaaatcgtagatacttgattgtcttgcccaaatgattttgtacctcattctgaaattccttgaacttttcaaagtactcagacttatgcctcattaagtagacataaccatatctactaaagtcagcggtaaaggtaataaagtacccaaaaccacctttggcagttgagctcattggtccacatacatcagtatgtactagtcccaatagttcacttgccctttcactttgacccgtgaaaggtgcctttgtcattttgccaagtaaacaagattcgcatgtctcaaatgatttaaaatcaaaagagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaatcattgtccacttcgcctcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttatccagactctcggcgtaaccaatcattttgatcacatgtgggctcattggattaccttctgctagcctgcacgcaaccaaggactttgaggtattaaacctctcagctcttgcttggtcctcaaacatgttacgtagtctcgtgattatcgtatgagcatccaatgcatcatatttcctttgaagctcaggggacatagtagcaagcatgagatagcttgtatcaagataatcattgcatcgcttttcatgctccctacgttgagcagcaggagcattgttgggcaagttagctggaaaaggctctgtaagcacaaactctttgtgctcttgcctgagaacagttctcaggttgcgataccaatccatgaagtttattccagtcaacttctctttctcaagaatagaccgcaagttaaaattggatgatgcaggagctgccatgatctacaatagaaatatatgtatgcaaaatcagcatcatgtttacatttaacctttcattaaacaatttaacaaaagatacttccactatgtattgtgaaacaaaattccctctagtaacatagtgagtcaagatcctcattttattagtgtctagtgagctttggcatcatagctagacaactatcaaaataggtaagcaacaccttgctaatcacatcatatgtgactcttgtgctgttggggtgacatctccatgtccaacccaacctatgccccaaggtccaaaactgttttaataaccttgtcaagtaaaccaataatctccgcacatagatgtccgacatctatcctattttatcatgataaaaagtgacactttgctatgacaaacccatcacttatgatcacaaccgtattaggtgcaattactggaagagcataaatcacacttaatttttctgagggaatctatcctaccatgtcatatcaaatatacaacagcagtaaagtaagatagatataaaaaccccaagcgaaatctaaggggcaacgcacacggcggtacatagatctgagggaatctatcctaccatgtcacggggtacatagatctcatctacgattcgccatgtgaaaaccttaacggcgtaatcgaattatgccgaaaccgagtcaatctcactggctcattttttctcattggcgtacggttccagtggacatcggactatccgatgaacacaatcgcgctcagccttggtgagtactagacattccagtgaagtcaccaacccatgcgactatcggttcatctcatcaacccatgcggctatcggttcatctcatgttccgatcacctaagaactcatatacaacataatagatctcatctactacacccgcatatcaactatatgcaatgatctagatcataaactatacaaggcggctctgataccactgttgggataagcgtaagctacgatagcataaatcaaacatttctatcgcataaaccaggaaccaagcaagtattagatcatatatcgttaccactcgacgcgctgcgcagcggaagaagacactgagaagtcgaagaaactctcgcgaagtagcacgcgtcgttgtagaggaagtagtcgatcgcaccggctcgaccttctcctcctcgtgcgttctccttgccgtactcctacgctgatcagcaccgcaaaccagcggcgcctctaccggtatccacacatacagggacgaaacgccacgcgcagatgtgctagcacccgcgcgcggctagggttttgctcggggagggaagtgacggctagggtttctcacgtgatgcaatgcctccaccggtcacacccctcacgaatatataggatccatcactcgggcctccaaggcccgtaagactcctatttggatccctatacgaagtatgctcatattggatctccatccaatccccttagtccggcccattaagcgtgcgaccctgtaggttcatgtatact

SEQ ID NO: 33123 - DNA, 2039 bp, Oryza sativa
ggagtagcgtttagcagtccctaagtaagctactacacatgttgagaaccatgataatctcaggtctaaggattcaacaccaacactaaatgagatcactgatgacacaacacatagggctcttgtagtgtctcatgttgggtctatccaacaacatgttcaccaacatgtgtccacattattaatttggtatctctataccatgatccatgaggcatgatcatcaattaatacatgtgctgatcatataaacatatttgttccacatatgatatttgatcaaggatcctttagaaatagtaacaaacaacataaagagtctcatgaaagaatcacatattcattaaccaataaggagttatctatttcaaggaacaatgtcaaataaatatgtaaacatagtatgtgatacaatcatctctatgattgcctctagggcatatcactaacagtgcatgcctcgctgacgggtctggagtcgttcctcgctccaacccatattggagaccatcttctctattaaatcaacggttcctcgaaccgttttagagaagaatgctcctccagctgcctcgaccatgtgatggcgggacattggggtgagtctattataaaagttctgcaggattaatcagtcttccatcccatgatgaggacatgcggccacatactcctgcagacgttcccatgcttcccgaatggactcgtcccttgtctgctggaaactggaatccgtccatgaagggcattggttttgcccgttgggaagaatttcgagaggaatgccgtagaacatttgtcctaggtgttgacagcagcatgattggcgtagaaccactgcttcactctcccgaggagggagaacggaaacagccttagcctgacggcgtcgggaccgacgcccttcatggtgcacgtgctacagatctccaggaactgctgtagatgagcgttggcatcctcgttaggcttgccacagaacgggctagcctgtgccaacgtaacgaggctggacttcaagtcgaaatccacgtctcccatgttgatctgtggccaaatggccacattctcagcagagggagcagcgaactcgcgaagggtcttgtcagccatagtcttgaaggatgatggcgttggtacaactggtttctctgtcggtagagttttctgcggagcaatgactcgcgacctgatgctccggatgaaagcttctagattttccttgaagtttcccggcaagttgaaaccagtcatgcacgaccctgttttcacaacaaaagtgaaaacaaccaaggttatacagaggtaaatataaagtattagttcagttaatctctgttatgaatcttccccttcaacggcgctagaaatgctggttggtatttcttaacaacattattagaaatataattcccagcaatggcgcaaaaatacttatggtatattatggttatagagtttatccgcaagcgcacggatataccattgtagcaattcacccgagagtattccaagggtatcatatttattttatcccgtgggaagatcatgtagagagaacttgactaataatttatatattacttgtgataatcatattctaagcaggggttagaataatccaagggtagagtgacacacaagcattagctacttattctcataatatattatctaagctaagtggaaagaaaagagaaagataatctattcctatacttctaatatatatagtatacatacattcttgttatctgatatactagctagtaccctctatccgatgctctcctggtactctgagaagccacccctgactgtcgagttccttacgacagcccattatgaccatacaaccggggctaaataaggaggaatacccctcccagtgaattaacataggattatatacacacgcggaagaatacccgtactgagctattgccatcagcggcccacctctcatccacagcatataaccccaaataatgatatcctgtaatctagacaccacgtctaaactaccaaatactactcta

SEQ ID NO: 33124 - DNA, 1280 bp, Oryza sativa
  unsure (1)..(1280): unsure at all n locations
nnnnnnnnnnnnnnnnnnnnnnnnnnnnnnnnnnnnnnnnnnnnnnnnnnnnnnnnnattctcaacatcgcccgattgatttatcatctatgttgatgtcgattctcctccactttatttttattctctgcaaaaggttagtgaacctaatactagtggaatattattattctaacatgtatatgcattgcaagcatcactagttctcctctattttggctatattgatggtcgaaacttatcgataacgaccgtcaacaggcttgaaagagaatacgtcccacatggtagagctggaagaacccttgtggctgcgattggaatggatatcccttgaagaatttatcacgataacactattccatatgattatgcgaaagtgcagttgcaagtggtgaacaaagggttagagtcatacgatctggacatccaaactcctgatggcatatccgtacttggggatgcggttgacattatagtattgtagcacataaagatatactctttgggactggcaacaatgctctgtcgaaaccactgagacctcctcaaaaacaactatcgaatgataaggtggaagaacatgagcaacctaagagcactgaagtggcatctacatcagcaatattgtcaattatgccagcaatagaaccgaaatcgaagtcgcaacaggtttggaatgggtcgaaatagaaccagatgtgtatgaggatccatctcctgcaaaagacaacgtggacgcaccctcggtcgatgactatgtcatcgacaagtccgaagtgcctaaactggtcaaaagccacaactccaagtccaaggataatcagaaggtgaagtggatggtaaccgccttctgaggtggtaaaaaacgtgccaaggaaagagatgttgatgagaagaagaccggtgaacttgccggcccaaaatactttggaacagatgattgtctggcagtgtttgaaaatggcaaagccttttggctggattatgcacttgaagaaggtccgtgggagatgagaagattacataaatggtacacggacgccaacaagaaaggcctaatgtcattagctgtttgaacatcacctgatgctttcatggccgaggaaggtttcttgtggctcaatttcgctgatcttcacgccgtctgtcggtgacatgggatcaggagtatcatgactagaggtttgaggcagacacaatcgcacacgtggcctggcacccccgagggacgtcgggcccgaaggtgatgtgttcgccctcctcttagtccccccgag

SEQ ID NO: 33125 - DNA, 4041 bp, Oryza sativa
  unsure (1)..(4041): unsure at all n locations
nnnnnnnnnnnnnnnnnnnnnnnnnnnnnnnnnnntattacgctcctcaccgacccgaacctgtatacatcgcccgtgtcttgtgtgtttcctgtctcgcgagccttccacatacagagagcttagaatctcaccctgagtccccggccgaactggcaaagggggcctgtgcggtctcccactgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctatgcgggagaaggcgctcgagagggccgaaggatccgcgacttcgacacccacaggaggtggagaagggcggcgagatggggagcgtcgcctcctcgtctacggcgatggcagcacgccccagggcgcgctccaagctgcgggcgcgctcctacgtcacccgcccgtcgcccatgacccggagtctccagcccaacgttggctggacgatgtggccaaattgatcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccggaaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgcccccggttgttggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacacggtcatggcgaatttctttcccatggccctgaaaggacaggcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgacggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgcaaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacattgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctccgcccccgccaccccgaggcagcggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggggttgattgagcaccgtctcgccgtgcggccgggcgcaaggccggtccggcagaaagtgcggcggcaggccccggaacgtcaagccttcatccgcgaggaggtggcacgacttctggaggccggattcatccgtgaggtcatccatccagagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgccccccccagcaaacttagggatgtgcaatgcgtcaccgattgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccctagttctggtcgccccggagccagacgagcccttgttactctacttagcggcgaccccgcaagtagttagtgcggcattggttgtggagcgcgatgaggacaattctcatttcacgcttccccaccctgtgccgacttggcccgggagagagcagggaggagaggctcccgagccgaacggtggcccaaggcccccgacgaccggagttggccctctacccgcttgtcagacggtgctaggagcccccgacccccaagaaggccccgacgccactgtgggaaggccgcacctatcgccctttgaccccgaggctaaccctgtgccgactcgacccgggag

SEQ ID NO: 33126 - DNA, 6418 bp, Oryza sativa
  unsure (1)..(6418): unsure at all n locations
ccaagcgcatcgggtcacggtggttacgtcttaccccctcggccaaatcttgcataatcgagagggtactggacgggtggtgaaatgggcaatcgaactttctgagttcgatttgcactttgaaccacaccacgctatcaagagccaggctctcgccgattttgtggcagagtggaccccagctcccgagcctgtctcagtccccgaggccagctcgggcccctcacagctgcctcacaccgctcactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctgcactggggatccgccgcctcctggtgttaggcgactcccagctggtcgttaactaagtctgtaaggagtaccggtgctctgacccgtagatggacgcctacgtgcgccaagtacggcgtatggagcgccattttgacgggattgagcttcggcatgtgcccagacgggataacatgattgccagcgaactctcacggctcgcgtcctcgcgagcccagaccccaccgggcgcctttgaagaaaggcttgcccagccgtcggcgcgacccgaccccttaggggagatggatgcgcctgaccggcccccgaggcccgtcggagtccaggcctcgggacctgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgatagctcttaatgatgcggtcgacctggtccggcgatgcagagtgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgtgaagacatgggcatcaagctctgcttcgcctcacctgcccaccccagaagcaatggccaagtggagtgcgccaatgcggaaatcctcaaaggccttaaaaccaagaccttcaacatactcaagaagcacggcgattcatggatcgaggagttgccagcagtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgtagggttggccgggggctgccacacatgcacattcttatttcttttttttttcagtatttcaataaaagaagtttcaatttcctaaaggctgtatctgtgctgtttttttttttccttttgaagaatcttgacttgaaataggtcactcgtgctcaatcctgccctcgggggctcgggtcggctaaaatcgcaaaacggggcccagaaccgagccgtgccccgaggcgtggtgaactccgggggggaatcggcaaaaacccacaatcgggtcacccataaccctcggtcaccacgttcccggcctggccagtctcgacatgtggatctcccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgtcgtcactgtcgtctgcaccaccggcattgccctccttgtcggagttgggggcgaacgcgagccgaggggccgagccctcgaagctgtcgacgatatggtcggcggcatcccggacctgcgcgcgcgcgcggtccacggtcccaagagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggtgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagtgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggctgaccgccagctgttgcgccgcggcctcggccccctcgagagctcgctcccgctcggtgagcgcgtcctcgcggaggcggagcgtgaactcttcttcggcgcaggcagcctcgtgcgccgccagcgttgcttcccggatggtgacggcagcctcgcggtccgccagatccctctccacgacgcaggtgcgctcttccagcgccatggcgcgcgcctcaagggcctcttcacgccgccgggacgccgcttcggtctccgccgcccgctgttctcgggcagcggcagcgtcaagcgccccctgggcggcgtcgagtttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgtagaaggggctctgcgttcagtggggcgatagaaggcgtggggaagagccgccttggagaggatgccacgcggctcgggccgccgatggaagtgccggactcggggatgtcccccggacccggttggtcctgagcgacgcccgagggagtgggtccaagcgacgcgcccgcagcctcgtcgccagccgccccggaagttgtcgcctgagcgtcgcccgagggagtgggcccaagcgacgcgcccgcggcctcgtcgcgagctgcctcggaagtcgccatcgcctcgtcctggcaaaatccggcctcctcccgagcggtttccccggcctggcgggcccgggcggcctcctcccgagcggtttcctcggcctggcgagcccgggcggctcctgggcggcctcctcggcttcccgtaggcgatccgcggcctctcgccggtcagattcccgcctgagggcctctgcggctgccggatcctcggcctcagactggccggacttggaatggcgggagggacgcgacgggatctcgctgaaacaaaagaaaaaaccagaagacgaacaagatgggtgagtgaaaactcgcgttgagagagtgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgctgctggcacgcgccgccccgccccctcggggaggagatgggggaggtgttcctccctgcttcctcttaccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccaggtagtctggcgccgggcgtccctcgcccagcgtgaccatctcctggccggtggcagattccggcatgaagcggcgcgacagcccagcctgtctctcgctcacgatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaaaacaaggggaataatggcgaaaggaaggaaacagattccatcttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgccatgtccagattcgtgtgctactcaagtaatgtggcagtcttgaagagaccgctcattgttgacagccgagttaccattgccgannnnnnnnnnnnnnnnnnnnnnnnnnnnnnnnnnnnnnnnnnnnnnnnnnnnnnnnnn

SEQ ID NO: 33127 - DNA, 10554 bp, Oryza sativa
agtacggtattacgcttctcagtggcccgaacctgtatacatcgcccgtgtcttgtgtgtttcctgtctcgcgagccttccacatacagagagcttagaatctcaccctgagtccccggccgaactggcaaaggggggcctgtgcggtctcccggtgaggagccccacgctccgtcaccgtctatcgttgggaaaagatggacataaactttgttggtgcatggtgcctatgagtatgaacacacattgtttacacaaataaataaatatactacataagcatgtgattagtattaacgggtttttctttatagatgcaatacatggatgcttagaagaccatggttcccatcggttatctagatccaacaaggatctgtcaatcccagcataccgtaacgctatcagaaaacactgaacagctcaagaacatgacgcctgaagaaatagcggaatacaagaagggcttgcatacgatcaagttgcttactatggtacaatacattagacgagctttcctgaaatttcaacggaaaagagtcctaatggccgtatacaactttaagtaaatcccatagatttctctatacacatctgtgttatttcatccgtgactaactgcaccgtcgttaccatgtagcaatcatgaaatttgtttcttgatctacccgaagtacaggactgttacagtcctggacccccttgattataatcacatgacgtatacacaattcctaataatcttacaattgcaagtgattctaatccatgcatgtgtacttttcatgtattataattaaatctcctccttaatacgaatcgctaatatccttacaatgcgtacaactactacaagataaagagtggagaacaactataaataaggaagaagctactagtgcatacatactggctggtaatactccactcacttaatgtatttaaattcttttacttgcagtatctaactaattccttctatgtgtatgtcacgaagtattagaagcaacctaaaggcagtaccctctatggttattacacatgcaaatttctcagtgttaatgtgaggtacaggaccaacgcagaggatgtaagtcttcaactcaacgtataagtccaattgagaactgcacatctaaatgacatacaaatatattctcgttcttccgtacatgcagttgcctagaatcaaacatcgaacaagctttgacgataaaggcattaaaaatatgcagcaggacctctgccacttcatccattgcgagtgctgtcataaggatgtaaggatggacggttcttcaacacagaagacagcctagcgacaagtgataaatacaagtctcttctggagtggaacaatgcaatgccatgatgtattaattagatagtgcattcaaaatgacaactgtaaaaattattgtaatatattgacaacacttttcactactgcaatatatgtatttatgtcagtattaaatgtttgttactatctaaatagtattatgtattaattaattaattatttgcaacattattgattaaaaattatttttaaaaaaattggcgggaaattttaaattttggcgtgcatattttaccaggcagccccgccttctttatcacaggcggccccttccctctttcccaggaggcgtgccgtgctcccgttcacctgcgaaaatcggcgataagaaggcctttgcctacaaaaatgtttttggtccgcctgagaagagaccgttttcagtcctatgcaaaaaatgttttttctagttgtagtggctggtgataatcaaaattcaaaagggaagattagatggatcccaagtgcatgcatgcagtacgcttctgggaaagaagaggatgcatgttcatgtgcaaaagcttgctgaatatgtacgtggaccaagaaacaaaggaagaagattacggctcaatgttgtgctacatgggctgagcctgttggactctgtcatgcgtgaaaactcgagttgggcctcgtcagtcagattgctctcttgccgtttggatggcagccggccctaagggaaagtttgtttgtgtcgctagcgtaagcttagattgattcatctatttttttttaagaaaccactaggatataggccctttcgcagagattcatctattattatttttgctaattcttcggagttgcttggattgactgtcgttgtcaacccgttcgtgcaatcgccttcgtgtcgattatgtggattggatttgtgaaggttcgtgtgattgacgtcgttgaggtgttgtacacgggtacaaggttgctgcgaggattgatcgagctgctactttcgagttatcattcgtcatcactgcaagaacgggccaccctatatcataactgtttcaactattaatgtatataattttatgtgtagaatagtgttggtgacgtgagactcggagatatatagaaatagactcaattattgagcatgccctaattgtactattccaaaacatgtgacaccttaaatcatgggtggaaaagactaccaaacttgcgcagttgcgctttacttctaattgtaaatgcatgcatctcttttttatacatgtgtatcattcatcctatattttggaactgagataacaacgttacaatccgtactcccggagggacgacttcccggcacctacacactgtagcggaatgaaagtataggttagtataggttacatgaaattggacggtagggaatgtttcgtatatatgaagctaacgcccgcaaaaggcgacaacatatggttgttactgagagacacatccatacacgtccagacatccaatttaaacccctctctaactatcctccacgtactagagaagcatatatataattagtcgcaccaactggttacatttttcctggccggtgtaatttgcaattattgcgcatcgtacaattcaatgacaacttaaactgtctttaatatatatcttcaaaagtaaaagactatcgttatcaaagtatcagtgcatcgacggcaacacactgtggaatatatactggaccgttgtattgcttgggcattaagatcaggtcgatcagtgctggttcgtaagagccatcagtaccggaagtcaacccaggcacaaaatttccagcactgatgacccctctcatcagtgccagttctggacccggcacagatagagcttgcgagcatcttgggcaagatcagattaactcatctgtgccaggtaataatttgaatccggcactgatgattgtatatctctgtgctgggtattagtttgaatccggcgccaatggcttcatacggtcatacctgtacaagctatacataataacctgcattgatgtttttttttcgagattaaaaaaataaataaaggaaaaatgtgatttggttaagcatgtatgtactagggtgatttttgcaacaaaactaagcaggtgggtggacatttgcaacgaaaataacttttagggtgtaatgcatgtcaaacttcaagtgatttagggagtgccttatgcaattttccgttcattaatttttcaggcagacctaaaaaagtaacgcttgtaaaaatgttgagaggccacacagatctagccccacttgtgaaaaccaattttcatagcaaaatctaaaaggagactgcctgcaaaaataacattattttcacaggcgaacctcttagcataccacctatgaaaattgattttaactttgtcaccctaaacgcaccacctgcataaaaggaaaaaacctaagctacacataataacctgcattgatgttttttttcgagattaaaaaaatataaataaaggaaaaattgcaaaaaaaaacatcccataagtcacttgaaatttgacattccaccttataagttgttgcacatacccatccttagtcttgttgaaaaaaccatcctaacacacacatgtttaactgaatcagtctgttattggtgatgtgagatttaccacaggcgaagctagccaagttaatcttctccaagtgcttgcattagacttatttttcatatttgatttaactttttttttgcaaatagcgaaactccctacgacaacgtttaagctctcgtccgcaaatttatctgtggaatctcacaatagaaaatgtcaaaagtatttaattttggtaaaaatcgcattgacagctcacacttatgaaaacatgtggtttggttaagcatgtatgtatggggtggtttttgcaacaaaactaagcaggtgggttggcatttgccgtcctcccaccagcctctccctcctggtagctgcgcgcagcccacaacactgtccctgcccgctaccaccgtctgcgccatcccccctccggccacgatggcctctctctcctagaggctaccactgtgcctctccccaccatcgtcccctggtactcgaccccggtcagatatgacgtggaggcactagataggggtgggcagaataagaccgaaccgaagaacagaaccgaaaagaccgagactgaaaccgaaaagaccgagaccaagaaattcggttagtaattcggtctcagctctggaaagaccgaatttttttcgggcaattcggttattgtcttcggttaaccgaattaaccgagaaaaccgaattgtggccaataggcctaggaggcccaataagcccactaaattgctaaaccctaaaagccagcactaccactcgtcacgaggccatcaaccccatccatcatgctgcctctacctccgatccatccccatcgcgtgtcgcgtcgcgggcatccacagcgtcggcgccgcctccggccagcccacctccgttgtggccccgacgagcaccgccatccgcctccgccacggcccgacgagagccgccgtccacctcgcgccacctccagccatcccgcctccgccgcagccccgatgatcgccgccgtccgcctcgcgccgcctccagctggccgccgcggccctgacgagtgccgccgtccacatcggcgctgcctccagctaggccgcctccaccgcggccccgactagcgccgttgtccgcggcgcacctggcgagcagcggcgtggccttcaccagtgcttgccgctgagccggtgaacttctccagtgatttcggtcagaccgagactgagactgaaaaaactgagaccgaatttgccggtcctgagttttttcggatgaaattcggtgctgagttttcaatgactgaaatgaccaaaaaaccgaagactgagaccgaatttttcagtcagaccgaacgcccacccctagcactagatctagctacggaagtaccggatgcgggcacgacggtgccggatccgccacctccttcgctggggagtgggtgcgttgtcgccacctccggtctccggtcaccacacgtcatgccgcctctcccatgccagagacagggcgccgctgcaattaaacctagccacctctatctcggcccgtcgtccggttctccagcgacaccctctggcagcagcgatcgaggtgggaagaggggggcgacgggggctagggtttcgcccctgagccgcccacgcgtgggcgatacgagagcctgttagttttttgttttatcttgtttatacgttatatgaatatagtattgtaaaattttgaagaatagatgtgtgttggtttattgtttggggtgctagatgaatttttattgttgcaaagtttcttttttttttgcaaattttagggtgtatatagatttttttcatgtcctggctactgtagctgaatggaagttgttttgcttgaataggacaatgtaggacaatggagagcgagccagctcctgcgcacagaagagtaggaccgcacaaactgataaggttgcacctgaatgcttatggaaccagcatcaatttaccggcaccattgagggtagtcattggtaccggttctacaccattgaggttacaccaatgacctcatcattggtgcctattataatttaatactagcactataggggtgcaccctttttaatttttctaagtgcgaaaaaacccaaaaaaatattttgcattttattagacgtcaaccacaatcacactttacttcccccaagtcatattatttttttaacccatattctttggaatgtactccctccgtcccgttaagtgcaacaatatatatataacctccttactatctcacccaggaacaattattgtcttggaagcaaatgcttttttaaagaaattatactccagtccatacttaatactgtagatgatgtcaaatgaaaattttgtcaactacaaaattgtagatctcatcaaaatataaaactttcgtataggttctatctccatccgagatcgtttataaattttaaaaattcacttatccaaatagatttgagaccttataatatatatttttggttatccaaacaacctcaaatagaaaatcattagctagaaagttgtagaactcatataactttacaaatttcagataaagtttatcttcgtccgatttcgtataaaaaagttactaaaaacacacatatatgagttgtggtattaatgatgctggttttaattataaagcggtacctagggtagtcctaatgggcgggtgattgctccctccccaccccagcgatcacccgcccctccccctgtacgttacttcctttccccctttctcctccccttcttctcttcctactacaccataaatatttgaattcaaatttaaattttaaactgatatgtaaactttttacttataaactttgggtctataaactaatatttgaattcaaattcatatttgaaacgggtatgttaacttttgacctataaactttgggtctataaactaatatttgaatttaaattcaaatttgaaacgggtatgtaaactttttacttataaactttgggtctataaactattatttgaattcaaattcaaatttgaaacgggtatataaactttaggtgtataaattttagatgtatagaaatactatatataaaaaaatatttgagttcaaattcaaatttgaatcggatatataaacttttgacttataaactttaggtctataaactttaaatgtattgaaatactatatataaaaaatatttgaattcaaattcaaatttaaatcggatatataaacttttgacttataaactttgggtctctaaactttagatgtgtaaacttgaggtgtataaataggtgcataaatttactaaaatagaaaagtaatgcggtgccaaaaaaataaaaccaggtggagggagggtggggggtgaattgattgctaccgccaccaggcgagcgatcgcccctttccgcggtacctatgacttcagaaacggtacctatgacttcgatgcggtattttggtggatgttgttaaaccacatcgattgtccggtatcagggatgatggcgcggggtgttttcggaatctcggaccacctttgcagctcttttatatatgagctggctagccttcatcgtgatatactactcctactaatcagctgctaattataacctccataaattctctggctgatcctaccttctgttaattttccgtgaaatactgcgtggcagggcactagctagttatgtcccattaccttcctttcctctctcatggaatggttggtcgtcgtccggttctgcagccggttcagcgttgcaatccgactggtgcccaagctcgcggcttcttccgacaacagagcgcgagcggtgtgctgctacatgcatatacgcacaagaagtctggtgatgccgccccttctatggaggcatctagctttcagcccagtgtgtggggagatttctttatcaactacgaaccgaagcaactacaggcaagagcacgatatttttatatctatgtcttttgcatgcatgatacactggtgaaaccatctttggttggtcggccgaaatccaaaatagtcccgattccactaaaaaccggttagagctactttttgatctttgctcccagttggtaacatcaaccgggactaaagatcatttttagtcccggttcaaaagacggaaggtggtgtcagacccctcctttatctttagtcccggtgggtgacaccaaccggaactaaaatatttttactctcggttggtgttaccaaccgggaaaaaagatcgacatgcgccatgcgagatcaatagaaccaaggcgcatggaaggatcagttaataagttctaacctttatctcctcctcttctcactcaccctatcccttcctcttcctcctcccatctcttcctctacctcatctggatccgccccctcccctcccctctcctccccacttctcaacctcctctcgatccgccccctcccctctcctccccacttctcaggcggcagcggccaggcggcctcgcgcggccgggaggcgcggaggcggcctcgcgcatcctcacgcggtagccggagggcgaggcacagcgcgcggcgggcggcacgcggcgcgggcagcggagccgcgcacagggcagcagcgcgccggctctcttctctttttttttataatttgtgattgagagatgtataatttcttttttagaatttgtgattcattgcatggatctgagatgtataatcgatctgtgatgcatttgatttgtgtgtaatttttttaagatttgtgatgtatttgatttgtgtgtaagtaaattaggatttgtatttttatttgtgatgtgaatgatttgtgatgttactttgatttggagatttgggatttgatttaggtatatgcatgacactcgatttggggatttgttgtttgatctgggtatatacatcctactcgatttgagagaaaataaaaagaaaatggaccaaccgggatatataggagtaaaaaaatatatataaactgatgcgctcaacctgaatgttttatccacacacatggaatgctaaaggagctagtttggatagttaggggctttctccctatattcctttttgcttgtcattatggacacataggtctatagcacacatcgttcttttttttttctaataccatataaatgcgcacaaactcacatcttgttcttatgagatccactttctcattatatatatttactaaaagaataaatttcacaaaaatacatatactatgaacaaactatcacaaaactacatattttacataaaatttatcacaaaactacatttaagatacagtgtcacaaaactaaatatttagtaacaaaattatcataacactacatatctagaaccaattttagtaacaaaactacaatgtttatagctacaacataataatggtgctacatatttaaagtataaaaactagataaattcaatactgaatatgtagttttatgatatttggccttaaatctatagttttaacataaatttggtgctaaatctatagttttttgatacaattcattaaatatgtggttttatgataatttgattaatatacctatattttttgaaatttactcttactaaaatagtaacaataaaacattttaattggtaatctagatactacctccaagttgataataattatcgttttaacaagaacatatagtctacgaaattaatttttaccactattttctattaaaatatatagttttattaaagtaccttttaaacattaattcttcaaaaacattaatgcttcatgtttagaagttaaatatttcagacgttatttatagtcaaggtttttcaagtttgacaactccaaaatgacaattatttttaacttggatagagtattaattaacattgctttcacatgacgattcataaagttgtttatgcctctagcgtgcataatactaccttcctttttaggttataagatgtagtcaaactgtttcaaatttaaccaaatttatagaaaaaaaatagtaatatttttgacccaagataaatttattataaaaatatatttaattattaatttaataaaaaaaatttggtaatataaatattaatatatttgtctataaacttagtcaaacttgaagcattttgactttggccaaagtcaaaatatcctgtaacctgaaacgtaggcagtatttggcagtagcttttaagcatatattttttatatttttataaaaaaatgtttttaaattttcacttcattcatgtaaacaaaatatattcatcgatggtgtatcttatttgtttttttatggtagttaattttatgctgattttggcatataattggtcatcgaacaatatggacaacaaatccacaacaaacacaagttatatacattgtaaattactgactcaactcaactatgttggttccaatatttttctttcggttgatcatagataactaatcaaattcatgcgtgcaagcagcgatcaaaggagtggatgatgaataaggccgataagctacaacaagctgtccgcacactgtttaggacctgtaatgacatggtggacaagat

SEQ ID NO: 33128 - DNA, 85 bp, Oryza sativa
catatacatatatatatatacatatatacatatatatacatatacatatatatatatatatatatatatatatatatatatatat

SEQ ID NO: 33129 - DNA, 505 bp, Oryza sativa
gctgcacacgtggaaaccacatggctaccaagcgtgcacactaacacggtcaccacacacacaagcgaatgactaccgacaccggtacacaggtaccggggtcgacaaccgcacaacgggcatgggcgacaccgaaaggacgaggacggggcagtgagaggacagatccttaccaccacgcgacgaggcgtgggaacgacgacaacgaacgggcgcggctgagacgaacggcgagaagacgacttcggcggcgatccttggatgaaggcgagacgcggccggcacaaggcttggcgacgcggagccgaggacgaagacgatgacggggctgcggcacttgacggagcgaggacgacgaacgagaacggcttgacggagggacgaacgccacggcgaccgggaacgacgggaggacggcgacgatgacgaccggggccagcgaggaggcgatgtgggcagccggcagtggctggacggagacgaggacggcgtggaacacgccgtt

SEQ ID NO: 33130 - DNA, 766 bp, Oryza sativa
accttgaatggggaatcctgaaatcgatgcctgctgtcattgtccgacttctcggttcccattgaaccaagatatccagtgttttgcaggaatttggagctagatgcgtccaagcgagtgcttgctgctgcaattgtgtcaagctgtagactgattgaacaaaatccatacttttgggatactagtaagcagcgcacagatcgcatatcatttgacttacagcatacacattaattcttcaagtctcaacttggattacagcgagattaacgtgcgctcctccctaacacctctacgtcacatcccgtagttaaccggacgtagagagagagagagagagagagagagagagagagagagaatacatctattattcagatattattccaatgtgtttctggacaagtagcctaaactccgatcagtctcgagaagcctgcccgtgtgtgcaaaatccagaaatcacccaggacaaatttacatgatcccaaccgtatttgaggccattaacattgattaaagtcaaactatggccgttccgactccgaaggcgctatcatagttcctcaccatgttcttcgtcgagggcataccagcaacaacatcttcttcgatgccacattcgtttgtgccccttatgatcttgaagtacccatcctaccagtatcaccgaccaaacattattaatagctcaaaaaatacaaattatgcaacatttcacttattgaacttatatatttgccaaagacttacatcgccccatcct

SEQ ID NO: 33131 - DNA, 947 bp, Oryza sativa
ctggctcggccattgggctgaacatgaaaagcttggcgcacacgaaagagtgcgagagctcagaaaatccctggcagagtcccctacctggcgcgccagatgacggagcgtggggctcctcactgggagaccgcacaggcccccctttgccagttcggccggggactcagggtgagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatgagccagcctctcccttgttctgggttccccatctggaaaagtccagtcccccctcccagtgggcaaggtcctccttttatatcttaaggggataccacatgcaccatttctctcttttttgtggggacttaccccaccttttcataaatggacggagatttgtatagttgccgtccgagtcaccatctgatgagacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgactaggactaacgtgccatctctgggaggtaacacgctagctccagctggggacgagcgcctagaagccctcgtcctgacgggatggggcgaggcgtgcgtcagatcgcctgtcgccaccaaacccgcgatctgacctctgtgactggtcacagaccggataaacgagtgcactgcactgcgttacatgcggcatgacgcgctcagccaaaccgcaataaatgtggttaggt

SEQ ID NO: 33132 - DNA, 884 bp, Oryza sativa
  unsure (1)..(884): unsure at all n locations
tttatggtattgaaatactttccgagtatatgaatgcctactttatattatgttcatgttatactgaatatactgctagcttatctgggagatgctttggtgcaggtataatgtttgtgtatgcaattactctatgtcatgacgatgatattagagtagtatctggtagtttagacgtggtgtctagattacaggatatcattatttggggttatatgctgcggatgagaggtgggccgctgatggcaatagctcagtacgggtattcctccgcgtgtgtatataatcctatgttaattcactggggagggtattcctccttatttagccccggttgtatggtcataatgggctgtcgtaaggaactcgacagtcaggggtggcttctcagagtaccaggagagcatcggatagagggtactagctagtatatcagataacaagaatgtatgtatactatatatattagaagtataggaatagattatctttctcttttctttccacttagcttagataatatattatgagaataagtagctaatgcttgtgtgtcactctacccttggattattctaacccctgcttagaatatgattatcacaagtaatatataaattattagtcaagttctctctacatgatcttcccacgggataaaataaatatgatacccttggaatactctcgggtgaattgctacaatggtatatccgtgcgcttgcggataaactctataaccataatataccataagtatttttgcgccattgctgggaattatatttctaataatgttgttaagaaataccaacaagcannnnnnnnnnnnnnnnnnnnnnnnnnnnnnnnnnnnnnnnnnnnnnnnnnnnnnnnnnnnnnnn

SEQ ID NO: 33133 - DNA, 681 bp, Oryza sativa
  unsure (1)..(681): unsure at all n locations
aannnnnnnnnnnnnnnnnnnnnnnnnnnnnnnnnnnnnnnnnnnnnnnnnnnnnnnnnttcaagagaatatttggcaacaccaatgaagcaaagttagtacgttggcatgccacagagagaaggaatgacggtttgctaagacaccctgcggattcgattcaatggaggaatatcgaacgaaagcacaaagactttgctgccgacccccagaaacatgaggatatgtttgtgtacggatggcatgaatcctttcagagacatgagcagttctcacagcacttggccagttctcattgcgaactttaacctcccaccatggttgtgcttcaaaaggaaatatattatgttgtgcttgttaatccaaggtccgagacaacccggcaattacatcgatgtgtcttggagcctgttatcgatgaccttgagattctgtggaaagagggtgtggaaacttgggatgcatatggtcaggagaacttcacactacgagttctattgttttgcaccattaatgattatcccgcgctgggtaatctttctggacaaaccgtgaaaggaaagaacgcatgctctgactgtatggaacatacacgcagtaggtggctgaagaaatcaagaaagatggtttacatgggtcataggagatggctccccctactgcacgcctttagaagaaaga

SEQ ID NO: 33134 - DNA, 1204 bp, Oryza sativa
tcggttaatcatagataactaatcaaattcatgcgtgcaagcagcgatcaaaggagtggatgatgaataaggccgataagctaaaacaagctgtccgtacactgtttaggacctgtaatgacatggtggacaagatgcacttagtagacgctgtccaacgtcttggaattgatcacctttttcaagaagagataagcagcacactaagcgatatcaatggaagtcaatttgctagcaatagcctccatgaggttgctcttcgctttcgtttgcttagggagaatggcttttgggtatcaccaggtatatatcaatctctctctctctctctatatgtgtgtgtatatatagatattacatatatatatatatatatatatatatatatatatatatatatatatatatatatatatatatatatatatatatatatatatatatatatacgtaatatatatatatatatatatatacatatatgtatatacatatacatatataggacactcatatggggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatgaatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactacatatatatgtatatatatatatatagcttaaatagaaatgacaagacatgcataaatactagattgatgcagagttcgtaagtagattgattaatgaatactaggatatatagtctcattttttctgggtgtatcattctgaaacggaacagcacagttaatacaaagaaatggtatgtcctgcagatgtgttcaaaatatttaaaggtgaggatggaaggttcaccgatgcaatatctaatgaaccaaggggattactaagtttatacaatggcgcacacctcctcgtccatgatgagacaga

SEQ ID NO: 33135 - DNA, 3955 bp, Oryza sativa
ttttctgggtgtatcattctgaaacggaacagcacagttaatacaaagaaatggtatgtcctgcagatgtgttcaaaatatttaaaggtgaggatggaaggttcaccgatgcaatatctaatgaaccaaggggattactaagtttatacaatggcgcacacctcctcgtccatgatgagacagaactcgtagaagccatctctttttcaagggaccatcttcaatcaatatgtgattcaagtgagctcaagccccctctagctgatcaagtgaaacgtgccctagacttaccattaccaagggcatacaagagaatggaagcattgcattatatgttcgagtatggacaggaggaaggccatattgtggtccttctggatctcgcaaagctggagttcaacctcttgcagcatgtccatttgaaagagctgaaatccttttctcagtacgcatctttccttgacatatacacatatacaaagtaatagaaaacaataaaagtaatcaataatgatatgaactatatatctcataagatataatgatgtcctaaactactacaagccaaaatttgtgtagagattaatttcaattcatttataatataaattctttcaattcatgataaaaatctatttcataaataccagacacggtatagactgttatgagatatttcataaaaatatttaaaaatgtatctgttaattatcaaataggcttgaaaggagacactatgttcgctatggaggtcataaattccaatattaatcagaggaaaagaaatggagagttcaaacattgaaatttggaattaaaaataaggaatattacaaaaaaaagtccataaagaaccaaatacaagattaattaaaatttgaaatcaaaacaaaataaaataaaaaattagaaaaggaaaagagtgaactcaagtaggaatggaatataatttagaaataactagcatttagaatataaaataaggagtattgaaaacacaatccatctgcaacacaagacgagattaagtaaaatcctgaattaaaaaataaattccaaaattaaaaaaataagaacatgagataaaatagaaatataatttagaaataagtaaaattctaaataataaatactccctccatcccaaaatataagtatatttagcatagtgacaattcaaactttttaactttgaccattaataacaaacaaaatgaaaaacacaataatgtaaaattgatgttactagatttatcattaaacaaactatcataatataaaactctttttatttaaaatatcttacttttataaatattgttgatcaaagtagtatctttggagaccgtgttagtaaaaaaatgcttatattttggtacatagggagtaataaatattgaaataatagttcatctagcaaaccacataagattaattaaaattcaaactaaaaataaaatatattttgaaattataaaaataaaaagaagagctcaagtagggataaaatctagaaataactaaaaattgatattaaaaataatgaaagaagagatcatctggaacacaacatgggattattttaaaatttggaataaaaaatacataacagttcatgtaggaatatattttagaaataaatggaattcaaaataaaaaataatttaaattccataattagaaaaaggatgagagttcaagtagaaatataatttacaaataaaaattaaaaggaataaatttagaaataactgaaattcaaaactgaaaggaataaatattggaagaatattccatggagacatcaatacgatattaattaaaattcaggaaataaagaacataaattctaaaaatagaaaggaggaaaaaagagggttcaagtccgaatacaaattagaaataactgaaatttaatattaaaaagaatatgaaaaaacatatatgtacaacacaacatgagattaataaaaattttaaaaagttaggaaaataaaaaaaaataagttttcaagtaggaataaaatttagaaataactaaaatttggaatagaaaattaagaatattgaaagaagagagtaaaacataaaataagttaaggttcatttacaacacacactgaaataagtaagatgcagcataaaacatgaaatataaaaataaattagaaacaaaataagagttaaattcagaatacaatttagaaataaccgaaattcaaaataacaaaatagggaatattgaaagaacagtgtacaaagaacataatacaatattaattaaaattgaaaataaaaaataagatctgaaatgagagaaaatgagaattcttataaaaatgcagtttagaaataacaaaaactagacattgaaaagaagaaatactgaaataggggtcaatctaaaagacaacgattgcaaatgatgatagagcgggtagcggcaaaccataaagaagtagctttggttgatagaccatttattctaaaaactataaaaccaagcctcaatgacgattaggttctatttttataatcctaatgatattaagaggaagggtgacatgcaagctatgaaagagtagggttgaagcggttgacaagacttctggaaagtaaaaagaggaaacctggccataacaatgaatagcttcaatattttaaatccaaatgacaataaagaagggtgcagtgggcaagccgtaaagaagtatggtagcggcgtttaacttgctttctaaaatctataagatccaattgttaaaggttttaaggaggatgaatagaagccgtgacagacagggcaagcaaataaagagacggtaaagatcttggtggcaactggtgtaacttttaaaaatataaaagtgaaaacccaataattataaggttcaaactttaaagtcctaagacaacgagatgattatttaataattttaaggaaaatcatgtgtaaacaataagataattttttagggtgctagctgtgtaattgcgcaagacacccaactagtttcaataatatcatatttgtttaaatatattgtatagaagcccacttacagacattgtagagaaggttttgagacatttcataaatattgtctagtgttgatgtttagaaactgtaatttaccaaatgttaaaagacatttttgataaagttatttcccccctgctgtaggcattatttagggtacggtgttaattcgtgtgtactggaaactgtaatttaccaaaaagttaaaagacatcccgcgtaggcattatttagggtacggtgttaatttgtgtgtactagaataaatataagaggactgatgtaggacatgaacaaatagttccagaagtcaatatgtgaagttttgatgagatggttagcatatcaaggtataagatggagatctggataggttcagggattgactgtagcatggtttacttgcttatacgtgttactttgaaaaatgttactttttgccactctgtttttccagaaaaaatatactgttctctttttttgcaactgttaatacaagttagtacaaattaaattatatgttatatttgtaattttctaaatttttgtttatgtaagggtgtagcagcattttgagggaaaattaatgcttgactcactactacaaaatcagttttttttctggctaaaatcaactttggcaagcaggcggccaaccgcctgcaacaaaaggctagagaaaattgtgattttggctggcgggcctcatccgcttgcgaaaataaaatttcgcaggtggcatcctagaaatccaccggaaaaatggatttccgctgatggcacatttaggtcaactgccagtgaagagattttccaaaaaaaaatccacatattccataggattttcaaaacaaatttacatcaatatattcatcaacagatcagcagattcacattaatagttctattacagtg

SEQ ID NO: 33136 - DNA, 2189 bp, Oryza sativa
  unsure (1)..(2189): unsure at all n locations
nnnnnnnnnnnnnnnnnnnnnnnnnnnnnnnnnnnnnnnnnnnnnnnnnnnnnnnnnnnnnnnnnnnnnnnnnntgtagcatggtttactggcttatacgtgttactttgaaaaatgttactttttgccactctgtttttccagaaaaaatatactgttctctttttttgcaactgttaatacaagttagtacaaattaaattatatgttatatttgtaattttctaaatttttgtttatgtaagggtgtagcagcattttgagggaaaattaatgcttgactcactactacaaaatcagttttttttctggctaaaatcaactttggcaagcaggcggccagccgcctgcaacaaaaggctagagaaaattgtgattttggctggcgggcctcatccgcttgcgaaaataaaatttcgcaggtggcatcctagaaatccaccggaaaaatggatttccgctgatggcacatttaggtcaactgccagtgaagagattttccaaaaaaaaatccacatattccataggattttcaaaacaaatttacatcaatatattcatcaacagatcagcagattcacattaatagttctattacagtgaagcaaatcgattttcaaacatcaacatccaaacatcaacatgaaaacatcaatttctcacagtatccaaaagtccaaacatctacatcaacttctcacagcattttcaatatgcaaatatcaacacatacacatcggtcgccggcgaccttagaggttgctatcactgccaccgaagccacccccttggctactgctgccaccatctgggagcaggggcggatccaggattttcagtcaccggtgtcattaggtaaaacatattttattatagccttgcttgatatagttctagatccttaatccacgctggatttgaagtgtatatgttaaactataatggtttaaatttttatagtatttcataaaagattgggaacaaaataattcatcccaatattatcaacataattataaatctaaatcacatattcatgaagcttagttatctataatgtcctacacgtgttctaacattagtgaattactagtacaacatagaaatagatatcactgattgataacaattcgagcaacttaccatgtcttctaagtattaaaaaacatttttgcaaaatttaatgcatgcatgtaagcttttatctgttgcgcactatttctataccttattattctacattgttatctattaaacctaaaaagaagtaatgacacatttcaccgggttaaattattaattgtttaacaatcagaacaaagtaaagaaaccaagcaagttagttctaataatcacttagcaaaactatgagaagttgattaattaactaaaggaaaacagggtgtttgcacgtgtaatgctaacaatagcataactgttttgctttcataaaacaatgcatgtttttattacctgctaattgcatgagctgtagtgaattggtcaatctaccggtgtcagtgaactttcaccgatggtgtcattggttaaaaacaaatagtatcgtgtaagatttgcagaagggcgtcggtgttagctgacaccggtaggaacaccgtagatctgcccctgtcggggagagggaggagagggatgcgagggaatgcagggcgttgccgatctccaaccatcaccatcagtaccggatctacccctcatcgccatcgttatcgacacctcaaggctggaggcagctcgatccagagcttgcgcccctcccgtggccaaaaccgctgcccatggccctgtggcagtcgcatcgtcgtcgtagcggcctcccccgttgtcgtggcgatggatctggccacccctgtcatcacggtggcagacccggcctccctcatcatcacggcggcatatctggtcgcccccatcgtcgcggcaaaggatccggccccgagctcgtggcggccagcggccgagaagaggaggccacgccccgccgcggcggagaggtggtagaagcgatggcagctagcagcggtggtggcgacggaagccgacgacagtggtggcattggcagtgatcgcaacggtagctggtgacagtgaagaagggacgaagaagcagagaccgtgggagaagggagcgaggcggcggagagacggaggtagaagggagctgtggg

SEQ ID NO: 33137 - DNA, 6061 bp, Oryza sativa
  unsure (1)..(6061): unsure at all n locations
nnnnnnnnnnnnnnnnnnnnnnnnnnnnnnnnnnnnnnnnnnnnnnnnnnnnnnnnnntggcggacctcttaacgtggccgccagcaaaaatctgttttcactggcggtccgttgctctccagctctcattatgtttttgctggcggtttttgcgtatggccgccagtgaaaattatagggtaacgccatgaaaaatcgtattttagtagtgactggggttgactcgatggaaattggaaaataaagataagcactgatggatgtgtgttcagaaagggattagcggttcaaaattcatatggcctgcagaacagggaatatgataatgaaaaacacaagaatcttggaggatttgaatcctataaggaataatttgtatgaaggccttcgaaacaaagaatatattcttataatatctttcgtggaatgaacaattatatagagatttgggaaaaacacaagatttattcaaataatgtccctaatctagatgcaaaacagtattgaattaatgtcactatggttgtagcaggcattcactggctcatatatatgcatagcttttaaacatacctctacagcactacagagacaatattattaagacccctctgtacattgtttaacatgtgttttttgtatgtgtatatgttcatatgtactagtcctaaaatagtcaataggaactaatctattataaatagagtactgagcacacatctgaatcacgtaattttcaggtggtggaaagatctttatggaaacatggggctaagttacattagggaccatgcagtggagtcatacgtttggtccaacatggtgttctatgaggaagacttagcggtcataaggatggtatttgccaagttatttgtactagctgtcattatggatgacacatatgattgccatgccaacatcgaggaatgtcggaaattgcatgaagccatacaaaggtttaaggaaaatttactacatccaattaggagtaaatatcatgtgaaacccagcaattcattaacatgattaaaacaagaccagaaattatatgtttagaagatgtaaaaaagttcaaaacaaaatatcacatgcatgaagagaaggttgtgtgatacaaacatgcatgtgtaacacaattcaagatctagttagataactttcatttgaataatatgtaattcaaaaatagattaatgaatagtgtagaaccaaaataatgtgaagtttgagtttttttttcaaaagcctctatcaaattgaattgatttaaatcttgaaattgtatatgatcatgtggtattagtatcatgttggttcaaaacagctattagtgccagcttttgatctggcagtagggcagcgacagtgtagctcgagaggaacactgtcggttcctgaaccggcacagatacactatatgaatggcggttggcggcttagtccagcagcgatacgtggacatttgtggtattaactggaagtgatacatgacattcggcctcctggaccttcagacatcagcggtactagatcaggagatgaaaaagttgcagtgtccggatgcatggttcgtgcatgggacagacaggccctgacattttaaggcacataaattaaggagtgtttttttaaaagaactttttcatgtagttttttatatgttgcagaaaatatagggtgtttccaccattgccgtgattaattttcattgaatttacaaatcgaactggtgcagatgggatgagagtgctatctctttcctgccggactatatgaaaacgttgtacaatgaaattatgaacaacttcaaagagtttgaggatcaagtaggggtgaaaggccgctatcgggttgctcaaacaaagaaagaggtatgtaacagtaatacgccatcagctcaattttattgcatgtgtttcttcctcttctcacaatcttcaaaattagagtttgatcattgatttctgatacaatatattatgatcaataactataaagcatgttcatcaagaataaacgaaatttagtcacatatcttgttctgtgatgaccatgtaattgaagggcgtcatagtggatagctccatctatgaacaccttccggacaaaaaggggcatttgtaaaaaataatagttgagagtaaaccacaccttcggaacaaccccgaatcggcaagcagggaagcagcagcagaatttagagtatctagaaaacaatccacaagcaacggctttgaattaggaaagaaaaagctaactttcaacttcacttcactcgtgttggggaaagggggaaaaccaacgattgagtacattcgtactcaccatgccacggaaaaacaaggaagtagtaaattgaaaaagagatattcgaacgcggtctaacgcgcaacttgatacacgctatctcaaacccaaggagcaaagcagcccaatcaatcctcttttctctcatgttttatttttattttcacctccatttttttccggggcatcacatcaatggcgcctgctcgactacttagcatgggcgtatctttcacattcactattgatcaggagagggaactacatggtttgatcaacacgttttcacaagaggccactatgccagactataggatgtagccaccagacaaaccacgcgagacgtacacatgctgatttgaaaagcaaaccctaattaaacatatgcacacaatccatgtaaacattagaaaactgtctcctcctctacgttatctcattcttacatgcgtgagacccttaattagcaactattgctagctactgctatatattgcgaaactacttcatcatcgttgtgcagctctgactcttataggaattagggctcctttatgaccaatgtttacaaagaatctcatacatatgaatggtactgtctaaatgtggtccgcgtcatgaggaccctgcttaccatgttttatgacggaattgttcatcactgtgtgccagcccaacttgtaacacgaatttcaaagcatttgttattaccctgtttgatgccgtgacctttttttcttaccaataccaagaccttaagctgtcactagaatcagccgaggcagaactaaggaccttaatcgtcttagattaatgacggatatctcagtcatcacagggaatcggtcagaaaggcctagatatgttatagtgaagccaccaacatcatatgaaagtaatttaaactacctccgtcctaaaatgcaaatattttttagattggcatgtgtattaataaagtaggtgagaatgattggagaaaatgtgtgaatagttaatataagataaagtaggtgaaagagaatgttgtgattggttgagtagaggtaggtggagaaatagcatcatttcgagacaaggtattgtgctaaaaataactatattttgggactgaggtaatactaatcgatcagaataatttgtctacagaaaatgtgtataatttggttagtataattaatgaccaaagtatatgaagttgaaatgtttgaagtacatgtatgtactttgtaagtggatggagagagtaagaccactaattgataatttaaaaatttattaaacaactaaaatgataacaattctagaaaaaataaagaaaatatgtagtaattattttttttggaacaaatttacaattatgacttaaatgcattgtctaaatggaatataaatttaagatatttagattgcgacgagtacataaaacgacgagtaagtctaaatgcgttgtctaaatctaaatagagtataaatgcatatctaaaacgacgagtacattgcgactagaaaagtatctctatttgagttgtgtagtagcataacgatattgctacatagattcgcaaaaaagtgcaaatattgctatgtggttaatatcctttgcttgtctgtagtttcaaaagctgtccacctattacctgcaagaatctgaatggtcacatcagaatcataagccaaactttaaagagcagatggaattgtctacgatgactgcaggaggaccactactatgtgtatgtactacggttggccgagatgatacactaacaaaagaagcatttgagtgggcagcgagcgacactggtgccataagagcatatgcaaatatggtgctcaaaaattttggtggcaatccatcggaaaccaaaggagttttaaatgtagagctagcagtcggcaacaaaactatccctacaacattttttgtcatcgatgggaagggttcctacagcttgttgcttggaagggattggattcatgccaattgttgtattccttcaaccatgcatcaatgcttgattcagtggcaaggcgacaagattgaaatcatgccagccgacagccaattgaagatcgagagcccaagctattattttgagggcatcgtgaagggttcaaacgtctacaccaaggacacagtagatgatctcgatgacaagcaaggacagggtttcatgtcggctgatgatttggaagagattgatataggtccgggtgactgaccaaggccgacatttatcagtaagaacttatctccataatttagaaccaagttgatagagctcttaagggaattcagagattgttttgcttgggagtattatgagatgccaggactcagcagatctattgttgaacatcggctacctatcaaaccaggggttagaccacattaacaacctccgagaagatacaaggccgatatgcttgaacccgtcaaggctgagattaaacgtttatatgatgctggttttattcgtccttgtcgatatgcagagtgggtttctagtatagttcctgttatcaagaaaaatggtgaggttagggtgtgcattgatttcagagatttaaacaaagctaccccaaaggatgagtatccaatgccagtagccgatcagctggttgatgctgcttcaggacacaagatattgagtttcatggatggaaatgcaggatacaatcagattttcatggccgaagaggatatccataaaatggcttttaggtgtcctggtgcaatcggcttgtttgagtgggttgtaatgacttttggcttgaaaagtgccggagcaacatatcaaagagccatgaattatatatatcatgatctgatcggctggttggttgaagtctatattgatgatgtggttgttaagtctaaagagatagagaaccatatagccgatttgaggaaggtttttgagagaactaggaaatatggcttgaagatgaacccgacaataagaaggtggtacccaaggataaggaacgagttgtttggcattacaacaagaaggtggtacccaagattattttggaaggtgaacttgtatggaagttaattttgccgattgggactcgggatagtaaattcggacaagtggtcaacgaattgggaaggaccgttccaaatctataaggttgtatctaagggagcttacatgttgcaaggactcgatggagaagtttatggacgagcactaaatggaaaatatttgaagaaatattacccaagtgtttaggttaatgcatgatcggctgatgttgccggtacatgatagccgatgcatttgcagcgccttgagatggccgatattgttatatcgcccttagttgttttcatattgtaatcggttgtggtttgccgatgtacaatggctgatattgttatatcgcccttagttcaaattataattttatcaatgttttggacattataaaattagggggcacatatatgagaaattgcaaaattgcaaattttttagcaaaatatggagttatattgaatcggcataaaattcctagagtctattacacaaaatatcactgagacaagtagcgctggatagccgatatagctctttgcccaatttgttctacttcttcaatgaattgggcatcctgagcatcggttccagggatgacttttagggacttggtcatatcagcgacgttcttgatagccgattttagccttgccttttgttcttcgccagactatgggagatcggctagcttcttgtg

SEQ ID NO: 33138 - DNA, 35992 bp, Oryza sativa
ctgtctcatcgagatagtccttaatgtcaaaagagaacagatcggctaagacctgcaagaataatttaggaatagttagaagctaaatagatatagccgatctaagttcttgtatcaaagggaaacgtattgggatagcaagagcagctggttgttcttcttcttcaacatgatggctccctgtagccgatggggtttggttacttggtgattgttgtacaggggaaggaggaggaggaggaggaggctgcaaaaagagataagtgttaacataagattggctatgatcggctaatgagaaattaagaacatcttactagttgagccagtttgagagttgttgttggcgatttcttctacacagcgattgtcacgccctgaaaatcgcctaatttaatagttcattctttaatgcatttttagaaattattttaaaagtttacaagttgaactctaataatctaggaaaaatcgcaacataaaactgagttagatgaaatttcattaaatactttgcttgtttatctgtttcctggattttttctgggaattatttgagcaagggaagtatttttaatcaacgaaatagcatttcacgaattattcaaataaggaaaagtattaaaacctttctctaggccgtgggtcattttcggcccacaaagcctctctcgggctgccagccatgccagcctgctgctccattcctttcttttcttttcttttctttttccttttctctgaaagtctacaatgactccctcggcactattcttcttcaacctcaggccagccgactgagcccgagctgctgccgcctcccctttgaatccacctccatcagttgctcctgagtccaattggatgaggggaatttatctcctcgttgtcctctttcatttccctcaaaaagccggagtttaattcctcgtatttcaactaaatcaaactcgtttcgagtttatctctccaaactaaccatcggattttccggtttcgattcctttcgtttagagttcgatctctttaatccgagcctataaatagcatcccctagtcgtcctcttccgtttgcctcaagtccaagctgcagccgtcgcccgtagcgccgccgccatgtgagccctagcgtcaccgtcgccgtcgctgcttaaaccgttttgcgccctcgctgtggtcgttgccaccgccttccgtcaccaccgtcgggttcaccagtgttaacagtgaaatttggtaagcccggaatagtcatcggcttagagtcagcatcggctttgaagtcctgagattagccgatgagagttgtcaagtcgtcagttgtcggattcttgctatattcggttaaggaaattgatctactaaaggaagcttatcgagaagagaccgagtttaaagagaatgtggcatggcaagttatctattaattaggaatagtctgttagtttccttttatctttaggaaagtgtgtttagtgtcctataaggactttatctttttcttttatctttaggaaagtttctttcttctccgaaaaggacttgtatcaacccatgggtataaatatgaacacccggggtctatgtaatctatcgctacgatcaatacaattcggcgcatcgccaccttttaccttttctactttattttatcgtctggcgggacttggcacctgacgcggggctgcatcggtgttcgatctccggctaaggggtaagtccaatgttcctactgtccaggcaattgtatcgtttacgtcggcatcgtttaaggcagcatcagtacattcgacctcttggattgctctggtttggatgatatatttgcctacctatttatcatatgtctttgttaatctagtcttagcatatcaatttagctctatcggctgcttctcgttttagggtttatgccggtatcggctaaatcgtgttgctagattagattagcttagacatctaccaccctgaaaactcagtcaacggcttgattgtctagatattatgtttcttttcatatttagtgctgcatcagttaattttgatctactatgtcgtgcttagaaccataatctccagcctgcttctttattgccaataagggtttcatcggggtttcagccggtgagttatctggacgttgcatcggctcataaggattgcacatacatataagttggatttagccgatgacaacaaaggtttcattgtttaatctaatcttgtggatttcatgacatcggacctccagccgatgtgtgctttaaccttcggatcgatgcttatttatcatatcattatttgccgattggtttatactggattatattgttattttattacatcatcatcagccgattgccttcatatcattatctacattggacatatagccgattgcttaaaccctatcgctatcggctggtatcggcatcggctattatcggctatcggctggaactactccatcggcttgtcagccgatcggctgttttatctgctgtttacatatcttgtcagttgcaggatcaaactgactggcacacccgcatctcatcaatctttggacttgcactggagttaagcagatctcccaggccagtgtgtatttttcgcatcaacagccaggtggaggagcatcccgtccgccccttcgccgctgctgcatctcgccagagagccgtcgccgtcgtcgagccgagccgtgccgccgtcggagttcatcgtctgtcatcgttcgtcgtagttctttgcttcggtgagttcgtgtcgtcatcctcttcatgttggtgtcttcggaaagcccaaccgagctctgtagcgctggtaaccttgtggtccaggccatggccggcgatgatgtcgtgatgacaccataaatcttttatttaaatcgtaatattttttttgtattagatgaaaatctgattaaactttggaaattcataactaaatcatcgtaagtcggattccagtggttcaagttgctaaattcatctaaaatcgagatctacatgttaaaaatatccacatgtactgtttatgcttgtttttgtactgttttgttgataccggaattgggaacttgtctttcatcgtgcgatcattgagggcacggtagtcgacacaaaagcgccaactgttgtcgtgctacgaggaggacaggggcagagaaggtggacgagctcggacgaatgatgccttgggcgagcatgtctgcacactgtcgcgctagctcatccttctggtgttgggcatagcggtatggctggactgccatggggcgggtgtccggtagcagatggatgtggtggtcgcgtgatcgcggcggtggcagcccgtgcggggcagcgaagagagtgctaaagccctccctagctcatcagctaatgtatcgggcccgaaacacgtgaaagcgaggccaccctggtcgccggaggggccgccaatcccccgccaggtgacgggcagcgaggcgcgtgtgagtgtgacgctgagttgcgcatagtcccaatggatgggacctagaatcttggagccattggacgcccagaacaacgtcaaacgtatcgaggtggatggcgaagaagtcggagcagaacgtcgtgtcgccattgttgaacgggacgtcacgcgcgacgcccccacaatccaggcggtcgccattggcaacgcggatgtgaaggccatgtcgggggtcaaggacgacgccggtgcatacggcggcggtggagttgatgaagttgtgcatggagccggagtcgagcagcacgacaaggattaatctgattcttgttgatctaaaacatccaaagtacatcctttaaatagcaaacttacttctaacaacttgctaacaaacttaactaatattaagaaaaagataaaaccaaattcctaagcaattgccgcacttgattctcccgtcgcgccaggcctccttctctggaactgaatcccccacatgacatgggtactctacgatattttgctctggatgatttaatggccgaaatttaaatttcttaactgaaatcgaacccctacgccaaaccagatcatcagtgacgagcctaaactgtcatctgtttaagaagagagttgagatgacggtattcgaaggccgcctcctagagtatgtcgtctcttctctccaaccagctgaagtgcttcagtacggctgtctcgtcaaactgaaatggatcgaccatcgctcaataaaaggaggagcaaacaagcaatgaaggaaagttaattcgttcagtaagaagctaggaaggaagaaagaaatgtagtccagtttccagagttgatagatgttggtcaagccaatccacggagacgagcacttgctacacatcagcgaatgtagtttgttggattttggcgatgagatggttgattaaccctgcatttgcttccacatttgctttgatctgcattcctaaccaccggaaacaagcatttttttttgaacgactcgcaccatacagcgcaaagtttatattgataaagcatgaaaaaaatacaagattataaccctgggaggtcgtaacccaaataatgatatctcgtaatctagacatcatgtctaaagtaccagatactactctaatatcatcgtcataacatagagtaattgcataagcaaatattacacccacaccaaagcatctcccagataagctagtagtataatcagtataacatgaacataatatagagttggcattcatatacttagaaagtattccaataccataaatgtataaagaagagtattgtaataataatacaaagcttacaaaagagaagagaagagctactagagccatacccgaacttttccgaaggcttccggactccgatttctactctattcctattccactagcttaagaatactaaactaaacttgagagaatatgagaaagctttacttgaggtgtgtgagtgaagggaggatgagagctccttttatagcctcccaattacagttgtgatggttggaaaggtcggtaatacccactaaccgtcattggggagccatctcaaccgtccaagagaaacctggatcgaatggcgctgcagggggttcggccgaaccatgggctgggcccacctggctcaaacttggcaggtggcctcctcttctgttgctcactgcagacttgtgaattttggcccaatttatcgtgtcaattctatgttcttggcccattcctacataagtctgattctcgacatcgaccgattgatttatcgtctgattcgatgtcgattctcctctactttatggttattctctgcaaaagggttagtgaaccaaatactagtggaatattattattctaacatgtatatgtattgcaagcctaactagttctcctctattttggtaatattgacggtcgaaactaatcgctaacgaccatcaacaggtactcctctgtatttaaccccgttgtatggtcatgacgggctgtcgtaacgaactcggcagtcaagggtggcttctcgaagtactaggagggcatcgaaaagagggtattagctagttaatcgtataactagaatatatgtatactagaagtatatgaatagattctcttttctattttctttccacttagcttagatattttagtttgagaatgagtagctccctgcttgtgtgtcactctacccttgatttatcttaacccctgcttatactgtgattattacaagtaacatataaattattagtacggttctctctactatgatcttcccacgggattaaacaaatacgatacccttagaatactctcgggtgaaatgctacaatggtatatccgtgcgcttgcgaatgaactctgtaaccataatataccaagagtatttatgcgccattgctgggaattatatttctagtaatgtcgttaagaaataccaacagctaggccaacaatggagctacaaccgggatcacctaaaacactatcctaacaaccgacactaaccgcactctatccacatctttgggattcaaggagagagggtgagaaagaatgatggaatcgctctccctcctaggccctccgacgtggtcaacttgcataagctagagcttcgacacaagaggactggaatctacagcgagcttgcaccgtttgtcagggaggtttcgtcaagaggtgtgcctagacaatgtctccagggagaggagcggcgaaagcaccgccgtcgtcgtccgtcgaggtctcagggagaccaggactaggttttcactcgacaggccccctagaggagatgggacagcatggcaaggccctcaagagggaaagggacgctcgagaacgccctcgttgccagctcggccaagtctgggctgggttttcacccgctgccgaccacctgtctatccacaactgatgcaccatgctccaccgctgtcaatccttcgtcagcgcatggtcaccgctgcatcggcaccatccgccggctagcctccgcgtgccgccacacggccaccctcgtcgcactgtgccagcctccaccgccagtcgcgtgtccttgcgccgcgctagcctccgccggccaccgatccaggaacacccggcaccggcctccgtgccggtgccacccgcgccaaccttggtagccgccggcaccttcatcagcttgagcacattcgccgtcatcatcgttcacccacaccacaccgtcgttcagccgtcgctgccactcgctgtccagccgtcgacctcctgccgaagccacactgccgcgccgtggccagccagatccagcgcggagttgccggatccacccacgggacggctagatccgggcgtggccgttccggatccgtagcatccaccatcgccaccaaatgccatcaccgtccccgctaccgtctcatccctactgctcgcagccacttgacgccacgcgccacggagacgtggccatcgccatcatacgtcgtcgctaaccccaccgccattggccacctccactgctgccgccagccgcctcctccgtcccaccaccttccgtcgatcggaactgccgccgccctctcgctagatccagacggtgcggcgcggatttggccggaccgccgccaccccgagtggctcccctagccgcccaagcacgaggtgggcgaagccccgccgccgccgtccttgcggccgcgtggcgttgccggcggccactcgcgcggtggcgaggcgaaggaggagtgggggggggggaggaggggagcggcgaggttttcgcctccggtgcaacccatggggaaggcgacgcgagagtcaacaatgtggggaaacaagcattaggtatctatctctggtatttttaatgaagatgatatgacagatagaatgaatggtttgtaaccgaccgctaaggcactaacaagtgtgtggatcactcacgtatgcgtatgagtgcgtcactcgttaaaactaaactgagaacgctctcggtttagatttaccttaattataatatactcaatatatctcaagtggtgttcttttctcctgaagatgaagattatgttttttatgcaaaacaatgtggtattaacgtatgattgattaagttttaattattataaacttgaaaaatagattaatatgatatttaagagtaactttcatatagaaagttttcgcacgaaacatactgttaagcaatttaaaaaacatgccacgaaaatttttatcttcgtctaattagttggagaaatgaagggggcctcagttggtcgtggtcgcaataagaacagccaacggcgagcacggcacgcaaggaaatcagttggtggaggaatgggcgagacggcgagtgctcccaaggaaaaggatagggaaaaaaaatcagcggtctctgtctcgtgtgcctcgcctcacggcctcacctcgttaacatattttaaaagagataaagaaagtaagaaaaaaagtagcgggctataaatctttagccagctgcaatacagacttcaagatataatatgtgtatgataggtagaatcaggtattaatagtatagtaagcaactattatatgaattgactattatattagctatagatgatttagagctaatagttggttatactactattaaactttttgctcttagtacctgcgcgcccatctctattgatgcttttttttaattattattttttcccctcttgtttatgatggcagcaagaggcacaacagctataaataaatgagagagacagaccgggggcacagccggggggagctgctgaggactgaggtaggggaaagaagagaagagaagcaagcaacaccaacagcaacacgcaaggagtggaggactcttcaaggtatcccaaccaaagatattttgctctgccactatcatctcctaccattaatcccactcccacatccatcctcttgttaattgacttgttcatttttgcaagctgtaggtctggagagtggagaggaagaggaatcctcctcagtcctcaccttcagatttcagaacacaggcaatcggccctagctgcaatccaacaagatgggcatgcctctgctgctgctgctgctgatcctcgtcgctgctggcccccaggtccttttctcatcacctttacttgtttctttctttctttctgcgatctagccgtctcaaatctatccatacatttcgaccagcaattcacctttttactgtacaaaaccaacagctaacactaagatccaatcaagtatcttcgattctttactggtggaatccaattgaaatttcttcttggggcaggcagattttctgccgcagatatgctccatccattactatttgcgctagttctctccttagtctgaggatggattactgaatagaaaaacgcacttgcgtgcattggaggcatctctacagccctacagtggacatctgattattgaaatggactgtagtggtgtcatagatttgcttatatcaaggagaaagatagatctgagttaagcatacttagggtcagggagacaaagttgctcatgaccagaaataggggaattctgatcaaaacagaaatatggaaagtcagttacaaaagactaatccttcacaaaataggaagctccttcaggcttccagtgttataattggtgtacctcattttcacatcttatgtgtgaggaattgtctcatgattaatgaattttccctttccgacagttcactttatttaagagtaaatttcatagaactgcaattatttgatcaaaaatatcactttgctacaactttagtcagccatttcacaaagctacaactttagcaaatgattttatcaataaactacaactttaacccaccacgtgtgtctaacatgtgggctcgatgtgtaactgtgtgagttttacataaatgcctgactaatgggtctagattcgtcaagtgtataaagctgcagttttatgataacaccgtgtactattgttgcagttttctgaaatgtctgactaaagttgtagtaaaccgatagtttcgatagaatagttgcagttctctgaaatttactttatttaatgaatttccctttccctcacaaaaataaaagaatacaagcacacaaaagcttcatgtttcctctacacaaaacaaaacagagaaggaactgtaccttgaattatgttgtgagctgaatcacatctgtatgtacacatgcacaggcaggcagagctgcaaagccaatcccaaatctccagctcatgaccaaggagggcggcagttcaagaatcatccaggttatgcctttctatttcaattcgttcttctcaccttattgtattttcttatttactcatgacatatcattcaatggtattttgttgtcacaggacgacatcataaaggcaatcaacaagcatcccaatgctggctggacggctgcacggaatccatactttgcaaactatactgtaaataacaacaccctcctgttgttgttttcttttttttttttgcggggacaccttcctgttgttgttagtattgcatacatcaaaacatttatctcatgcttgttcggtggcctcaataatcctcctgtacagactgcgcaattcaaacatatccttggagtgaagccaacaccgcatagtgtgctaaatgatgtccctgtcaaaacttatccaagatcgctgatgcttccaaaggagtttgatgccaggtctgcatggtcacagtgtaacacaattgggaccatacttggtaagttcaattagtacctcaatgtttgacctgtaattagttctaatgaatacactaaccattcttcatttcctcaataattttccaccaaaccatgggaaatgttgattttcatgcgcagatcaggtaaactacgcgcaccaccataaattgttaatcccatgagggtttagaatgcaagatataataggtattatgtcttggttgacaatgacagggtcactgtggctcgtgttgggcatttggtgctgtggagtgtctccaggatcgtttctgcattcatttcaacatggtcagtgaatatgaatgacaagtccgttctcatggccaaggcttctaacttaatttattgttcctttgctcacatagccaagctactgttttttattccttgtagaacatttcgctatctgtcaatgacctagtggcatgctgcggtttcatgtgcggcgatggttgtgatggaggctatcctatcatggcatggcgctactttgttcggaatggtgttgttaccgatgaggtattgtccattttctacatgctatgacatgaatgtttctgcatgatccagcagtaatcctatatgtgaatatttttttcccggctcctgcaacattagttcagcttgatatactcagaaaatgcacattttccattgttttgcagtgcgatccatactttgatcaggtcggttgtaagcatccaggatgcgaacctgcttatcctacgccagtgtgcgagaagaaatgcaaggtgcagaaccaagtttggctggaaaagaagcatttcagtgtcaatgcatacagagtaaattctgatccacatgacataatggcagaggtctaccaaaatggccctgtagaagttgctttcaccgtttatgaggtaccattgactttctattttttttccatgctctttcaccaaattgttgattgttggttagcagaaatcaaaatggactgtaggctgcagttgctgctttgtcactttcaaataaaatatgacgtgcagaatataaagcttcttaaaaagagctttacgtatagagataaggcttaggaagaacaagacggaagaagaggggtgggggatgaaaataacccaaacaggaaagtagttcttagatattttctggggcctggagtatttatctttttctggtgcactacatgagaagatgtgcacactagtaatctttcaaacgttggagtttggttcaattggctacacatctaattttacgcatgttttgtgacttcatttataacattctgaggtctatcagaaaagagtatgatttctctttgatgcatagcattgttgatttgatttaatgctccaacattgtgaaggattttgcacactacaaatcaggagtatacaagcacatcacaggtggcatgatgggtggtcatgctgtcaagttgattggatggggaaccacggatgctggcgaggattactgggtacttgtctattccccatattacgttatctattaattaaacctatatttaagcactaattttctttctttcatccttttgtgtgttacagctgcttgcaaaccagtggaacagaggatggggcgatgtaagtccttggcaaatatataagttcaataagtgaaatgttgcataatttgtattttttgagctattaataatgtttggtcggtgatactggtaggatgggtacttcaagatcataaggggcacaaacgaatgtggcatcgaagaagatgttgttgctggtatgccctcgacgaagaacatggtgaggaactatgatagcgccttcggagtcggaacggccatagtttgactttaatcaatgttaatggcctcaaatacggttgggatcatgtaaatttgtcctgggtgatttctggattttgcacacacgggcaggcttctcgagactgatcggagtttaggctacttgtccagaaacacattggaataatatctgaataatagatgtattctctctctctctctctctctctctctctctctctctctacgtccggttaactacgggatgtgacgtagaggtgttagggaggagcgcacgttaatctcgctgtaatccaagttgagacttgaagaattaatgtgtatgctgtaagtcaaatgatatgcgatctgtgcgctgcttactagtatcccaaaagtatggattttgttcaatcagtctacagcttgacacaattgcagcagcaagcactcgcttggacgcatctagctccaaattcctgcaaaacactggatatcttggttcaatgggaaccgagaagtcggacaatgacagcaggcatcgatttcaggattccccattcaaggtaccagaatgcagatacagtaaataaaaacgatgatacattcatatggacagaatcacagaatacaaacagcgcagagcaatcggtacaatcgacaacagatcgaatggcacactgcctttttcctatcagtaagagttagctcagcgactccgagacgcagccgccatggccgtctccatggcattcttgaggagcaacatttccttggcattcttgaggagcaacataaacgatgatacattcataatcggtacaatcggcaacagatcgaatggcacactgcctttttcctattagtaagagcttagctcagcgactccgagacgcagccgccatcgccgtctccatggcattcttgaggagcaacatcatttccttggcattcttgatggctttcctgaggaggagcaacagcaacatcccgcggcggccagtgctccaccagcctctccacgggcactttgacgacatcgcggcgaacaccgatatctgagacatatcgccccacgcagtacatgccgctcgtcacaaccaccagcccaccagcgctggtcgtcaggaaccggagcggcgacgaggccaccgcgctgaaggcagccgtgagggaggccagctgcccgctgcgccccacgctgaaagcggtctccaccagcagccccgtcttgcagtatatcgcaaagtcctcgcaattgttcttgaacaggctatacgtcccgaacccgctgttcaggaggtgctgggcacggtggatcacgatgtcggcggggtccgaggctgccagggtgcacgttcctcctcgcgctttcacgaggaagaaagcgggggacaccgcgtagtcgaacaggtacggattgcccccatccaagaagcaatcgaggcacgacattatgaccccctgctgcttaatcaggtgaccacatttctcgcagggaggaccctcctccgttgctggagatgagctgaaaaggaacatgtccaagaatgttcctgtcccaatttcatgtccagttgctcttgtaaaatgaataaccatggcatcaccaatatatatccctgaaaatgaagttcaatttcgggaacaggtcagagacatggtcttagcgagtatccttgctccttagcaaataagtcaacaggaaaacatgaactgactgtataatgtggggttaacggacatggagcacataaatgttgcgtggcatgccaatcaagtaatgagtgttatgttttccataatagatggcaaatgacatcgccgacggtatattgtgcatatgtcggttaccagcatgtaggagaggctttattttcgggaatgcgcaaaatgattgcacgtcaatatattagaataggagaggctttatttggaaaggggatggccattgtgatggtggattggtgggcattgtttagttaattgtctaaggtttgtacaccaaaaaaaagggcaggttgggcataaaatacctacctgtgttcgggagagctctaaatttgagatggatttatcttaaatggaaagataagcagaatccttcgattgagatgcaggttccatgcgactcaacagacgagacttctttttagtgcctccagacttatttctttggacaatggtaaaaacaagaaaagaatggaaatccaggtggccaaacaaccagactcctaaagatatcgcccaaaattgtattcttgagtgctcagggaaaatggtaccgatttccttgagctgactggtaatccacatggcttaaatcggtaagacacagcggacagcatcaacaggttatggacaaatgtcagccaggttcgaccatttccaggttaatcattttgcatcaggcagcatcaacagccagcataggaggtgattgttcactggagccttgagcaggcacagttgttgacttatgacttggaaaagggatactaactgaaaataaatacaagctttgttttttccatgaacaaattactactacttctccatctccagatcagacacattgtatttcacatggatgaagagtgactaggtttttggggatgaagaagcatagcaagcatcggaggaggaggaagaagaagaagaagaagaatcaccgtggtgcgcatagaggtaggcagttctccaagagtagatgtgatccccggcggcgaggtccagccgatctacccggttggacagcacgcccaccatatcgttgggtgtcgtgctcctcctcctcctccgccaaatcagaaccgaagaagaaatcgatcccccttcctcccttccctcaaaccgaagaaatctaagagtcacctgggcatggacatcctcattgccaccttcccctaccctttccctggatggatggctgggtgggctggatgcttgcttagcggcgaaggaaggacgcctcctccccttcccggatgaattggggtggatgccgccgaaggagacgggaaaattactccacttcttttttttttttttgagagagagagagagagacgagacggctgggaagggatgggccgcaccttgggcccaagcccaacgtacttcatctatcttctcttctaggaataagttcatctgaggtcccttagcttgtcaacgaatccgattttcgtccttcaaccgaaaaactagatacggcgggtccctcaactgtcaaaaccggtgcaatataggtcctatggcggtttgaacggcagttttcgcttacgtgacgcttacgtggctaatttgactcggacttcatatgatgtggcagtgacgtggcgcttacgtggcaatttgatttgaaaaataataaaattgtgggcccgcatgtcaattacaccaaaaaaaataatttcaaaatggtgggggccacgtgggtcccacatgtcattctcacccctcctctctcctcaactcccctctattcatctctctcccctctctgtcctctctccaggtgtgagtgatgaggggtagcgcgtggcggccgagcaaggagggaagcggcataaatctaaggccagttacattaggtgctaacaaaatgtaccatatgcacatttcctttatacgatatttttggctcgctcaatcctagccagacactagagaacttgcacgcgtagcggccacttgcggatggctgagtgtacatgcaaaccacgacgacgcaaagctgcgccaccgatgccactatggccagtactccctccgtcccctccgccccctccaaaaaaaaatcaatcatgggtttgaacctaaattggacacagacacacatgtatccaggttcaaacctaagattgtttttttttcggacagagggggtaagtgttaacatgcctaggcactgcttcccacctccttcacatccaccaaagaccaaaccaccacccgaaaatgcgttctgcccagttgcgccacgacacaacccgcctcctcgtaggggtgaaaacgatctggaaatttccgagattttcggctgccgttttcagtttgcatcgactgtttcagtcggtatcggtaaccgacggtggtggaaatggaaacgataatatcttccgaaaatggtagtggaaataggatggaggttttcccgaccggtttgtcggtaactgtatttgtacggtagttttcgtcaaaattctgaaaaaaaaatctgaaagttccccagtggctcagccggccaaacccatcggaagcccataaatgaagaaagcctggtacgcttgcagctcataaaaaaggggaagtgaccaagaaaatgttgctaaccctatgatgtggcatgtggattttgctgaactttggtctcctcagcttatcgatgctaaagtactgttgaactttgtttatattgtttatcaaacttattatcatatcgttaatcatcatataatgatgttatgtggagtgtgatgatgtaagaataaagttaaaaggtcatcttcgcgcatagttaaatgtgtgctatagagattcctaatgggtacgtgcgtgctagatggcacagcccctctcggcctctcctcctagtacatcaataaaacttttaacgatttggaaaattttcaacttagatttaaaaagtttcaaattaaaactttcaacttagatttgaaaacttaacaagattttttgaaaatttttaatccagatttgaaaactttcaaagtcaagatttaaaaacttttatatcggattttgaaaacttttaactcaaatatgaaaactttcatctcaaaattcaaaacttttaactaaaattttaaaaacttttgactcaaaattcgagttgaatcaggcgcattcaggtgcacatgatttaaaaaattcacaaaaaaataaaaaaaaatcgtgaaaaaaaatcatgcacgcgtgattaagaaaaaacacgaaaaaaataatgcaaaatctcgcgtgggcatggattaactaacttgtgcaagatagaaatatagaatcatgcaacagacctttcacacggtagaagtagcaggtttcattgggtgtatgcctcacgtggaagtgtgcgccgccagcgtgtatgggtgaattagttttctcggtgttctatgccactcttcgctgattccgatatgatttgttgacttccaaccaatatcagtatattccgtttcgatggtcccgtttctgatataccaatattaccaatttcgttaccgttttcgggtctaacgttcccattccgttttcacgaaaaaaaagaaaatgaaaatggtatagtgtttttccgacggttttcatccaactgaggctcctcatcgctgctcctgtcctgtcggagaaaattgacgttgtgccatcttcaaaaccaggtttagctcaaatgccatgctggtagtgggtttctttaaaatgccactttcaaccgaaggttacatgccagaatgctacccttcatccacatgccgctgagcgcggttcactgcctgccgccgagtgcgtagttcaccgactgccgccgccaccgacgagcgcgtggatctggtgccaccacctgcttcccagccggcgccgccacctcctgtcccacgattccctcctcgctgctggtgacgtcttgagcagcgacggcggcatgatgtccacgatcaacaccttcccaccaccgagggccaccacgcatgccttcccgccgccgacggtcatctccgccgcgcccttgaggcgctcggactcagctaccatcctctaccgagcggtgccccagtcgtaggcggtgagcgcgccacgctcctcatccaaaacgtagatggtctcgccgttgtccaggggcgacgccgccgcggggcccttccaaccggcgagcatgcggggcggcatgtccttccaacgatcggcacggaggtcgaacactaagcgctccttagcgttgcggctgcggaggttgaccatgcagaccttgccgccggagcagacggcctccgcggctgaaccgcccgtcgcgcagcggcaggatcggctcccacgcggcggtgggcggcgaggccgcggggtcccacaacgcgccagagcgggtgacggcagggtcgtagcctgcgcggacgcccccagtgacaaacacgcgaccgcgcgccgcgccggccgcagaccagctatccctgcgccgctggtcaccgacggaggtggaagaagggtagaaataagggtatttttgtctgttcgggtattatagtaagtaggcttcaggtgaaaccactcctatacggcatttgagcgaaacccgtttttggagttagcaatatgtaaattttctcgtcctgtcgccgcctttgcccctgccggctgccgcgccgggcaaaacaagatcgtcaagatctcctcgcggtctgctcctgctcagccttcctcgccgcgcttccaaaccctaatcctcctctaatatctctgcctcgccctcacaggtgccgccgccgattcatcgccgtcaccgatgccgcgcatctccgcattcagccgccgggcacatttctcgcgccgccccccatccccatgatccaaccgccatcgccaggaacatctcttccccgttgccgatctgatccgtccgcccccgacgtccatcgctggatttcctaaggtactccactgtttactactgttcatataggaatccgaatattgtttgtagtattgccttaagcagtgcacccgaatctgttgggaaatatcgtctgtcatcttttctgctatttacttgtgaatcggtgggattttcattgcagcaggacactatctactttaatccaccttttatacttgcatgtgtgcacatgaacataatacatgcacttcggtgtaaagatccacgtggtctcaattgagtattcaacttgaaattggtgaacggattaatctcagtggcttggtgcttgtctgttgaagctaactttgtgttaggttttcttttggtgatgaggagagcccattcttttctcttgctaaacaggccatcaaatactattttcttcaggactcattttttctcaatcactacatatcttttcttcttttgcagttcttgaaagttggagtggcaacttgaggcagtgattactttttatttttcagcccagacggaaaaaccaacctaagctaacaaggaagacgagagggccagaggggagggagggattcctcttccttgctgccgccatcgaaaccgctcttcttctctgctgcggggtggggatggaggagggcctcgcacgccggctcttggtacaccaacaatggtacttgatccactctcctccgctactgcaatctctactactccctccgtttcacaatgtaagacttcctagcattgctcacattcatatagatgttaatgaatctagacacacatatatatctagattcattaacatctatgtgaatgtgggcaatgttaaaaagtcttacattgtgaaacggagggagtagttcaatccgatcgatggattctcccactttggggcaggggggtgtggggttggaggaggaggcttcttactagttcaatccaatcgatggattctcccacttttggggaggggggagaagttagaggagggatttcttgcttacgagatttggggaattaacggggtccggttcggtggtggtgattactcaattccgcggcctagcctagcttcttggagtgcacttgtgttgtttgttgtggaggagtgagtgttgacttgttcgattgtgtgcgcttttcaaaatgcaaaagaggatgctgcatatcttcggagttttagttttaaacgatctggagtgtaaatagtctagtagcttcaaactgttgataacttgatatatgttggcggttgatgttttgcaggttgttgtgaataattttcttgatagtcatccaaatatgcgtgcttgaattgtttggttggcattttggatgatttcaccagtcattacggctctcttgcttcaaatttagttgctaagattgtgggaactatttttatattgttagaaaaatgcaggaaccgcttgccattgttatacatggtttcatataaattatgcactttcggaatagttttttattagaaggaatgaattaccggcaaccttatcatatggacatggatcaattttattgtgctatcaggcatgatgacattttaggtactgcttattagattaatatcattcttttttgcccaaacacgtagtaggctgacatgattgatgaaactggatcatttgctatttgttatgcaaatgcaataactattttagctgtcagaccattctggaaacacatgagctgtttagttttactgggagttgaaccattcattcctagctgactccattatcttcttgctctgcagtttccaacattaattcataaaagcatgtaatttgttgaaaactttcagggatctcaaccattttcttctttttaaaattttggttcgacaatttaccactttagctctgtctcctaaattcgttactccatgttagccaggaaactggatgaggaacttgatggttggctgagggctgctggtctaaccaagtcccctgatgtgagtgcagtaattgcgccgtaagatggtatttaactattcatatgatggtgaatttcttctgttctattttaacaattgtttcttgccattacagccatgctggctattcatactcagggcggtgtgcggcatatgcttttggcaacattgatccaactaacatgtatgttatttacacattactgttactctctcaaaatttcagatcttctaatagtaaatcactgtcttgctgtactggtaataccttgacttgaatgctttcatgtaaaagtacctcggatgtaccattttatcaacctgtacttttatctctcattggtataattggtaaagtgatctttatgagtgatgcatgcatttttatttattttattttgaaagttggacatgggttctagcattaactaaagaactagatggtcacatgtattaatcctagagtttaaacccgggtgagtgaggatgttaaacacctacctcaccaccaaagctataggccatttcctgacaacctcagtttccaaacatcccatgtctattcaaaccgaacacaccaagataatcataaaacattcacttttgttgcataaatatatgatatgcttttgtcattctaaacactgcaatagttctgctacttttgaattttgaatatgtatttttaagaatagttttggtagattttttacttgtctccttaacaatgatgaaaagagagatgcaaaatcaaactctgaaattcagaatcagcttcagcttttaagaatgtccaaaaaatactacttacattattatagctgattactttattctaattttcactttgcccatctaatatgttttcctgtatgtgatccagttctcgggtcttcctgttaggcccctcacatcactactatactccaaaatgcgcattaacaagagctactatttatagcaccccaattggggatttgccagtagaccatgaaggtatgctgttactgacttgaatattttacattcatattacatgccatgcaatctaattaccgtctttacctaagatttctcttggataataggccagaacaccaacattagtattgcccttaacctgacccaatatgccttccatgcatgattagcactttagcagtactaatatgattttacgacataattatttttagacatccatccgtattaattatttctgttttgaactttctatattttcagacagagccatttgtgcttaagattccccttttaaagtagtggtggtaataatctgccaccccacctgctatcgttgctactttttcttgagttgcctgaaaattttcaatatcacacattagtccaatataagtgaattgccacaggcacactgtacagtatatgagttattatattattcaatgtgtttaaacattgtcaagtgctcctcgttgcaaacaatgtgtaactggtttgatgcaaaaaccacacatctatatactcactccgtcctaaaatatagcaaaatactaaagtagtactcgattagacaccacctggtactacgaatgtggacagacccctatcaagattcatagtactaggtggtgtctaatcaagtattaggttgctatattttaggtcggatggagtatctttctctcagtagcagcatggcctttagttacattgatcaaagcaaacatcatggtcataaggcccttgcaagggagaccagcataagccataaacaaaataagcaagtccagaacaaaccatttagccttcaaacctcactaaacaaaactctcaggctatcagttaaagcgctgagcatgcccatacccctcctagcacaataactgatagtaggggtgtcacatccctcactaaacctgggctttacccaggtttagtgagaatccgctggctcagattattcgatgatccaacgcgctaagggaattcatgttctctctttgcaggttcttacccacgatgtatcaacaaatctcttcctgttgtgcttaaacaatctgcttgtattttgtttgaatttcacccatctatcaagaataacaaaagcaaattagtataagtctggtctgaggggaagagggggccatgttgcacactaggccttctctccaaggtggttacaaaggcaaagttctatgtgttaaggatggagggctttggtatgggacggtgtatagcatgccagatagggtagctcagggtctcagttaatgtgagaaaatggatgtgtgataattagaggaaggatcagaaggtcttgatagtatcaaggagaaccaaaaaaatcaatggtatatatctgtatagaagatctgggtggtaggtagccagttctctcttaacataaacgatgcatttgaccagaaaaggcgttaagatttctcaacagccaactcacatgatttacactttatagaactgcaccctactcagcaaatatagcaacatgtttcagtacattctgatattccaagagttctaaaagaaacatctgagacaccttcctctaaagactgggcaactgaaacatctgggtcatcacaaaattagacgagattggaaaaaaaaaattctgaaaggcacctctccaggtcaaatgccttacaaaaggaaatattttcggatcttttgcaaagttacctacttaaaccaatgtttaaatctctaaaccttattgagaccctcctgcacccactaatcaacttacccctttttctgtaaatgggttgagaccaaaatgaagccatgtatgggcagttgctctctagatatcttgacgatccgaagaacttcttttctatctcctcagatttctgccactggggaacccggtaaatacttaatttctactgtcagctttttcatgctctgccaacttgcttgttttcctatggtaatctttagtgtgagaaaactttaattgtcctgtgtcacatttgtcatctactagttctgcagaactaattaatgaagtttgcagtgtttggcctattcgaggctaaagatctggccatgtagaaaagcagaagagttggcatgcctggtttttcattaaatttgctagccaatttagttaaaatgagctcatgatgcaaaatccacaatcttagagttctcttgccgaatatttttttagtaggcctatagattgtccaaattcttagtctttctacctgtactctttccagaaggtagatagtatgccataatagcagttttagctatgactctcttttcagatcaactcatcatcacacttacaaatatggttctttccaagtttaaatttcagtacaaaatcttaattttgtatatgcaaatttgaacttcagtagatgtcaaaatttgctctcaataacgaaaagggtaccatcatatgagcagcatttgtctatcaattgaacccctcatagcaagagtactctagatattgttgtgcagtatcttgtatttccacttagcataaatgcaacttatcatgtggaataacatttaggctcgaataatcgatataggcatcagatggaatttgagaacccatcagatccaattggcagatcctagaaccatctcaattttgaaagaaaaaaacaactccacctggcacatgttgtaataacactatatcgcaaaccccaatctcgaatccatctctggtggatggtgacagcaccttgcttccctgctaaattcatctatagaaacaccggatgctgtagatgtatcctggtttacttctgccacatggcttagcctgatcatgttggggtccaccatctgcccaacgatggtgatcaccagtgtgcaagcgtttggagttgtaggagtgtgaagatggggggaggtcgctgtgggctgatgttgtttgcggttcagggacgacacaatttatttgcataagattttggtgggaagtaaaaagggagctaatttgctccaggctttgtttcacccggatctgctttgatcgatagtgtagaaaacgtgattgaacagcccagatcagttcatttcataattggacaccaaagaacgcttgcccatgatacatcaccaggctaagttgtagttgttacttcgatcttataggatttgcatatgattatgctcacctgcatcgtctcatcaggtttagttacacatactacgacaagagccatggtgctatacataaatcgatagaggccttggaccacatgggcatggagataatagagactggtaatccagatgcattcaagcagtacttgcaagagtatgaaaataccatatgtgggcgccaccccatcagcgttttcctcagtgtaagcgttgtggcgatctaactagtgttatctcttcatttctacttctataacttcgtcctctttatgcaatataatgttccagatgctgaaacattgttcgacgaagatcaagatcagatttgttcggtatgaacagtcaagccagtgcaagagcatgagagacagcagcgtgagctacgcttctgcagcagccaaggtggatactccagccgaagaagagaaggattggattgagtaggttgtggattttgcccggatcacttgtacaaccccccgcctgcagctagcatgatcgttttgcaatccatgtatctgcctgccaaactctataaagtaattataggttcctgttggagaccgattgttgcagcaagtttaacaccaggtaacaacaatgaataaggaatactcatatttctggatacatttaccctagtatcaacgagctgaatattctttttggggtttcaggcctgcttaatggcggtgggtttttttttccgacatagattctgcaccagcaagatcaagatggcaacgactactatatgtagcactagaaaaacaatactagcacaaacaacaagttactcgtggtacaagtaagcaaaaatcagaactactatggatagcatgatttcattgagatgcgaagctgatgtatttgttgaaattcaaatctttaagagcattatacccctttgttgagtagctcataaaaagctgggacttttccatctctaacctggtttacaaatgcactcctctttcaccaataatataagcatttacaaaccttccatggcttaccacaagcccatatgagtaatctttgcctccaaccatcagattagtgtgaggcggtatttaaacccctccccaccccaaagctaagattgttgattttattgcaatagcatattaaggtgccattggcttgagtttgttgagattcattctttccctactctttcttggtcttcgtgatttgtctgtatgagtggattggagtgggttatctcctgtgcttggtgaaaatttggggattttttaagcaccagcattcaacaagttctttttatctaatctcttagaggttaaaaactcgtagatagctaagttaggtgtaattgtagagtttccaatccaattgttggaagcgaatatctaatctcttaggctcagttgtttttttcaactccaaacttcaactttctcattttttgttagcatactttcgttaacatgcttttcaaactgttgaatggtattttaaaaagaatacatagaagttatttaaaaaaaatcaaataaatccaattttaagtttgtaatagttaattaattatatgctaatgagctttcgtttcgcatgcgctactaaacttcctcgacaatcatacaagaacgtaaccataaggttaaaaactcatagacaacaagtgtagagtttctgatccaattgtggtgaggcaacatatgttatgcacacaagctttcacgtgtacacacgtgcacaccaactaacaaatgtcactaaaaaatctagaaaaattcacgtatgtactttcaatagtattacacttagggataaaatcctaacctcaaattcataatattttagccgtaacaaaaataaaatttgacagttttaagtttgtaattctgtcataattttgtctctgtctatgtaaaatgaatttgaagatacgactttgcacatagatgtactactattggaagtatatgtatgaatgctttggacattatgttgcattgtatttcaagctatattccatagtcttaagttatatatgattatgtaaatgcatagaaaaaaatcatatccggctaggttgttctccttgtaagccttgcccccaaagctatataagtaaggcagggaggcgtacaagtgtataactataactcgattgtgagatcaatacaacacctggcaattcaattctcgaaaccggagtagagtattacttttcattaaggagatatgaacatatctaaacttttatccctttactcatctcgtgtattaacgaaccaaactcatcacataagtacagcaaaatcatgttttacgtcacgtaaaacatgatttatacttaaaacaactaaggcaaattttgctacaggacactgtttatgtgtggttttagccctaggacactgcccaaactcacttttgggggaaaacactccataaacgtggtaatttgccagtggacatcgcgccgattaaaataatactttccggttgaagaggaaagagaaatcgcgtgaaatgtcaaaaatgcccttgggcccacatgtcagctctatctcctctctctctattctcagaggcgcatggggcggcgtcggtcgcagcggagatagcgaggacggtggccggcggagtggagcagggcgtcggctgcagcggagcggagctggcgccaactcgcagtcgtttgccaacaccggcgtgcttgtcacctgcgtcaagaacttccccggagagctggggcatcgagctcggcttgctcaagggattcgttaggctcagcggcgccatcttcatgcagctctacgtcgccatcttttgtatagaaaatttttataaaaactataccgttttgcagtttgaaaaatatgtgcgcgaaaaatgagacgattaagttgggaaagctagcaaaaaaaaaaacccacaacccatgtacagaatgagacatcatattggccgtgtttagttcctttttaattttttttgaagtattaaatatagattagtaacaaaacaaattacagattccacctataaactgcgagacggatttattaagcctaattaatccgtcattagcaaatgtttaatgtagcaccacattgtcaaatcatggcgtaattaggctcaaaagatttgtctctcaatttatatgtaaactgtgtaattgcttttttttcatatttaatgctccatacatatgtccaaatatttgatgtgacggaacttttaaaagtttaaagggaattaaacacaccctacgtagaaatcaccttaatactacgggtgtgtttagttcacgttaaaattggaagtttggttgaaattgaaacgatgtgacggaaaagttggaagtttgtgtgtgtaggaaagttttgatgtgatgaaaaagtcagaagtttgaagaaaaattttgtaactaaactcggcctacaatggatggaggtagtaagttactgacagtgggaccagcagctacctcccttgtttacttcatcagccattctgacaggcgctcgagatcccgcggctgcctccggcgagcgatctccctgcgtctcctcggtctcctcgcgagctcgccgccggccgcctgagccgatctccatcccgcgagcagcagcgccggcgtccccgctgcttcttccgccgcatccttcgctcgctcgctggtgagcgtccatccatccgtttcccatctatctctacccaatatgcttcttcttcttcttctctgtcgattcgcgttaaatcatagcttctcttttggatctggaagctgcttttctcttaatttggcttaaccttcttagtactaagtagtaagatctggaagcaaaaaagaaaagttggggcctggatctaagctcgcaggagatcttctgattatgtcgtactgattgaataatctcttgttttttccacttctggcaggcgcataattcctgaatccattttaagtgcagtaattctgagtaccaaaaaagccctcaaaatggtatgcctaatggtttattactctttgtaatattaagaaggaacattctgacattttgctggtataagcaagtggttgatttgtttaggagagcttattattggtttttgtgtaccgcaggtggttcttgctgcttccatcatttcaaagtccgggaaaggtcagctggcttgaaatattctgttgtttatatattgtattgtattattctcagtgccgaaaagaagtttttttaatttatattgttatattgtaatcaaaacaaatccttttgttcatagaaaaagaaaaaaaaagtatttgtataagtttttatcattcacctatgctaataagagtgttagctcatatgcaaatttgtggaacccaaatactaaactagctgttatcgtgttacctcagtagattcttaactcctataaccctaaaatcctatgtagtgagcacctcctggttaccaatttgttgatgcttcattccaggaagttaatgtgattagactaaatgctgtttcttttctgtgcttttcaattgcagcacttgtttcaagacagtttgttgacatgtctcgcataaggattgaaggattacttgcagctttccccaaactggttggaactgggaagcagcacacttatgttgagactgaaaatgttcgctatgtttatcagccaatagaaggcctgtacttgctacttatcacaaacaagcagagcaatattcttgaagatctggacaccttgaggctgctctctaagcttgtatccttttttcccatatgttcactgttccagttttttgacctaactaacctatacaatcctatcctatgaaacatataaaacatggttttttaacctacacatatattgctctgtagtgaataaatgtatatcacataatgttaccaacgtttgttttgtgggataaaatgaagatgaagattataatgtctcggtatagttgagcttgtcactatataccaccaaggggacaaaaaggaaagaaaggcactacattttcaatgtgaatttagattgaaaccaacatgcaaactatcatgtttttgggctttgtatatccatccatcttcagacttgctcctaagctgcattgattttctttcttggcaataatccagtacttttatctccttaacagttgtataggtgcctgaatactccccctctcttgatgaggagggtgtttgtaaaacagcatttgagcttatatttgccttcgatgaagccatctctcttggaaataaggaaaatgtaacagttcaacaagtcaaacaatattgcgagatggagagccatgaagagaaggctcacaagctgatgatgcaaagcaaaatcaatgaaacaagggacgtgatgaagaagaaagctagtgagcttgataagatgagggtatgtactgcatcttttttcatattaagaatacatattatatcgagaaaataaatgacagttaatgtagtggactttgatcattaggaaaacaatattccattactatttctagtttgactttttggttgtgttctgtttttctgtcagcttgtcatttctttggttccagcttagctcgcgcaaaccttagtgcttaaattacaatggcattgccgtcatttgttaatgtctaagtggtgaacttttgtggttggtgttcttgcagatggaaagaggaaaacttgacaaaggaggatactcatcaatatctggtccccgggtaatcgagaaaacattcaatgacatgagcattaccggtagtggatttgggagtggttctggattaggtggactgggcatggatatggactcatttgctagcaagcccaaaggaggtaacttgaaaactctctgcatttttcttggctgatattatattctagcattaatgttaggccataacaattaagggtaaacttactgtgttaacctaggactttcttcttgtggtacttgatattcaaatatctcaagacttaaattcgtaatatagtttccccatgccagtactcctgctttacataaaactgcttgacaaagttcagtcagctatacaatgttacttatgtttgctagcaatatttgcacaggccgtccatctgcagctgctactgctcctggtaaaggtcttggtatgaaattaggcaaaacacagaagacgaatcagttcctagagtctttgaaagctgaaggagaagtcattctggaggatgtacaacccagctcagttcagtcaagggcatcgcctcttccaccaagtgatcctgtcacagtgacaattgaagaaaaactcaatgttacagttaaaagagatggaggtgttaataactttgatgtgcaaggaacccttgctcttcaggtccttaatgatgcagatgggtttatccagttgcaggtaacattccttctgaacttatagcattctgcttgaattcttttttttacagaaattctcaacaccaaagaatgtaacacaatttttgtttgtttcttatataaatctatacgagatatcagatatgtacccataagtaaatagaatgcatctgttatattgggtcatcttttcttttgcgacaatattcaccttcagctaagataattcctttacatttatatttctggtccatgtcatatggtttccaattttgttggtacatttgcatttgtttatgcttatcatgccatgtttgtgtccctgatgagcaacattgtttctttttattatgttcagtttcatctttgattgttgctccatgtttgcattgccgatgagcagcattgttctgtccattctcatagatactattgatcatagctgatcatttcatatttatgtcttatagattgaaaaccaagatgtacctggacttagcttcaaaacacaccccaatatcaacaaggatctgtttaacagtcagcaagttgtgggagcaaaagatccaaacaggccattcccaagtggtcaaaatgaaactcctctggttaaatggagaattcaggggatggatgagtcatcgttacctctatcaggtgcacaatcattttattttcttctgtccactaactcgtacttcaaggacatgtatttttcttacactggttgcttaatacttttgttaacttgctttttcttcgcatagtcaactgctggccatcagtatctggaagtgaaacctatgtcaacattgagtatgaagctgctgagatgtttgacctgcacaatgttgtcatctctataccattgcctgctctccgggaggctccaagtgttagacagattgatggagaatggaagtaatgtttcaaattcctctttagtgaacttatctgttatattatactaaaataatcctccaacaggtcatacttgtctccttccttagtcttgatggtaggagtattaaaatataacaagtgataactttcaattctggcttttgttcctgacagtcttattggcatctcaaactgttaatctgtatgcttaagagggatgtgttttgaatttatcgggatttagtccagatcccttgtatgaattggtcctaaatgacatctcttgtagatagagctcaacttttttttccttgttggcaataacgtagacagcacagtgaaagcttattggtctaatgcctgtttcacatttcactgtgcatacaggtatgactcgagaaactccgtgttggaatggtccattcttcttatcgatcagtcgaaccgcaggtccttgaaatatgagttcatataattatgttttgtacttctatttgggttttttgccctccgttgttaactcttttcccccttatttgcagtggctccatggaattcgttgtccccccagctgatccatcaacatttttccccatatctattggattttccgcatcgagtacattcagtgatttgaaggttggtaatctccccatatttgtttacagactcgcacttctccatatttgatcttccttctggtttcattttatcataatgttgttttctgcatgccttgcaggttactggaatccgtcctctgaaggatggtaacccgccaaagtattcgcagagggctcgtttggtggccgctaattaccaagtagtttaacctaacaagggatgtttgttgcctcacttcagtgacacatgtttgcggtatatgttatctttcggcgatgagctgttgagaagtcatgacaaacaaggattgttttgtatttacagtgaatgtatttttcgcctgtttcatatgtagtaacattttgccccaaattgctgatgatctgtactgccacccgagaaataaacacatgtattttcctttgaaacctttatttcgtacgtcttgttcgttttgtgagattattttcacaaatgtttaaccattagtcttatttaaaattgttgtacaaacattaatttaagtcacgcttaaagaacatttgatgataaatcaaatcacaataaaataaatgataagtcaacagggtcgtatattaaaaaaattggagatagtatatatttatatgactatatatcgttcaatattattaatattattaatgtttatagcattttagattatttttatgttaacgccaaatttagtaagaatttttactagatttgttaatgaaatgagacaattaaccgatggaaacttatccagaattaaccgatggaaacttatccagaagagaccgagtttaaaaagaaatcatgaaaaccacggcacgataatttaatttatctagtgttaattaggcagggtgcagtaattttcctttttatcttcaggcaagtttgtttagtgtccgatcaggactagtatccatcccggtgtcctgtaaacctatctctcgatcaatacaactactctcggagcatcgtcacgctcttttccgaggtttttatcatcggcgcaagttggcacctgacgcggggctgcattggcttcgatctccggtgaaggggtaagccctaagttccgttggccctggcaaatttatcgctacactagtgttcttttaggatgcatcgcttcgatctcttggattgctctgattcaattggtatatttgcgtatctgatatttcaattctatctttaagtgcattgtgtttagaagctcatcggtttagttgggactgtctcagttaggtccgatcttctatcttagcccatcactttatacatgatttatcgatattattaggtttattcgttgatgtaacttaatgttgtatcggtttggtccgacctattagtttttactgttgattaatagatctaatccaccctagtaactcatgtatattgttttatcggagtgctaacatataagttatctttacatctgacttccagccgatgtttattttaaccattcagtctacatttttctgatgattggttcattggacatctacttcatcatattatcatcagctgattggattgtttgctcatgttcttccattttttttatctaagtattagaatctacatcggatatatagccaatttttcaaaccctaccgacatcagctagtattgctacatcagcttattggttgatagactctttgaccatcaatttatccatcttgtcatttatccatcttgtcagttgcaggatcaaactagctggcacggccgcacctcatcaaaatgtaggacctacactagagctaagcaaatctcccgtgtcttcgtgttttccgcatcaacagtttagaaaaaaaatatctttcttgtcctttaaaaactagtcaagtatcttatataaataaaatatcgataacaatgataataataattatttacctatgtaaaaaacatatataatatatattacggagcatacacacatgagctagatgctagtattcatgtgtaagtaatagtgtttgactctagcaatattattatcgaaataaagaagaacgagaaaacaagaagaagatggaacaatggaagaatatagagttaaagttttactttcacgctgtattactacgaagaccaaatttcataatagagtaaattacaccactgatacataaacttataagcaggtttcacctagatccacgaacttacaaatcacgcatcgagatcccttaacttggtttattgtatcattctagtccaaagcttcgtttgatagtggtcttacccacatgtcataccacgtggacgttgaccctgttctccttttctccttttttttttctctcccatcttttctcatctgctccaccgacggtgacgttgaccctgtgcctccaatgcacggtcaccgtcgctcgccaggaggctactgccccaccccgttcccgatgaactccacctggggaagggggaaggggttgggcgcccccttttaatttggccaataattccaaaatatcatattgtaaactagcacagaagttgtccgtctcaaattttggaagttttacaatctaatattttagaaattttgatcaaaatttggaagttttatccaggggtatttcgatcattaagacaaaattttaccgtactaacgaaggctaactggacgacgatgatatattatagaagttaagcaaaatatgatggtatatggtagaacttgacaaacctagtggtatattgtagaacatggacaagatcagtggcacacaatagattctctcatattttttatgttatggttgttcatttgactacctatctactatggtgcggcagttttagtactacaagtccatatcttaacactaaattacatatacttataatataattttcaaattatactatgcattattcacattttatagaaaatatggaaaaatatttattacctattcaattatgagaaaaatattagtccaaattaacatatatgtaaaaattaaaaaaacaatatagtggaaataccaatatatagttttatgggtttgttggaaccatgccacatagtgataagagatagtcatcatatgtcatgcagtgagaaaagaagatcacaattgaatcgagactacctgttaatggataactcaaatttaattgtgctagacaaaaaaaagtaaattacaatttgtactatgtattcttaaaagttttcatattatatcatcctttaactatttttttcatgtacacaatagctaactttacctttttttt

SEQ ID NO: 33139 - DNA, 776 bp, Oryza sativa
  unsure (1)..(776): unsure at all n locations
aannnnnnnnnnnnnnnnnnnnnnnnnnnnnnnnnnnnnnnnnnnnnnnnnnnnnnnnntgtttaacagtcagcaggttgtgggagcaaaagatccaaacaggccattcccaagtggtcaaaatgaaactcctctggttaaatggagaattcaggggatggatgagtcatcgttacctctatcaggtgcacaatcattttattttcttctgtccactaactcgtacttcaaggacatgtatttttcttacactgttgcttaatacttttgttaacttgctttttcttcgcatagtcaactgctggccatcagtatctggaagtgaaacctatgtcaacattgagtatgaagctgctgagatgtttgacctgcacaatgttgtcatctctataccattgcctgctctccgggaggctccaagtgttagacagattgatggagaatggaagtaatgtttcaaattcctctttagtgaacttatctgttatattatactaaaataatcctccaacaggtcatacttgtctccttccttagtcttgatggtaggagtattaaaatataacaagtgataactttcaattctggcttttgttcctgacagtcttattggcatctcaaactgttaatctgtatgcttaagagggatgtgttttgaatttatcgggatttagtccagatcccttgtatgaattggtcctaaatgacatctcttgtagatagagctcaactttttttccttgttggcaataacgtagacagcacagtgaaagctt

SEQ ID NO: 33140 - DNA, 1176 bp, Oryza sativa
  unsure (1)..(1176): unsure at all n locations
nnnnnnnnnnnnnnnnnnnnnnnnnnnnnnnnnnnnnnnnnnnnnnnnnnnnnnnnnccctttgatacaagaacttagatcggctatatctatttagcttctaactattcctaaattattcttgcaggtcttagccgatctgttctcttttgacattaaggactatctcgatgagacagaagaggataccacaagcgaagccttggcccctttatccgatgatgtgaagaaaactcttgaagatatctcttatcggctagaggcatcatcactagacagtttggtggtcgactgtggatcaattagggcccggctacacgaagttcaagctttaattcctgaagaactaaccgatgtcctcactccagctgcttattttgaacaacatcaattcaaactggagaaagccaagcaaagactagtcgaacgccgagaacgcaaagagattgaggctaccatccaggccaatcggcaactcgtgcatgaagagaagtcaaaacttgatcaactatctgagggcccgatcaggtctaatattgatcggcttgaagctcgaaagattgagctcttggcacaattccaagaatgcaatgccgaagtggttctggaacacaagaagctagccgatctcccatagtctgtcgaagaacaaaaggcaaggctaaaatcggctatcaagaacgtcgctgatatgaccaagtccctaaaagtcatccctggaaccgatgctcaggatgcccaattcattgaagaagtagaacaaattgggcaaagagctatatcggctatccagcgctacttgtctcagtgatattttgtgtaatagactctaggaattttatgccgattcaatataactccatattttgctaaaaaatttgcaattttgcaatttctcatatatgtgccccctaattttataatgtccaaaacattgataaaattataatttgaactaagggcgatataacaatatcagccattgtacatcggcaaaccacaaccgattacaatatgaaaacaactaagggcgatataacaatatcggccatctcaaggcgctgcaaatgcatcggctatcatgtaccggcaacatcagccgatcatgcattaannnnnnnnnnnnnnnnnnnnnnnnnnnnnnnnnnnnnnnnnnnnnnnnnnnnnnnnnnntta

SEQ ID NO: 33141 - DNA, 763 bp, Oryza sativa
  unsure (1)..(763): unsure at all n locations
nnnnnnnnnnnnnnnnnnnnnnnnnnnnnnnnnnnnnnnnnnnnnnnnnnnnnnnnnnnnnnnntttcgatggtcccgtttctgatataccaatattaccaatttcgttaccgttttcgggtctaacgttcccattccgttttcacgaaaaaaaagaaaatgaaaatggtatagtgtttttccgacggttttcatccaactgaggctcctcatcgctgctcctgtcctgtcggagaaaattgacgttgtgccatcttcaaaaccaggtttagctcaaatgccatgctggtagtgggtttctttaaaatgccactttcaaccgaaggttacatgccagaatgctacccttcatccacatgccgctgagcgcggttcactgcctgccgccgagtgcgtagttcaccgactgccgccgccaccgacgagcgcgtggatctggtgccaccacctgcttcccagccggcgccgccacctcctgtcccacgattccctcctcgctgctggtgacgtcttgagcagcgacggcggcatgatgtccacgatcaacaccttcccaccaccgagggccaccacgcatgccttcccgccgccgacggtcatctccgccgcgcccttgaggcgctcggactcagctaccatcctctaccgagcggtgccccagtcgtaggcggtgagcgcgccacgctcctcatccaaaacgtagatggtctcgccgttgtccaggggcgacgccgacgcggggcccttccaaccggcgagcatg

SEQ ID NO: 33142 - DNA, 747 bp, Oryza sativa
  unsure (1)..(747): unsure at all n locations
nnnnnnnnnnnnnnnnnnnnnnnnnnnnnnnnnnnnnnnnnnnnnnnnnnnnnnnnnnnagagctgcacttcatttcattaagaaggaaaaacaaaccacccatacaaccaagcgctaacaagcccttcatccaaaacacatccacaaatagcatcacacaaggcgacacatgaccaaaaaaccaccctacgacagcctagtgcccttaagataacgacctacaaaggaaaacttggagcacaagagctccaacaggcaccaaagcgtagcttctgttgacactgcccgcaacgcctacataacgtttggattcgctcaattgaatacacagtcattatagtgtttccaaatttcccaagcaactatgataaacaataattacttttcttttgtctccttggtaacatataatgataagctcaactaaacaaagacattataatcttcattttgtcctacaaaacaaacattaatagcattatctgatatttagtctgtacattgcaatatatgggtaggttaaaagaaaaaaattttatatgtttcatattatagcattatctgatattttgtccccttggtggtatatagtgacaagctcaactataccgagacattataatcttcattttatcccacaaaacaaacgttggtaacattatctgatatacatttattcactacagagcaatatatgtgtaagttaaaaaaccatgtttcatatgtttcataggataggattgtat

SEQ ID NO: 33143 - DNA, 787 bp, Oryza sativa
  unsure (1)..(787): unsure at all n locations
nnnnnnnnnnnnnnnnnnnnnnnnnnnnnnnnnnnnnnnnnnnnnnnnnnnnnnnnnnnnnnnncacctgtgatgtgcttgtatactcctgatttgtagtgtgcaaaatccttcacaatgttggagcattaaatcaaatcaacaatgctatgcatcaaagagaaatcatactcttttctgatagacctcagaatgttataaatgaagtcacaaaacatgcgtaaaattagatgtgtagccaattgaaccaaactccaacgtttgaaagattactagtgtgcacatcttctcatgtagtgcaccagaaaaagataaatactccaggccccagaaaatatctaagaactactttcctgtttgggttattttcatcccccacccctcttcttccgtcttgttcttcctaagccttatctctatacgtaaagctctttttaagaagctttatattctgcacgtcatattttatttgaaagtgacaaagcagcaactgcagcctacagtccattttgatttctgctaaccaacaatcaacaatttggtgaaagagcatggaaaaaaaatagaaagtcaatggtacctcataaacggtgaaagcaacttctacagggccattttggtagacttctgccattatgtcatgtggatcagaattaactctgtatgcattgacactgaaatgcttcttttacagccgtacttgggtctgcaccttgcatttcttctcgcacgctgccgtagaataagcacgttcgcatcatggatgcttacaaccgacatgatcaaa

SEQ ID NO: 33144 - DNA, 648 bp, Oryza sativa
ccgatttaagccatgtggattaccagtcagctcaaggaaatcggtaccattttccctgagcactcaagaatgggcaattttggggggatatctttaggagtctggttgtttggccacctgatttccattcttttcttgtttttaccattgtccaaagaaataagtctggaggcactaaaaagaagtctcgtctgtgagtcgcatggaacctgcatctcaatcgaaggattctgcttatctttccatttaagataaatccatctcaaatttagagctctcccgaacacaggtaggtattttatgcccaacctgcccttttttttggtgtacaaaccttagacaattaactaaacaatgcccaccaatccaccatcacaatggccatcccctttccaaataaagcctctcctattctaatatattgacgtgcaatcattttgcgcattcccgaaaataaagcctctcctacatgctggtaaccgacatatgcacaatataccgtcggcgatgtcatttgccatctattatggaaaacataacactcattacttgattggcatgccacgcaacatttatgtgctccatgtccgttaaccccacattatacagtcagttcatgttttcctgttgacttatttgctaaggagc

SEQ ID NO: 33145 - DNA, 762 bp, Oryza sativa
  unsure (1)..(762): unsure at all n locations
nnnnnnnnnnnnnnnnnnnnnnnnnnnnnnnnnnnnnnnnnnnnnnnnnnnnnnnnnnnnnnnnaaaataatagcttggggtctcgatcttcaattggctgtcggctggcatgatttcaatcttgtcgccttgccactgaatcaagcattgatgcatggttgaaggaatacaacaattggcatgaatccaatcccttccaagcaacaagctgtaggaacccttcccatcgatgacaaaaaatgttgtagggatagttttgttgccactgctagctctacatttaaaactcctttggtttccgatggattgccaccaaaatttttgagcaccatatttgcatatgctcttatggcaccagtgtcgctcgctgcccactcaaatgcttcttttgttagtgtatcatctcggccaaccgtagtacatacacatagtagtggtcctcctgcagtcatcgtagacaattccatctgctctttaaagtttggcttatgattctgatgtgaccattcagattcttgcaggtaataggtggacagcttttgaaactacagacaagcaaaggatattaaccacatagcaatatttgcacttttttgcgaatctatgtagcaatatcgttatgctactacacaactcaaatagagatacttttctagtcgcaatgtactcgtcgttttagatatgcatttatactctatttagatttagacaacgccattttaaggaaaaaacttactcgtcgttttatgtactcgtcgcaa

SEQ ID NO: 33146 - DNA, 4140 bp, Oryza sativa
ttcctgcagcccggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaacc

SEQ ID NO: 33147 - DNA, 10021 bp, Oryza sativa
ggcctgcggccggcccagcagggaggagggggaggaaaggaggagatgggccagcggcccatccgaaagaaaggaggaaaaagagaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagtgtgtactggaataaaatgagcaactttggtgagtcgatccacgaccacccagattgaatcgtgccccgacgacgttctgggcaaacctgttatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgggcctctagggcagctacgtacccgtgttctacgatgcccaaatttaggtgctcaagatcttgctgcaatttgtcacacatgacttcggtatatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctgacgaatagccttgtccacaagcttctcaaagtcctcataaactccggagattagctggttggtcaattcatcgtcgagcccaaacaaaaacttctcctgcttctcagcatcggtgcgcacgtcctcaggggcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcagaagaacaaaaccccaaaatttttcccgaaacaaatccaagtgcaaaaagcatatgcagatgaagaggggttcagagggctcttaggtttccagttggcttgtcctacggtcaaggtcggctctgataccaacttgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaagggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcggcgcgggcggcgggcggcggcgcgagcggcgacgaccgaaagcgacggcgagggcgcgaagagggcggcggcgcacggggaaaaaaaaagaaggaaaggaaggggagggagacctcaccggaggggcggcaatggccggcggagaaaaacgagggaggcggcgaagaccggtgatgccgaggtgcggacgagcgacggcgacacctagggaaagagaggagaggaattagggcggaggaaaacccccacagcgaccatccacgccggccggagtcggaggggagagagaactcaccgacgacgcgagggaaatggggtttcggtggtattccggtgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcgaaaaacgagagaggagggcatggggagcattttataggcggagggggaggcggacgtggccgggaggcgctccgatttcgccggcgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccggcggcccatccgaaagaaaggaggaaaaagagaaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacagagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaacaagtgatatgttcgaagatagtctacagaggtcagagtaaaatcacatctaacaacgaagcttcaaatttggccggataacgaccagacaataagaagtccagcagtaaagccatttgggaagacgtcaaagcatgtccagtgggataagttggttctcttgggaagcataattcaaaggcaaagttatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaaagttctggaactgaagccccatcttcaagtgccacaatccagtcgaagtcagctagaggtgcaaccagggaaaagtcaggtgaagagaagactccatctgcaacaggagattgagccaagcagtccagagtggagaagttttgttaggcaagttcgttataaaagatgcgacggaagaagtcggacaagaagagaagaccgcccaacctatcttcttgctagcctcctcgaatctcggggacgagattcttataaggggggtggatttgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttctttcccccccttcctctcttgggccggctcggcccacctcgctctttccctctctctcctccccgcggacca

SEQ ID NO: 33148 - DNA, 62845 bp, Oryza sativa
  unsure (1)..(62845): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgccttcctttttggtgtgttatgactttctatcccattgcaaaaaggttcttacattgactaaaatatatttatgatgactaacattagattttgtacatactgatcttgttgaaagatgctacaagaaaatatgtgcttgattggccaacaaggttcaaaataatcaaagggatagcaaaagggcttctttatcttcaccaagattcaagactgacaataattcatagagatctcaaagcaagcaacatcttgttggacacagaaatgaaccccaaaatatcagactttggtattgcaaggatttttcatggtaatcagcagcaagcaaacaccactcgagttgttggaacatagtaagtaataactagtaattagcccactagatagttttcaacactctaggttttattgactagttaaattcaaactgtgaattaatccttgccaacgattgtgcattcattgctaatgaaatggtttatacagtggttacatgtctcctgaatatgtgttgggtggtgccttttcggtcaagtcagatacatacagctttggtgttcttcttttggagattgtcagtggcctgaaaatcagttcatctaaactcacaccaaactttttcagccttacagcctatgtaagtactctaaaatgccgataattttgataccaaattaaactttagcagtcagcagtattttggagcaacaggcattagtaactttggtcagaacttcattctacaggcatggagattatggaaagatggaaatgcaacagaattgttggacaagttttttgttgacagttatccacttcatgaagctttcaggtgtattcacgttgggctcttgtgtgttcaagatcatccgaatgatagaccatcgatgtcatctgttgtttttatgttagaaaatgaaagcacgctgcttcctgcaccaaagcagcctgtgtattttgaaatgaagaaccacggaacacaagaagcgacagaagaaagtgtgtactctgtgaatacaatgagtaccacaacactggagggacgctagactaagaggtcaagctttactatacatgatttcagcatagataattctatgtttttacaatttaatgcttatgataatgaatttcagtgatgtgatatatgactttaaatctttaatggaaaacagtggagtttgctgcgtggtgaagaatgcttgtgaatattaatcttattgattggtatttatatataaaaaatgttacattgcagacaaggtattgcttacaaatttgcaaacactgtatttctattccacatgtggttgcttttatctgaagttaatcataaacctaaaagaatgtgacatgtttacaaatacacaaattataatggcatttttaaaaaccaattaaaccatttgttttagccaaaaggtcataagccggcttttaatagaagataataaccaaagactatggttggtattgaaatagatatccaaattagcaatgcctggccatgatttccattccatagaggccggatttctatccatttacctctaaaaaaaaaaagaagaagctgtacctggcctcaagtagcagggatgttgctgccggcgtggaagtggcaagggccaaggggaaccagcttggcgtcaatggcttgtgaccgcgtaaggggacgggacagtagcaggttaggcccgccgtctcttccgcctaagccggctgcggtggcggtggcgccggcacctgcccccacggccgccgctactccgccgtccaccgcctcaaccgagcgcttcctctcctaggctgcaacgcctccgccacctcgccgagctccaccgggagcggcagaccgcggacgccgggcgcttcgacgtgcggtgccgaccgtcgccggctcaccgccccccaccgccgccaaccaccactccgccggcgaagtaaccgaagcacgttcgtcttcgtccacagatcaatcgacctaggcccaatagcccatcacgagcactttcacggcccacgaatctcacagttccggtcgcggactggtgggccgaatttgttctggtattccctcgccgcggcccatgccaatgcctctccgccgctgcccggtgaagcacctccaccgtctcactctcatcactggctcggaagtcaggacgctgggaagaatcaccgggaaatatttgtggagatgcacagcaaaacacttgcctgtaaatctgtgattagttgtgctggtaaaatagcttgcctgccgtactgccgttgcaagtggttctcctgaagactagcaaatgccctgtgcgtgctgacttgcttcatcaagcactgaaaataaaagtcattgagcaataaatcgggtcttcaatcttaacggtgacatacaactactagcgtgtcgttctgatcatctggccactctcaacgagaaaattgggattatactatcgtaaaagagtggtttcgctggaatgctatctcttcaaactaattcactaaaatgctatcttaaactggaggtgttcaccaaagtgctattttcactcttttgggtaaatagaaatttttttcctcaattttaacttttttctggaccaaaatacccctgctacgggcccacatgtcatactctccactctctccttctccccctcccctctatcgagggagcgccggtggcgggaggcgagcagtggccggcgccgcgtcgccgtcgctggcgtgccggctcgacctcgagaagctgatggcggcgcagctcggctagcccgtgctcgacgacctcctcatcccgtcctcctcgcccgacgccgccgccacaacggcctacgacattgacgccgtgcagaggatcctggccggctacctcgaccatgagggcgacgcggcggcggcgccgccacggctggactgcaccaccgacgacgacttcagctcagcggtgtcgccgccgcacaacgacgtcgcccaggtcggcaggctcatggagagctacctcgccgagatcgcctccgacgagaacctgtccattgactagttcaccgccctcgccgagctcatcccggagcacgccaggttcaacgaggacggcatgtaccacgccatcgacatctacttgaaggttagaagctgccattcacatcgatcactaaaaaatggctaaatccttcgttaatcactccactaaatgcttatgtggccggtgcagacggtggtgcaggtgctgtaccacgagcagcggcgcctccgcgcgccatcgcagccgccgagcaccgcgccgtcgtacgccggtggcgagtcgccggcgctgtcgtacaggccgacaccgagcttcaacggcgctgtcggccactgctcgcttccaaccaccggcgctccctcgagagagatgaagaggaggagagagtagagggagtatgacaggtgggcccgcatcaggggtattttggtccggaaaaaagttataattgagaaaaaacatttctatttacctaaaaaaacgaaaatagcattttggtgaacaccttcaatttagaatagcattttaatgaatcagtttgaagggatagcattccagcgaaaccactcttttacggtagtataatcccaattttctcactctcaacacaggaatacagaatatctattgcgctatttcagggcctgggaaatataacaattacgatagtataatcctactcttttacgaagctagctgcactagttactctatactgccgacaagaaggttggcccaataatctcacaactctgttctatcgtctctatgtaggattgtagtgctttccaaggaatttacaagagaatatgaccagactgcatgtagtcatcttcatgttcttgattagtttctgccaatccgatgaccgcctaacaccggcaaagccactcatcttccccggcggcgacaagctcatctcggatggcggcgtctttgctgtcggcttcttctccctgaccaccaccaactcaaccccaagcctgctctaccttggcatatggtacaacaacatcccggagcgcacctatgtctgggtcgccaaccgcgacaacccaatcaccacccatacggcgaggctggctgttaccaacacctccgggcttgtgctatccgactccaaggggaccacggcgaacacggtcaccatcggaggtggtggagccaccgcggtgctgcagaacacgggcaacttcgtgctccggttgcccgatcaccccacggacacgatcctccctggcctccctggcttcaagctatggacgaacatacaagaaccatgaggcggtgcgcgtagttgcttggaggggtcgtcgcgacccgtccacctgcgagttctccctcagcggtgaccctgaccagtgggggctccatatcgtcatctggcatggggcgagcccgtcgtggcgcagcggtgtctggaacggcgcgacggccaccggcctcaccaggtacatatggtcccagatcgttgacaatggcgaggagatctacgcgatatacaacgcagctgatggcattttgacacactggaagctggactacaccgggaacgtgagcttccgggcatggaacaacgtatcatcgacttggacgagcccattcgagcgaccaggccatggctgtctccactacggcgcctgcgggccgttcggctactgcgacatcaccggcagcttccaggagtgcaagtgccttgatggcttcgagccggccgatggatttagcctcaactcttccagaggatgccgaagaaaggaggagctgagatgcggtggccaagaccatttcttcaccttaccagggatgaaggtgccggacaagttcttgtacatcaggaacagaacctttgaggagtgtgccgatgagtgcgaccgcaactgctcgtgcacggcatacgcttatgccaacttgagaactatcctcacgacgggtgacccctcaaggtgcttggtatggatgggggagcttctcgactcggagaaagccagtgccgttggtgagaacctgtaccttcgactcgccggctctcctgcaggtatgcgccgtctcatgatgttttctctagcaattgccccacattctccatgaacatgacgataaatgtcattctgcagtaaacaacaagaacattgtaaagattgtactcccagctatagcatgcctgctgatactgacagcatgctcatgcgttgtactctgtaaatgcgagtcaagaggtaaagcaagagataacagctacttgcaatatgcagctgctaaatgtaatattgttgtgttgacatgttttgatatttatattaggcatacgacgaaacaaggaagtacttaaaaaaacggagctaggatacttgagtgcttttcatgactcatgggatcaaaatctagagttccctgatattagctatgaagacctcacctctgcaacaaacggtttccatgaaactaacatgcttggaaaaggtggttttggcaaagtatataaggtggtataaaattttaccttgtaaattacacaatgtgagtgtagcattcatgtcactttattcttgtttaacaccatgtctccatggtaatgaaataccacagggaacattggaagatggcatggaagttgctgttaaaaggcttaacaaggattctgagcaaggggtagagcaatttaggaatgaagtagttcttattgcaaaactgcagcataagaacctagttagacttcttggttgttgcattcatggagatgagaagttgcttatttatgaatacttacccaacaaaagcttagacaaattcctctttggtaagttttatcagatattaaatgaaaagcttgtttttcagaaaaggatgcattaaaaaaaagtcttgattttttttttttggaatgttcaccggaggggagaggttccccacctgaatttccattaagacaaagtgcatactctaatggaggagtcaacattatcgaattctctaatggtttcattcctgtccattatccattttcttggtagatcacgcaatgaagtctgtgattgattggcaaacaaggtttaacataatcaaaggggtagctagaggacttctttatctccatcaagattcaagaatgatgataattcatagagatctcaagacaagcaacatcttgttggatgcagagatgaacccaaaaatatcagattttggtatggcaaggatttttggaaacagtgaacagcaagcaagtactagacgagtcgttgggacctagtaagtggacttgttctctagccgactagttcaacatattcatgtgcttgaacttattcacttttttcctgcttgcttgcaaatgatttaaatagcggctacatggcacctgaatatgcaatggaaggcattttttcagtcaaatctgacacctatagctttggcgtattgctactggagattgtaagtggattaaagatcagctcccctcatcatattgtgatggattttccgaaccttatagcttatgtaagtgcatgctgctaccaatacttatgttaacaattcgaacacaatatagttaaaacaagttaagaaatctttactaatgttattactttcaggcatggaacttgtggaaagatggaatggcagaggctttcgtagacaaaatggttctggagagctgtttgcttaatgaagtattgcaatgcatccatattggactattgtgtgttcaggacagcccaaatgccaggccgcatatgtcattagttgtgtcgatgctggacaacgaggacatggcacgcccaataccgaagcagcctatatatttcgtgcaaaggcattacgacgaagaagaaagacaaggctcggaaagttccgttaataacgcgagcctgacagcgctagaaggccgctagactgtaagagattaaactctcaagcagtttctgcagttgtacattactacagtaggagctgaggtttatagatcttgtaaaagaatgcattgcataagcagattgatgtacccctaatccgatttgcaacatatgggtaaaaataaataagtggttccatgtgcaattcactcatgagatgttgaaaagaatgacttgcacaggcagttttgttgtgatttgatcacctgctatgcttgttcaggtctctgaaagtccatcttcgtttggcggaaggtctccaaaccaaagtgctcccgcagcaccgaaggactgaaaaaaaaagaagaagctgttgtgtgaatcttcagcgcctgtggttcctacttccaatgcaaatgatgtctcctcgtcgcttccaaatgggcaaatcggcaagagatttgggggcaaaaggatcaagggggtggtaaccaacctgccctgccacgatgtggtgaatccgtgatacgtctgctccccggacacgcggaaccactagctctctcgcctggcaacaccggcgctgacgccgccgccgcgccacctcgcgcgctcgcggtggcggacgaaccgccttcccggttggcgccgcccgctgccggctcggtggtcggtgccctcttctccgtcgtctgaactccacgcggaagggttttgtacctgcggcccaactgggtctgattcggccctgcgtacacggccacggatggattggcccacatatagcacccgcggcccatgtttaatccatgaagcccataaggccaggccggctgtttacagcccagcgctgccatggagcacgtcagcaagccgttgacgacacaaattctgtttattattaattttatttattgaaatattttttcaaatttctataatctacacccctaccacttttagcagaacgtttttttttgacgtggcacatattcattggtgcatgttaacggtcacatagaaagaggctgaagtagcattcttaccgccttattagaaggttatatgggattatatgtgaaatgatggctagagcattttgcaagcggccatttcacaacatctcaaaagatgtgacaaggggttgcctgtaaaataacattctcggttatttttgcaggtggcctccttatagtcttttgggaagatgtcaaggcaattgcttgcaaaatagccggcctctttttacgcggtatgccaacacccgtgtgccacgtcataaaaaaaataaaactctctcctagacgtcgttttttaggtgtagatttctaaaagttttctagaaaattattatgtaaatatttaaataaataaaattcaaaaaatcgacgacttgacgccatcaactcctgtgttgattagtgtacaaagtccccgtgtgtcccagcgtcatcacgctcacgcgcaacgttttgagactgaaattttcgttttctttgttgtttttgttcaggagagtcagcgaagatgtttcggacttcccgtgtgccaggcacaaccgcacaagttgcattacaacactgactacctgcctacctgctgcctctcggcattgcgtaacgcgccatggcggcgaccggccgacacacgcgcatgccgcgaggtttcgctctcttgccaacttttcacggtcgcgtctctctcgaaagtttaatcagctgaccctgatgtcgtagctacagtaattagtttgcggtttgacactgcgtcttcaccagaggggcagacaagtcccggtcaggcgttacttcgttggcccaccgtactaaattcactgttcagaaaagagtcgtgtatggattagtagcaaaaatcaaaggtgccaattgttcacgcttcatagccacaggcgagccaagaacaaggccatatgagatttaccagattatggcctgcctcccagttttcatctccttgctgttcctcatctcttcctgcaaaggcgatgaccagctcacacaggcaaatcgactgatctcccccggcgacgtactcatctccaaaggcagggtcttcgcgctcggcttcttctccccaacagcctccaaccagagcttcttcctcggcatatggtaccacaacatctccgagtccgagcgcacgtacgtttgggtcgccaaccgcgacaacccaatcaccaccccttcattcgcaacgctcgccatcagcaacagctctaaccttgtcctgtcggattccggcaatcacaccctttggacgacgaacgtcacggccaccggaggcgacggagcttacgcggcgctgctcgactcggggaacttggttctccggttgccgaatggtacaaccatatggcagagctttgatcacccaactgacacccttctgatgggcatgaggtttttggtgagctacaaggcacaagtcgccatgcggtgcatcgcttggaagggcccagatgacccctccaccggagacttctccatcagcggtgatcccagctcaaaccttcagatcttcctttggaacggtaccagaccatatatccgctttattggatttgggcctagcagcatgtggtcttcggtcttctcattcagtacctctctcatctacgaaacatcggtgagcacggatgatgagttctacatcatatacacaacctctgatggctcaccttacaagcgtcttcaactggactacacgggtaccttgaagttcctggcttggaacgacagcgcgtcgtcatggacagtcgtcgtccagcgcccatcacccaccatcgtgtgcgatccctacgcctcgtgtggtccattcggctactgcgacgcaacggcagccatcccgaggtgccaatgcctcgatgggtttgagcctgatggctccaactcttcttcgagaggatgccggaggaagcagcaattgagatgccgaggcagagatgatcgcttcgtgaccatggccggaatgaaggtccctgacaagttcttgcatgtccggaatagaagcttcgatgagtgcgcggccgagtgcagccgcaactgctcgtgcacggcctacgcttacgccaacttgaccggagccgaccaggcaaggtgcttgctttggtcaggggaacttgctgacactgggagggccaacattggtgagaatctgtacctccggttggccgactctactggtatgcccaatttctcttgccctgcggtgaaaataaagctcttaattagatagcctgctcatcgaattaaaagcaacatccatatatacacttgcaaggcatggtatagaatttctgaagaactgaatatgcagaggtcttgccaggccaagattttccacgaacaaaaaaatgttcactacttgataggactcttctgaagaaaacaaaaaaggaatatataccttctgttaaaggaaaaagaacatatatccaatgtgctactccatatcaacctcaaattttataatccgtgttctcttggtgggccgtattctgcagttaacaagaagaagagtgacatcccgaagatcgtacttccggttataacaagcctgttgatactcatgtgcatatgtcttgcgtggatatgcaaatcaagaggtaggccaacaccaactaagcttttcaggctgcattgtttctaaggtaacaatttatatgaaaggctttcctgccaggcatacaccgaagcaaggaaattcagaagaaacatagactacaacatttgaaggattccagtgaacttgagaatgacaatctagaacttccatttatttgcttagaagacattgtcactgcaacgaacaatttttctgatcacaacatgcttgggaaaggtggttttggaaaagtttacaaggtacaaaaggttttaccttggcaatttcagaagaaatatcttttatattctcttgttcaattgaaagagtgtgtgcttgtgcagggagtgttggaaggtggcaaggagattgcagtcaaaaggcttagtaagggttctcagcaaggtgtggaggagttcagaaatgaagtagttctgattgccaaattgcagcatagaaatttagttaggcttatcagttattgcattcacgaagatgagaagttactcatctacgaatacttgcctaataaaagcttggatactttcctttttggtacgttgttactcacttatttgtggtcgtataatacaaacattcttgaggatattcatggttaatgacaattaactttgtttcacattaatcttggaagatgctaaaagaaaatcagttctcgattggacgacccggttcatgataatcaaaggtatagcgagagggcttctttatttgcaccaagattcaaggttaacgataattcacagggatctcaaagcaagcaacatcttgttggacacaaatatgagtcccaaaatatcagattttgggatggcaaggatctttgaaggaaataagcaacaagaaaatactaccagagtagttgggacatagtaagtaacctgtagaccacctaatgatatatgttttcattataactaattcaaactgcacattacattgtttttggaatgatctaaacagcggttacatgtctcctgaatatgctttggaaggctccttttctgtcaagtctgacacctacagttttggggtgctactgttggagcttgtaagtggcttaaagatcagttcgccccatctcataatggatttccaaaatcttataaccttcgtaagtggactgcaatcctcaacattttaatcagtaaaacattgcaaaataaattgaccacaactttcttgtatatcttggttcaggcgtggagtttatggaaagatggaaatgcaatggatttggtggactcatcaattcgggagagttgtctacttcacgaagttttacgatgtattcaaatagcactttcatgtgttcaagatgacccaactgccaggccactcatgtcatccattgtgttcatgttagagaacgagacagctgctcttcctaccccaaaggagtctgcttatttgacagctagggtctatggaactaaagacactagagaaaacaaggaaagatctgtaaataacgtgagtatcacagcactagagggacgttaaatgtttattacaccattccctgtttagtctataaacttctgtagcttgtagttgtacacttatacattagcaattcaaatttatacacagaaaatgttctgagcaatacattgtaaccagcattttctttgttgcttggttgcataaaaggaatgcttccatacatccatatttcagaaacttaactatttctgctactgcagccttggcttgctctgaaatttgcagactaataaatgcaaatcgtttggccaaatcctatcatttgatagcattgcataggaaagaagcagtctgcttacaggtgacgagtttgaactttgaagggcatccgctgctgcgttgtccaaagcagcaaagcacgccggcgccgccttattcatggaaagccccaggccaaggcgaaacctgcacaccaccaccaaccaggaagcaatactctcaatcacaatccacattccacagtggagatctggataaaccctattaatcaatggcgcactggaactctcatggatctaaggcctgaagaaatacgcaccatctgcgttaacggaaccaatccccatccttccatgggagcgccgcccgacgggaagcagccgaggcggctgcgccgctgcggcattcaggattcgccaactgatcggtcttgcaagctatcgagcacgcgcaggcagatccggttccatccagcggcggcggcggcgacggcggcgacggcgacggcggcgatctctgacgaaagcgaagtggggtggatgtgacgggccgatttactgggccgcatggtgaggaaacggccacgatgaactttgcagctcagtatggatatgggcaagcccagattgattcggaagcaatggtttacgatccaattcatgtccgtgggccgaatccttcggcggcgagccggcgaagcttctcggtccgacaacctgtgcagccggcggcgcgccgccgccgccgccgccgccgcgcgcacagcctgcccaccatgcccgcccgccggtgcctccttgtccctccgcttcaacctccctcgccgacggccacgaccggggcctcgtcgggggactcgcgtcatgtccccttcgacggtgccctactcctacctccgccgccagggacctcccatcacagccgccggccgtctacggcgagatttccccggagacctaaggtccgcttcagtcgcctccgccgcgagctaaaaccgatggtgacttggtgagccagccagtttctcaatattccccccttttaactgtcatactcacacatgttcgatgaactttcgactttgtatttctggatggagatgtgccgatgtatttgacttactgtccctggtaatgaaattcaaggaaccttcactcagacggcattatgtagttgctggctcaagttgggcagacgatttgctggatggccaaatcatttgagtcaactttgttcagctggatgagaccgacccttgtttggcttgttgttcatagttcctaccaattgcgtgtcctcgctgataagagcttcctacaattggagggaagaattgcttccatgcttactcaaccttacacagaatagaaggcctaatgggcacggctttcgctaccgttttcgtactcgtgttcttgatttctttgtgcaaatcagatgatcagctaacacctgcaaagccactctaccctggtgacatgctaatctcggatggtggtgtttttgctcttggtttcttctccccaacaaactcaaatgctaccttatatgttggcatatggtaccacaagattcccaatcgcaccgtggtgtgggttgccaaccgtgacaacccaatcactgccccttcttctgccatgctcttcatctccaacagttctgaccttgtgttgtctgaatcgggaggccacactctttgggaagcaaggaacaacatcaccactggaggttctggagccacggtagttcttcttaattctggtaatttggtccttcgatctcctaaccacacaatcttgtggcagagctttgatcatttgactgataccatcctccctggcatgaagctcttgctgaaatacaatggccaggttgctcagcgcattgtttcttggaagggccctgatgatccatcaaccggcaacttttccctcagtggtgaccccaactcggatttccaggttttggtttggaatggaacaagtccatactggcgtagtggggcatggaatggtgcgttggtctctgctatgttccagagtaataccagctctgtgacataccagacaatcatcaacaaagggaatgagatatacatgatgtactctgtttctgatgactctcctagcatgcgcttgatgctcgactacacaggaacaataaagatgctgatctggaacagcaacttgtttgcatggtctgtgttattcagcaatccctcttatacttgcgaaagatatgcctcctgtggaccatttggttattgtgatgctgcggaggcattcccaacatgcaagtgccttgatggattcaagcctgatggtcttaacatttcaagaggatgtgtgagaaaggagcagatgaaatgtagctatggagatagtttcttgaccttgcctggcatgaaaacacctgacaagttcttgtacatcaggaacagaagccttgatgagtgcatggaagagtgcaggcacaactgctcttgcacagcatatgcttacgcgaacctgagcactgccagcatgatgggtgacacatcgaggtgcttggtttggatgggggagcttctagacctggcaaaggtcactggtggtggtgagaatctgtacctccggcttccgagcccaactggtactttttatcattccctgcccatcatatgcctctacattgtgattaatgcccatacttactccacttatgcactgttaagtattaattaatttgattacgcatttttttttatgctttttaacttgacccagagctttctaaactgttttataaagcattctttctgatctatgctttctaatccatttcatactgaatgggcaccttgctgaattaggcacttgttgctcttactctttagttgaggaagttatattaggaaagataatggtggtcacgaaacatagcctagtatattacgaccaattgttcagttgacaccgatttcagtaatttgttttttctagccgatgcatttcttggtcagtccagttcatgtaccattgacaggactcaaattggtatcctgctgcattagcaacttgtggcctatcttttggcgtgccacttctgctactatgggacccaatactctattgcccaatgtgtaaagatttgccaatttaccacttcctctgatgtttgcagacacactaaatctgcctgtaaaattcacaattcatctgaagtctgtagtagcatcaaatatggttaaaatgaaacattactaatagtaaagtgcatctagtccatgcacttgcaagcagcttatgaagagaacctgaaagtcccattctcttgtatggactatatttctgcagcagtcaagaaggagactgatgtagtgaagattgtccttccagttgtggctagcctactgatcctcacatgcatatgccttgtgtggatatgcaaatcaaggggtacaacaacactcacatcacttctcaaaatgcagtccatgtagttttgttagtaaaacaatttctatataatactgttcttgttaggcaaacagcgaagcaaggaaatccagaacaaaattatggtacaatacttgagtgcctcaaatgaacttggggctgaagatgtggattttccattcattgggtttgaagaggtcgtaattgcaacaaacaatttctccagttataatatgcttggaaaaggaggttttggcaaagtttacaaggtaaggagaagatatatcttgatatttcttttttttttaatgtcatagcttgacatttccagttaatatttggcttttacttgtttaattgaacatttggttgctcacatagggaattctggaaggtggcaaggaagtagctgttaaaaggctcagtaagggttctgggcaaggaatagaggagtttaggaatgaagtcgtccttattgcaagattgcagcacagaaatctagttaaacttgttggttgctgcattcatgaagatgaaaagttactgatctatgaatacttgccgaacaaaagcttggatgccttcctttttggtatgttctgatttccggccttatattaaatgattagtgaattagtaaaaatatatactgaatgatggctgacgatacactttgttcatgttaatattgggagatgctacaagaaaaacagtgcttgattggccaaaccggttcaaaataattaaaggggtagcaagagggcttctttatctccaccaagattcaagattaacaattattcatagagatctcaaagcaggcaatatcttgctggacgctgaaatgagtcccaaaatatcagatttcggcatggcacggatctttggtggaaaccagcaacaagcaaacaccacccgtgttgttgggacatagtaagtgatgcatgaattatctaatgcttaatgtgatcaaatttacatgtttactgattcaaacggtgcattcctcaccgcttaacaaacagtgggtacatgtctcctgaatatgcaatggaaggaatcttttctgtcaagtctgacatatatagctttggtattctacttttggagatcataagtggcttcaggatcagctcaccccatctcataatgggcttcccaaaccttatagcttatgtaagagcagcagaatgcttaatttcttcagctcaaacgatgcatacttttgtaactgattcttatattctgttggtgtagtcttggagcttatggaaagatggaaatgcaagggatttggtggactcgagcgttgtggagagttgtccactccatgaagttttgagatgtatccacatagcgctcttgtgcattcaggaccatccagatgataggccgctgatgtcatctgttgtgttcatgttagagaacaatactgcaccgctacctcaaccaaagcaacctatattttttgtgcacaaaaaacgcgcaactgaatatgcaagagagaatatggaaaattccgtgaatggcgtgagcattacagccttggaggggagatgaatgtttatatttgttttatccttgtctgtaaatttcggcattttctgcagctatgcgttattgtaggaatggtgattcattgcttctgcttttgaaacgaatataatccattatcaacaaattttgtatccgttgccaaatggacgacggacaattgtcctgacatctattgtagatcctagttatgtcagtgaaatgcaatcatcttattaagggcgcgtttggttggaggaaattgtttggatggtgggtgtcggagttttagaatgaattaggaaggagagtttgagagcaaaatctcaacttttcaatatgtgtttagtaacagttaatttggaggggattcccttcttaagtatgtcaggatatatctgaattgtatgtcatcacttgaactttaattcccactcaaactttgtatgattctcatctctactaccaagggacgagaaataaaaatgaaactcccaacttcctcctctaaactaccaatccctttttgttaagtcgccaaacatgccgtaagggttagctcagaatggaatggatggaaaacatcagtatagttccatcttctaatcttctatgccatttgtccattgcctgactgcaatctaaaacttgaacaagcccattcctgctgcatcggcccactcgtgggtacgggccgatttgtttggacccaagttgaagaaagggcccgtatagttagttattcgggcctacctttggagcggaatttaactatttgccacttttaggtttgccaattattcaaatatccctcttatgtttgtatttaataatttgtagaggtaatttcttaactatttgccacttttgcttacgtgtcatgccaccgtacgtgccagcgtgaaaagcaacgtggacctcacccgtcagcccctctcctcaccttcttctctatctccggtcgccgcccacctcccaccggcccgcactgaccctgagccgtcgtcggccaccagcccgcgctcgcccatccccccgccagccccgctcgccccgcaccgtcgacagtgtccaccaccactactccttctcgtctcccccgactccgatccgacgtgcctcgccgatccacgcgacagcggccggcgagttcgccgaagccatgccgagctcgccgaaggtcttctcctcggcaaccacctcccgccgcgccacgcttcgccgcctcctctccaccccggccttctccgccgcatgccttctctttggcctcgcgggcttcctcgccgatgcgctgtccatttgttggtcgccagggagcgcgccacgcgcctgctgccaggactcctcgcctgctcttcggctctgtcgcgtggggccagcggccgacgacggcgcggggctggcgggaggtgggcgacgaccgaccggagatagagaaggagaggagaggggctgacgggtggggcccacgttactttctcacgctggcacggtacagtggcacgtcacatatgcaaaaatagcaaatagttaagaaattacctctctccaatggcaaattattaagtgcaatatttggataattggcaaacctcaaaatggcaaatagttaaattcgggtcaagattggatcggtaccctatctgcctcttctcatgggccgaaaccgccgaatccctcgccgccggcggtctgctctccggcggctcgtcctccatctcctccgcttccctgacctcgcttcgcagccgccggccgtcacctcggtcgccgccgccgcggacaatcccgtcggatctactacaactgacggcgaccaacccgtctgtgtccatcacccatcgaggttaacgagaactcgtcgagatctcaaagcaaagcgaggaggagatctgacatggaagcacatgcttgactttcatcagagattcagaaaaaaagtgaataattttacagctgtgagcagtcggatttgagatgcagctgatagaaaccgttggaagtacaagggcttgacttccagtaaatgacaatgtcagcaagtgaggctcttgcaaatctctcagtatcaggaaggtaggaaagcccctttcaagtgaccatgacctgtaagatttcagagatctgctttcttcaacattgcagcctaactcagcccaatcatccacatttcatcactttgtcagcagaaaaagaaaatggcattcagcaatagtatcatattatagctacaaaaacattgtcttgctgatctttgttggatctgataggttcagttaacaggtggccgagactgagatgagtttgcagtgtagccttcttttgtcactgtcaggtactctcgcaagccggccatattgtgcattctggtggctagtcatgtaaaaatgttctaacagaattgagcatgcagagaaccaatgcagctatgtgagtctctgagctgacaatacagggcaaaggcaaaccggggaggcagatggtggatgcaatgcagatgtctagctcatggatttctaaatgttttggtaaataaagagaaaaagggtaatgctccttattgattgaccaaacttttatatatttttataatatatatcttctagatgtacatagtggttcagtaaggactgaattctattattgtgtttttgcgcatgatgttgaattgttcttgtctgctagctttacaggagttcgtcgcatttggtttaccatttcactaaggagaataacatgtatggttgtagctctcatacaagtgaaacttgaatcaaattccatgacagatacacatgatggttcactcagttctaagaaataaagggttcaaatagaattgtattcgtgcagtacaaatattaatggattgggtgaaaatcaactatttgacatatctccctctactttttggcactgaaattcttttgaagagcatttctgttgaattttgactctgtataccaaccatgaatcttggtaaaaagttcgttttgggggttaaaagctatggttttactcatgctatttgaaatttcaacaccctcaacagaaccagaattgtattggacatgtggtgcgttgaatttcttttgaagagcattggtgtgataaaaaaaagttcaattttctctggaaaaagggtaaaggcttcgctcatgcagtcactaatccacgcgtatggactcaactagaccataagggttggatgggagcgtatcctatgcacacatgccctcacgtgtacacaccatgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgttagattttttgttttttttgttacggctaaaatataatgaatttgacgttaagattttaaccctaggtgtaatacaattgaaagtatgtgtatgattttttctagatttttttgtgatattttttagttggtgtgcacgtgtgtacacgtgagggcctgtgtgcataggatatgttgccgggttggatatggtgcaatgctaccagcataagcatactggcatatatagaccagccagtcgaagttagcgtccctaacaagggggtcagtgggtaaaagagatatacggaattaccgaagtcagtagtcaagtcacaaaatggtaattataaaattattatatttgtgaaaatatttttcttgccaaattaaatggtttgcatttccatatatgataaatctaaccattctttgatataatactgagcaccgaaattataggaacttgacagcatacgtcaaaatatcttcctaatatgattttatcaatggatcaatttgcatttttcctatctttgttcatataataataaaatgcagtagatgagtagaatatgcccaagcagaagtgttcggcatgctgatatgcactacagaaatggaattgttaacctgaaagttctggaaataattaagcaaaagaaacacatgcacaaattcttgaagctctacttaatagcaaaacatgcggtcagatttaaaagagaagcaagcaaaaggtatcattaatcaaagagatggcacttttatttggtacaatcaacagagagaaacctgctacattacttaattgatccaccattgaatcgaaccatcaattctataacaaattcttccgcaactactcattgatacgatgcaacctagcaaccaatcataagaacctgatgatgatcagtacataattctgtcccctctcaactagccgattccttattctgtgatgaacctgaagaatgaatccaagtcttcaagcactcattccaaaggttcatctagctaactagctcagtgctttgctgattacagccacagcatcagtactactagggttacgaaattatcatcatacaactagtacgtagatacaatcaagaaacatcagatctcgatttgtgctagctaggcgactatattagcagctagctactcgatcgttaatttgacgcttctgatcagtgttcttcagttccaggacttgttcttctacctaataaagttggcaccaaatggagtccacagctcgacgggcacctcgctggcaacggcgaacgtgctcgatatcggcaccagacaaagcccccggcccttcagtgatatctcgccgtgcttggacttgtcaggacttgagttctgaaacgaaacaaatcaattgcagaagccatcatcagcactggcttgaacagagatgacacacacagatcgatcataagtacagtgatcgatcagaatgctgaaaaggagagcaagcatgcagcatccaacactggcaataccttcaagtggggcacttgatgggcaccgttcttcaagtatggagcactaagagcctgcagaaaacaaaacacaagacaatgttcaggtaacactgatcatcagtctctcttctctgaatctctgatgcatgattcatctgaagaaacgtgcgagttcgtgctccaggatgctataattaaaggtggggaatcatggtgtacttgcacacacttacaccaacttggtcgtgcaggaacttgatgtactcgatggtctcatggagcaccgatgcggtatccgtctgcacgcgcgcacatcgagaagagaataagattgtgttgttttgcatatagtgtatagatctcgaaaggaggaggagatcaaaaaggaagaactcttttgcacagaagatgttgatgcatagttccaagcactcttgttgtttgtaatatagtgcacattggccatcaaaagcctccctcacctttccaaaaggagagactagttgttggagcgctgtgatcctgtcccctagcttctccttcctaacctgaagtatattgcaatttgcacatacgaacaactttagtaaagatgcatctatatcgatctcttaaattgcatgacctatatattattgtgacatcaaataatgcagactgttttatactaattaaaccagattgagttcaactcatgatgcatagcagctagctatgtctctgtgagtatctatctaccttgaaggtcggcaatggcgacggtgtctcgagtctcggtttcttgaacgctgtctccttcttggtgatcactgagctagagtcccctactccttccatagcagtctacacgtatacacataacaaaacatcaatcacaatgccctaaaattaaagtagctaatgacagaactagctagctatcttgtatgcatgcatcatctatgtacaaacctttaatgcaagggttgctgccgcacgcggcggcgccggcgacgagcgtttggcagagcgaacgctagcttgatcttgcgccgccgccgccgccaccgccacagccgccggcatgccgaatccggcagaagggttccagaacggcgcgtcgttggtgaactggagtgaatccctggccccaactgcctgcgcgaacttggcagcagctgctggtgcgtgtcccatctgctgctggtactgatgatactgctggagtccagccaaagccggctgctgctgctgctgcttcgccgtcggctccatgaggctcctcagcagcgaggactggaatccgccgtacggcgacgtcggcgacaagagcaggtctgagccgaagctggacagcagctcgtggtggtgacctgcttgctgcagtgctaggttatttgatgagtgattcatcaagctcgacgcgctcatgtcatggtggccatcttgcagaaactcatgcagaccagcaccgttgttcctgatgaaacgtacacaaaatcgcatgcaaacatgtcaggatcgatctcagctaagctagctctccatatgatatggtagctagtacgagttaattaattggcttgtatatataactcacatgaaaggctgggtccagtcggtgaagccggcgagccccggctgcggcacggcggcgacggcggccgggtcggggatgctcgccggctcttggaaggtcaccgagctgttgttgccgggcgactccgacgacgccgtggtggtgctcttcgcctgcttgccgccgttgtcagctaccatgccatcgtatccagcggccagagccgacgaccaggcggtgtacccggcgagctccgtcgtcgtcgagcacgtcgccgccgccggtacccccaccgcgttgctccaccacacgccatgagagctcgtcgtaccaccgccgccgttgtacatcgccgccggagctgcgtgcatcatctgatgatcccccatgatcgacgaccacgacgatgtaataatctctatcctgaacctcgatcgatcctccgtttcttggctagctagtttcttcttgtggtggagagagctagcaagagagagtgagtgcttgcttggtgtgtgggtgatgagcaagttgcagtggtgaaggggaaagcgagctgaggagaagtagtggaaagatgtatagcttgtgtatatatatataaaccgtttggaaagaggggagatgagatcgaggaggagaattttggctgtctgaccacaccggagatgaggcgccggataaaccggccgggggtcgttgccggtcgtccggcattgcgtcaggttattctggtgcaactgatcatgatccagcggttgttcaacaacccacagagagttcagtactactactgcactaatggatgttagaagagcttaattccccttgggatatgtgtacttaatttagttatgtcagtagtatatgcatgcatgcataaatgtagtctatgcatggtagtcttagggttttgacatgccctagctagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgtgggccggcacggcacggcacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcagttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacacagttgggagtacgatcccatggttgctcgggaatctcttgtccggttaatcgccaggcaagatttacccctgaactttggggagtcccctgcttttgaacattacattcagcaatctcataaccctaggtttaaaactgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaataatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagatgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattactttttttaaacattttatttccatttttaatttttttttccttatacatttcctttgctttttttttaaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgctgaaacgggccgtgccggaaccgtgcccgtgccgggccgggccgtgccgcccgtttggacacctatagccctagctgcttgtgtactactgtaaaaaaaatgtaccagctttgttttttgtctggtaattaattagttggatcataattgtcgttcctcagaaagagcatctgtaagaaatgtagggggggtggatgtgtgcagtgtaactcatataggaatatagattatattattcctttggaattaattaaaaggagattagacaaaaaagaaaattccctttatttgtgccaaacatatcacatctagctatactgttgtgctatgtctagaaattcctacctccatttctttcttttttttattttacgatgttccagtagtggtagcacacactagtactagctagacatgccatttgtcagcaattttgagattctcttatatttattttttttggggggtacacaatattaatatcacttcaataattgattaattgatagcaatatgcatgcatgcttttcacgatagaatcaggataaatatgtcgaatcagtttaaattaatgtcttattatccttctgcaaataaaacaagcagtgaaagactagcgaataaattctatgtaatcaaaggcattgacctctcaaaagaagtcttagcgatagcaacagaaacaaataaaaattagaacgattagagggaatgtttgatgatatcacctaaccgtaaaggggtaatgagctgcggcacctaattcccggcctgtaccaagaagtcttgtttgtgtgtaccatagtcttcatcaattgctctaatctaactctctacgaattactttctcgttggtaattattgttaatcttcccatcaactttagtttattgtatagcatttcacactagaagataaactcaacgtcacaatctaaacacaaattacacacgtaccctctgacctctacaaattatattttatttgcacgcctgctgtcattgtagtatatatatgatgttgcgctaattaaatcatgtagtacttgagtggcatgcagaatgatatgcacatatactgattgttatattgtaagactaaacgacttattaattaaagcgggtatgtgtgaaagtcatttttcctatgggacgtccctcttttttatgtcacctaaaaagcggtttttttaaaaaaaatagatatatatatatatatatatataaattcacgaacatatagatttaaatttaatttttatatacaagttttaaaaataaaaaatgtgactgtgaatctcgcgcacttctcacagagtcacatccatatatacaagttgagattatctcctatcactactggagaaacccacgtcactcccagttcgaaacaccttttaatcctggatatgttaccgggatgcccaatccggaattaaagatgtccatttttagtcccgattcaaataactgggtttaaagataaatctttagtacctattggtgttacaaaccggaactaaagttttttttccttttttttcattgtatttttgttgtcagcatattgatttcacgccgaactcaccaacgtcacaaattcacagctaaactcaccaacatcacaaaattcacggatcaaaatgactacacgaattcatagaacattgacattactaattcacatgctcaacaaacaacacaagtccacacatcacaaaaccaacaatccgcacatcgacatcagcgttgccgacgacccctccgcccgctcggccgccgcctatgccaccctcccttccacctgcccgcccgggcaccgcctcccttccaccgaggagtgtgcggttgaatttttttttcaatctttggtcctggttggtataaataaccgggactaaatgttaatctttagttccggttggtgggactaaagatagtaaggcctgatgactttttaaaccggaactaaaaatgttatcaaccaggactaagatcaaaaaattcccttcagctttttaacagggactataaagataatcttagtcccggttcttattcgaaccgttttttagcgatccaacaaagattaattctctagtagtgtattagttgcctgaaaacatgcgtatgtgtgtaagaagtgaagatagaagagtgacagatcaaaataaatcaaagaacaatacacctctgtcccaagtacagtcgtagcatataacttcgcaaattacaaacttaatgagaagtaaattaatctcatacgtactcatatcagtttcgtttggaaaagcagattgtgatagaggaacaagaacccctcatgtcgcgttaggcatgcatcggccggcgatttgtcttggattcttatgattctgcctttctcctttttggatttttgtccatgtattatattctctctcagagttcagacctgcaggtcgacagtcaatgcgtatttgtactcttcgacgtttttgtttttcctcgccgctcgctcctggcacacatatacatccaatcaggacgttagatgcatggcacggtgcaatatggccaaattaagcgtgcatccgcccatcatgcatagtcaacacattattcttctacttatggtcaggaaaccatcgtattcgccgtagtacatagagagatcctctgaatgaagagactggttattgttctagctgtgagttcacgccaaaattgaaagtttggttgaaattgaaacgatgtgacagaaaagttagaagtttatgtgtgtagaaaagttttgatgtgatgaaaaaattggaagtttgaagaaatatttcggaactaaacacggcgctagtactattaaaattttgaaatgaaggcaagggcataagtcataattgagtactagttggtaatttagagtactcagcagatatataattaatgtactttctccttaaacgtaaattcttcatctggtttgcattttagcagcgttgctggacggctgatcttctccagaagcgtgatattgatagcactcagcctgccccttttgcacacagaatcttgagatggcgaaccacaccctcttcaactgtgtattcgctcgacagatctagcaccacatgttgtcgccctctggctaggttgccctccccccgtgacagctcgcttcaggtctagtggctgtcttctagggtctgcttatctaagcatcttcgcgccaacttcgactccccggtccttctcgtctcttggtagctatggaaggagtggaactctagggtattcgactctgcgctctcctcggtctcagtagttctggagtctatcctctcggagggtcgtatactcgtatgtggtcttctgctggtgttgctgcttttgggggcttattaggagtgtggtatggttctgcctccaccctcccgctgatcggagtagccttttccgtagtagtttttttttctttcctttacctggttgtagcttttgtttttttctccctccccccataggcatgtctgactgattgagttgtataacaaaaactcttctaatatattgacatgcaatgagcattcgcgaaagaaaagttactttctgctacaccataactaaggccagtgatcctatgcagtcgtctaggctcgtcgatttgtgactgataataatagacatgcgatgtcaatataatcagctaatattacttagatgatacccctgtaatttactacggaataaattttttaatgcattgctttgcccatatgttttaaattacatatttatcaaaatacttaacatatgtttacaattaaatagataatctgtcgtaataatttactcgacaatctgtttcaaacaaaatcttggaatattgtaaaagatgataatatatatgtttcaaacagaatcttagaatcttttctagacagacggtggccggcctaggctacaacacacggcgggcggcggaccggcggtacagcttaggcaattagttagccatagtagccagtttaagcgattgaagaatgaagaccccgggcgttgacgtcacgcttatgactgcggcggcgaaggcgtcaaaagcgcggggcccgattgggtcgcacgcgtgcccggaaaaagccagccgcccactcaccctccatcccgccttgccaagccacacaccacaaacgccacccgttctcattctctctcgcgcacacacgcacgcacgcatgcacctgcaactctgaacaacgcacggcactccactgctgctgctactactcgcttagccgatcgaccgatcgatcgatcggaacgccgagtcaaaaggcgggacagggacagcatcctcctctgaaatctgaatcgcggcgtccagcgacacaccacgccgtgtccctccctccccgtggccgggggccagcgacgtcgctgccacgtatcgacgaagctttgaccgcccgatcggaatgattggggtttggaatggaggtcaactttcgattcattccgttttttttcccctatcgagtgctgggggtgtttttttcagaggtgaaattactagtttatgttcagaggttgatctctttcctcctcccctgcctgcctgacttgatcgagtagtagtgatacttcaccggtaattcgcactttgcagaacctggagatgatgacagcagtagtagtagtagtaatctcgatcgatctcttggatgcgttttcgttgaaggattggttattagcacaaggtgggatggtagcttgacccataactacaaatatatagtattattatcatgctcgtgcatggtttgtgttagaagcgtgcaatcaatttcctcttgcgaacacttacttatcctgcctgtaactttatactcgaatttaccatttttgctagccacaaacatatatacagattttaatttatagagtctaatgttttgttggtggagtcgtccagtcgtagatggcaagctacgctacgctacgctgtcccccctgccactgccgtgccacccagggcacgaggtctcccgaaaccgaccgacctgccgctcgctcgctcgcgcccgcgcgccggctagaatggtccggctgccggtgtgcgaaacacggcggcgtgcgcgtgcgcgcggggcggcgtacgtacgtggacacgcacgccgcgcgctcgatcgccacggcaacctgtacacgcgacgagtcctccgctggctagtgcgcaccgcaacatcgcggagcaaaccagacgcgcgtgcgtgcgcgcggccgcgcgatcgatcgagggttcccggcctgtaacacgtgcctccgaaaccgacgaggccagcgacgacgtcgacgctgacccaagacccaaacccaacccggccgcggcgtcggtttcggaggggtaggaagtagcagtagcgccggcatccgtcgcgtcaggaaaagcacacgctctgcgacacggatcgttgacgtgttggccggtttaggctgggcgttgacacggccgggctaaggacagtaggacacacgagggcatctttgggctattaggctgagacaaatgctagtttcctactagctgtttgattcctgggtcgcagtgggtcaacctgttcgtcaaagtgtgctctgactttagaattagatcgacacgctcggagtctactcagtttgtcccgacagctgccgggacggttgggttgggcacggatcgattggagcttagctaagttgggtgagtgatctggcatcttgttttaatttcggcgtaactgtatggtaatgtagtgtggccgtacgtgagatcgatctagcaagcttgtgatctctgcgcctaacacacgtggttaggacagtggacagataacccaaccaagcaagaggtcaaccatacgtctgatgatgcttttaataacccatatatgcacgggattgttcacgagactgatctcatcacagtgggaacacatgctattgagacaaaacaagtgtacgccgtgttaatgatcttgaactcttaatgatgaggctacattctcagtactacttacctaacaaaacccactgtctagtgacaatatatactggtgcgcgcccgttacgtcataaacaaacaaacactatcctgtccataattaaaggcaataaaacaacaggttttgtgatgaataattgaatgcatttctatgttgtgaattcacttactttaatgatgtactcactctgtgtatgtgaaaccaaggaaaactctccatctgttttgttaccctttcttcagcagagtcaacactcgatggaccccgaaaactgctgcacatgccaacagttcaggtgggctctgacgaaagcccaaaggcccgcggattcgctatctgtctcgctgaccggctgggcccaccaaccccccatcgtgattgtgttaggtataccgggccagctgatgggcctgtcaagccagtgtctatcgcattcatagcctgggtgggcgggtcaaaccctttttgacccccggctacttcgatcgttttcacaactctccttttccttttgtcctgcgaaaaaaaatttcttgtcgagtcaccttcggattattgcatcagtttcctgtgtgcattctttcctcgtcgctgacgaaaccattgcgtagatcgcaacaagaactaattaggcaaaacttagtgtacattcgttttcagtttctgtgtttgacttagacgtttaattagcaacaggtaagagtattttctctgcattgtcgtccatggcaagcatgcgatgatctgtgaaaagtagccgggatggcgtcggatcatcccggccgtgatggtcgccggcggccggggccaagctgctagctagctccgatgtccctacctgacaatatatatcaaccgacttgatgaatgccctggtgactactgacaatgggaatatacttggtggtgcttagcttattgggcactaccagcagcatgatcacagaaagggcacttccacacacaaaaaaaaatgttttactgtatatatgattgcgtttcgtgacgagttcctgcacaatgagatgtacatagttctgtactttccatgcattatacactggggcagctgtatatggagccttggacaccactacatcagaagatgggatcattcttgaaatgattcctttgacgcgcgttgtatacaatgttgacaaattaagcatttatattttgcttcacatcattgtgcacaggaacctgctatagtaccctgttacctaggtcttcactgatcaagagtactactgtatatgcaccaagccgccagttgctccttaacctagagagcgtgtgggactgcaatattttcggtgatgaaaacgtagaagccagcacagcacgggggcgtcaggttcatgtatggaccgaccaggtgaggacccaactaattggatgccccatatcattagctatagcactactgcactaacacagtagcagtagtccaggtatgaaaactgtgaactggcgcccgagctttatgtgaattattaggcagcgttcagatagtcagagtgctcataagatcacccagaagactttcttgaaaagaaagtagagatcatacgatgacacgtcttctttcacaagtgaagataaaaccacaaatgtgttcgcaactttcaaggaatctcaagtgaggcgtcagagggatcccccggggcatggcgaaatggcccggactgttgcctgttggcgccatgtgcgcgctacagcctttgcgaatttagtagatcgaatcatcgaacgggattcgattactgcatgctggtctgggtcgatctctgggagaggctctgggctaaccaccgaaaggaggaagcctttgcagcgagacatatggctcaatcagctcctccattaccctgcagtgcatggatgtccccgcagcaacaatgccacggatcatcaggcccgcacgcatactcatttcagtgcaaaaagggcttcagccttcagctggcttttcacgaaatatttcgtggctaactggcaggtccttggatagaccatgtgaggccggtttggctgttcaatggagcatcctgtttagctaggacttggatttagggcctgatcggaactgctatctgctgctgccgctatggctgtggctgtttttcagctgctgccgctgcagccatttttagctcttgcagccacggttgctgcagcagcaagcagtatcgatcacacccttaattccagcaatgctgtgccgtacgacggtacgaggtacgagcaggtcagcgggtcaccggtgttgtgtgaagctaagctgtattcactagctcgggatagttggcacaaacggcatgaaaatgtggcgccgtaaataagtgaaatacagctgcgaactttttgaacacgctgcaaacatgcgacggagaaaactcaatgcaaaacgaaaaaaaaaattgggagcctgtcagacaacctgagagccatcctggccaagcgaggcccggcaaggaacgatcctctacagccgtgggatcgaatcagccagtgacatgatccggccgttaatcacgctctggcccacaggtcatgcgtcatcaaccaagcttgagtgcttgcctccttattagtcaaggatgcaacggtacgagcctatagaacagatcctgttcaagtaaggtcgtgccatggatcatctgcacaactcttttaaaccagctttgatctatgtggatagccgaggtggtactaatactagtctttgttgtcctccaattgcgtaatgggccggcccatactgcaatacatgtcctgaaaggcttcatggcccactacgaaatgcttttctcctacagtttatcttactccttcacatagccatcacgtggttaaaaactccacctgtaaacattagtagatggaaattgtatccaatagtgtactgtcgtactgatccgtgcccaaactgatgataatgcaatttaacatgggggtttatgtttctgaggacccagctgatgtgatcagggccttgacataatcatgaaagatgctgtaatttaatttcgtccaagtctggacctgcatagcagtcttcagggcaatccctttgataaaattttacacaatgtcacatcgaatgtttggatacatgcttagagtattaaatataaacgaaaaaataattaatcacatagattgtgtgtaaattacgaaacgaatcttttaagcctaatcgcgccatgatttaataatgtggtgctacaataaacatttgctaatgattgatttattagacttaataaattcatctcggggcgaattctgtaatttattttgttattatactacatttaatactttaaatatgcgtccgtatattcgatgtggtatgtcaaatctaaacatagccttagtagtaccactatgtatgctcacttaatttcactagttaggatttgtcttttttagacggagggagtacgttgttgagatcttgtacctcagatttgttgtgtatatgcatgatgtgactaaaacaccttaattatcagtccaatgctccgtagcatgaacttggatttccatttattacgaggtagtccaaatgatcaatgtgagcagcagaagtatcaattgatgaatgatcaatgtgagcagcagaagtatcaattgatgaaggataataacacactatgattacaaaaatctacaaattactgtttggattgtcatgcggatgacttgggcttgtcaaagattttactgttagtaattcaggcttctcctaaatattgaaaaaacggcctaattaatggagtggtgaagataactgaaaaaaaaaatgatgcctgtcagacaacctatgggccaaccctgaccaagcgaaagcccggcaaggaacgatcctctacagccgcgggatcaattcacacggaaatgatccgggccgtcaatcacgctctggcccacaggtcatgcgtcatcaaccaagcttgagtgcttgcctccttattagtcaaggatgcaacggtacgagcctatagaacagatcctgttcaagtaaggtcgtgcttagcggtcaaaggttttgcattttaagctagattcatttcttgaagacttccgaggtggtactatgtttggcaaatgacgccctcccatgttttgttttgtattgtctcaaactctaggtctgtgcacatggttgtcatgtactgggctgctgggccttccttcctaaaatgaacccaggccttcggctacaccatggagccgtagaaagtggaaacatggttagtggtaaaaacagttacagaaattcttaaccaaccaaaataaactagtaatttgcccatgctaacgctacggcgatatctagcaaattttctacttaaaaattattttactatttcgaggtccaaatttatttaaatattattatcacaaaccggagtagctctcagtatgaaagttcaagtcgcaatcaagagaagtaatctgttcactattatttttctacttctacatgcataaacaaatatcaattaaaggttttctatttttttcatcaataatcaccatttgtatcacaattctctatccagcatttaagaaaggtttaaaaatatgtatggctatttttggaaatatcatatttgatagagaacctccgtccgtcgctcctccgttggcctcttcctgtcccagcgacagtacgccgtcgatcttcttcagcgagccggcatgtctgaatgccaccccaccgccaccccggttgatgctcgggccaagctttccgcctccgacggcgcccccgtcaaggatccgaccgagtacaggagccttgcaggcactctgcagtacctcactctcactcggccagagctcgcctatgctgttcagtaagtctgcctcttcatgcatgatccacgggagccccaccttgccttggtcaagtgcattctgcgcttacgtcaaaggctctctccaccggactccacatcagcaccggccctgtcaagtctctgacggcttattctaatgccgactgggccagctgtcccgactcccggcgctccacctccggatactacgtcttcctcggcgacaatccgatctcttggtcttccaagcgtcagacgactgtctcccggtctagcgcggaggctgagtaccgcgctgttgctcacgccgtcgccgaatgctgctggcttcgacagcttctccaggagcttcatgctcccatcgcctctgcaaccgttgtttacggtgacaacgtcagcgctgtctacatgacggccaatccggtgcatcatcgtcgtacgaagcacattgagatcgacattcacttcgttcgggagaaggtggctctaagacaggtccatgtgctccatgtaccgtcgtcccatcagttcaccgatatcatgaccaaggggctgcttgtgcagttgttcactgatttcaggtccaatctttgcattcgtgatcctcctgttgtgactgcgggcgggcattaggaatgtatagccatatatgtataggattcttttgtatccttagcttccttgtatactcctctaaggatcttgtatattggaaagactataatatatggtcacccccctcattggggagagtggtgttctctcctattctctttacaatatatatgttaatgaatctagacacacattaacatatatatatcaatgtgggcaatgctagaaaatcttataacctaaaacggaggcagtaatatatttgttcagaaataacgaaatgctctattctcattcatcaaaagttgcaagtaacgattgtggttacgctgttatacccaaattaattaataatggactaaaaagctatggttatcctttaaaatgatttagtagagcgtgtacacatagatggtaacattatctgcaaacgatatatgtaactcgttttccctaaataaataattttaattaagtacaaagacatagaattaaaatttttatgcaattaagcaagagatctgctggttgcctgggcatataaaaggctaaaacaggttagtgcatactgtgttggagtcatgattgtcaatacacatagaaaggagattcatggactgaattgcttgctccaagtatagacaagcatatgaatcagctccattttagaccagaaaatagtgcactatgcatctcgaaacatatgaaagcccctcattcttttttttttccgggttgaaagcctctcattcttcattgttaagataatgttgtgctgcttttatactgaataaggtgtgtagatcaacgtcagcttacagttgaataggacttagcaaattggtaaatgatccaagttaatgagctagttttgcaatttgcagtacattcagttattcagacgatcgcacccgaacttgcagccatatatagtacgccaaaagaaaatccgaatctcattctgttggacatacctggtccaaatcgaatttctagaaactaatctagacagcaatgagcatttgtttcttttgcaaggacccatgaacaacttacagaaagggcatatcaaacattaaagtatcaaagtaagattaatactattgttttagactaatagagctttgatagccacccatcaagaggtacaaggcaatctatgaattaagaagacctaaattataaaacaagaaacacatatatattacatccaaatcaaggtctccaaaatactgctacgtacttatttgcaaatgcatatccacatgggaaaaaaaaacgtgaacagtgatttgacaaactgatatttgcactaagttaagatagacaaggttcggcaaaaccctgatcaatctagtttgtgaaattaatctgaattatttctctaaaaaaattaatctgaattctgaagctctttatacaaggagcagatcatgatgatatatgccatagacaaatcactacttgcagtgcttctcccctacttacatactcatttactcacacagaactcaacacttcctgaagactgcacagatcaatattcatgtttctcaattctgaacattaccgatcgatttgactttcttaccggaaccatcatacagttttgtagaagtgattttagcaggtatagacaagcacgatataagctagcacatcaaatggtttggtctaaaagattttaccatgtcccagcagcggaacagcacctcgccatggttcgtgtggaagcccagtgggcgtaccttgacaccaagcatcactgacagaacagatcaggaacatgtaatgggaaggatgccacgatccctcagcatatcaacgaattaaatcaagattacagcaaaagctcatattaaaagttgttggcctataccccataatacaaatgaaatgtacattcagactttagtaaagtgccacaactccataatttggttaagctatcccatttgcagacatatcaacaaaaagaacgccacaagtctcatctatggcaacccgggcggctaggaaattttgcatgcaacatcaagaatcaggtaaatttgagataaatgtacctgaccttatccgcaaattccactgctgaagcattatgattttgaaattgcaagatcaaattagtggaagagcaagcagcagccgaccagggacgaaatgtggtggggcgttgcgatctattgaccggcgagttgggtagacagagaaccgcttatggcagccgaccggttacggcgatcggtgcagaagggtgcaaacgatttgtgggttgggttggagtctgggcttgggcattgcgcttgaccctcgccccattctctagcaacagatcaatagggaaaggaggcgctatcggctgtatcggtgacggcgaccaacagattttgacggtctctccatggtcatcggcaaaggacttgcacgtggcatggtgggcagagagggaaacgagggtgtcgtcgcttcgagtgagggcgacctaggcgcaaaaattcgcgagacaatgaggaattgaggaggcgcaatctgtagcgtggaagacgggaaggaaaggggaggaagaatcgcgtggaagacgggagtcgggttggggttatggtgcgaggtgggaggtggagatgacatggagcgttggatttcacagggatgatctcaaccgttgagtgatgaatgtaagagtgtaagagtgaaagatgagtaaaacaagttggtgaattatagggtagatcagcaggtagccagttagcaattccttttattttactggtcgagttatatggaaagggttaccgacaaaaatgaaaacggaaacaattttgctgttatattttactgtttctaaatgcgccatcatatatatgatctaattctttactcaacccatagtctatagtatcgtcaattcatcaatcaaacccctaatctattgttgaaagaaagacaaattgtaatttacatagtgtaactttgattttatttcatcagaacatatagctatgcaaattgaattgtgatttttatggtcaatgtttctgatatttcttaccggttttccgttgataatcatccgtagtatcagttgtttttttttatattttcgataccgttttctttccagtatttatgttttgaattccgtcttcgagaaaatatagtgatggatacgattgaaacgttttctggccgttttcatccgtagatacagtgttgcctcgttcacaggtgtacacctagcttggagctctctcgcacttgctgcattcaaaagcaaaagcaaggtattattacgtctccaagttgcgccgttgcggcacatctgcatctgtattttcggtggtatacactagtcctacattggtacagaacgtgccaatcaatcactcgctctgcattccctctacggtctaccactctaccggcatacgtatagtactactgcgacctgtccagctgtgtagctggcaaaagaaagacaagccgagagagtttggctaaagcgaaaactaggctggtcccttcagaacaaagtgagcatgcaaaagagggatcaaggcgaaggcaagagcatcatctcgtgaccatctcagctgtttcagtattctgattctactgacccgtgatgaggaggggcaaggcaaaagcctggtcagtcctagtactagtactgatcgatgccttatctcttcggactctctcgtcctgcaccccaaacagtgagatctgtaatagtaataatgtacgagtcgatcaaatggaccacaggtttattgtacctctcggtacacctcttcttattactcggttgatctctgaattaaagccatcaatacatcagtgatctttcagatggcattcattgatttttcaccgtgaggaggaccaaatgaatgaatgatggcattgggcatttgcatttcgatttgaagttaaaagtgagcatcgtccagatcggaagactgaagaaatgcagcagcagcagaacagcagtggaagccgagtaacaattttttacagatacacccccacagagacacagaattacgatgaactaccatcacctaagttcatctgagataaactacctgccatttgatttgctaaccaagaaagaaaccagcagttccatccatcgatccatcctaaccggcgacgagatcgacggtcaccgtccggcgcactccggcggctggacggggaagcggtcggtgtcgacgcagtagtcgtagacgaggtggtgcgcgcgcgcccacacgagctggtggttctggtgcacggtgagctcctccatgtccttctccttccaccagtacctcccctccttgccccacgagctccccgtgcaccgcgccacctcgccggcgtccgagtccgtggcgttcgccgcccacgcgcaaccctcgacgcggacgtcgcggaacgtggccacgaacggcgcgtgcgaccagtccgtcttcacccgcccgccctgcgtcgcccagtcgtccgcgttccagatggagctgtacaccgacatcggctgcggcgacgggaacggcggcacggacgccgccgccgatgtggcgttgctggtgccattggcggcggcggcgtggcggtggtggcccttgacggcggcggtggcgttcttgttctcgtagacgcggatgggggtgtcgtcgacgaggaagacgacctggctggggttccagagcacggcgtaggtgtggaagtcggcggtggggtcgaaccacaggtcgatgcgctgctcccggttgccgacgccgtcgatgtacaggttggtctgcaccaggtacggctcgccggtgacgttgcccaggaactcgaagtcgaactcgttgtgcttgtccccgccggacgacagctgcaagccaaattcagctaaatttagttttaactccagttaattaagtaatggattaatcgggggtgattagtgaaaagcggccatctttaaagaacgttgtcctattgctgcacgagttcacgtgccgctgttctttgtaaattgattcttggcagcttcccccgacagacatggtcaagcatgtccccaacactgcctcgaaaaacgtttgtactgtatttactacagtagtgcatactactaatggtgtcatttaccccagttaatcttgtttaagctaatgcaggatgaagaatcaataatggcaggttcgaagcagatggaggaaagcgtagcgaagcacagagcacagcctgatgcactcactcacatagaaagcagtgacaactccggcggaatcccccgccacgagcttcaggtcggcggtcgccttgccgtacaggaacttgctcttcgacgcgaacccgccgcctgcatccacaacacaaaacattctggtcatctgtcccccaaatgcagatcgagaacatcttcacccattcaccacaaaaacttcaacggcgaagacgatgaacagttgaacacgtaccggacgagctgtcgaggcggagcttgaggaggtcgccctcgtacacgacgtggtcgttggcccagctcggctccaccacgtcgtcgaacttgcccgccgccgccacaccggcggcgcacaccaccgccaccaccaccaccacgacggccagagacgccattgtcactgctcacttgctgtgctgttcgatcgactcgactgatgggctcaatctcaagctgaagctgggtgcgatgtttatataggcgagacgtttggcttacggtggaagggtggcacgtgacacgagggcgccacgtcggaggccaagctagccgttgggcaacgggggacccacgcgtcaggagatagggaccagtggtcagtctagcgctctactactactacagtctgcgtgcacagctcagctgctgtggatttctccaacttttgcggctttgttcacagcgagctttcagcacgcttgggcctctttagttccccaaatttttttcccaaaaacattatatcgaatctttggatatatgcatgaagcattaaatatagataaaaagaaaaactaattgcacagttatgaaggaaatcgcgagacgaatcttttaagcctaattagtccgtgattagccataagcgctacagtaaccacatgtgctaatgacggcttaattagtctcaaaagattcgtctcgcggtttccaggcgagttctgaaattagttttttcattcgtgtccaaaaaccccttccaacatccggtcaaacgttcaatatgacacccaaaaatttccttttccccatctaaacacaccctttctttctttctttctctcgctgagctacgcggctactggccacagccgctgtgaccagtcggggaaagaattgtttctgcctcgcttgctcttgcttgctcagcacagctagccagctagccgtacgtgaaacagtacactagttggttacagctggcgagtgggcccgtatgtaggactagtacgtgacacggtaaagagaaaaaaaggtgacagtaaaaacagcttggcccaaacagagtcgtgcaggggaagtagaagatcagcgatacataaagtgctgcgccctctgttgctagcctgcttgcacttgcattgcacggctagcacggcttgatggagtctgcaggatggcttgcaacggaaggagcattcaaaaacctgatgcagatctattgacccacttacccgtgtggattatagtcaagtctttgattaagtagaactaacacagcagtacaaagtatcactatacggggtacttggattagaaatgtgaaatgctagatgttcagatcagaaatggaatctcagctgcagcaactatactacaagcagtaaaaaacattcaaggatcaggcggtgacgtcgaagcctaataccagcaccctattttaaggctgtcaatccacgtgattagccaatttagttaatgctaatcactcgattaggaacagttccccaggagggagcagggaggcgtaggctccagctgtgaatgagcagggagccatcaccaccctttatcaaaggcgcccccccggttgtgaaaaaaatgctgcgatgcgatcgatggcatgagttttggtgcagagaacgacgatgatgcctctcctgccccgtcgattttttactgcagagaacgaaactcatgacgcatcattccacgggctctctcctcctcctcctttcgctttcgcgacgccccagccgatgcgcataatcttttgtccttgtcgagttcacacaaaagtcacaaaaccgctcgtgttaacgttacagtttttaccgcgccatcagagtttaatcgtacgctaagcttccattttagtaggactagtgggcagtggcttactggctttcatcccccgcaaatctgcattgttcttcaaggaagatacagtcggaaagaggtgatatatggctcatgctggtatggtacggtatggaggatgcgcataaccaatgcgtgcttgcctggtgtccatttcaatcgtgattagctttcggaaaatgatactctcttcgttttaaaatataagtatttttagctatgtaaaaattattatattttaagacggagatagcatattacagtattccattcgaattcaaacggaattatacatcagagatagcagctgatattaggtatcaagcttttgtccaaacagaatatcaaccgataattattggatacactcatttcgtccgaacggtttaccattctgtagtattttccttataacctttactgtactccagtaaagatatttactgaatgtggggacattcctttacagcggataatagtgacatcacccactgaacctgcaataattatgcttttctcccgtgtacaacgcgagtactctccccgtctcccgtgtcccgtccgtggaaaagcaaaagttttgggagtttggactcatcttttcaatccgcaacttttcgaagtgaaaaccgcaaacctctcctgctgctggaccccctctccagctgtcaggtctcaagtgtttgatttttgttttcaaatttaaaaattgtaccgttgatggtagagacaacgtttagggcgtttaaaggatttctaaatgttttccttttaaaaattgaaacctttggattttttagtattaaaatggatcaaatcttatttaacttattttgagacaaggggagtagtagtaaaattgtgtgtcatactatctcatactcgtatctcattctaaattagtttaatttggaatgtaaggagtactcttgtcaacattagcactgccgcactaaaattgttacgtgctccctctgtcccattttaagcgtagtcataagttcttgtgtgcatctttgatcatatatcttatttaaaatactttttaaaaaattaaagaacataagtcatacataaaagtattatttatattttatcatctaaaaataataaaaatactccctccgtcccaaaatgtagcagcataggatgggatgagacccattatatgactatgaatatggacatactcattacaaaaaaaggttaaataagacagaggatcaaagttgaacacagaaacttatgactgcacttaaaatgtaatgggggaatatcattttgtgtggtactgttactagtgtgctaacagctgtataagactatgtttagttcacactgaaatttggaagttggttgaaattggtacgatgtgattgaaaagttgtgtgtgtataaaatgtttgatgtgatcgaaagttgaaagtttagaaaaaaaactttagaactaaggctgtgtttagttcagcgcaaagtttggattttggttgaaattgaagatgatgtgactgaaaagttgtgtgtgtatgacaggttgatgtgatgaaaaagtttggatccaaactttacatctaaacacagcctaaacagcgcctatgtatacgagaaatgaatgtactcgtacgtacatatacggccaccgtatattatacaattatccgcacagcaccgtgcatttcacagcataaatggccgtccaatcaacgtgacccgaatgctctgctctggacgctgcagtttttgagcccattttttacctcgtcgtcgtcccggtgaaaatttgctcccgccacggtgcgtcgctgttcaccgcggcattggataggttgatatggacttgctcggcttgtcccgttgcactcgtgacgcatccgattcaagtatgcagtataccacacgagctgcaaccgctgctcgacaacgacctgaggctggctgtaaacgtcgttcgtgcacgcttcagcctgcagctcgcactgtgcttctcccatctcttgtactactgataattgtgttcagcggagcacagtaaactgcccccacggtacggagtactacgtacagtaactgctctagtaactttggaagtgtggtttaagactgtcagtacgtgaagctaatggtgctcagaggaggattaattagtcctaaatgagttgtactacatgaaaaaaaaaagaacacgtgatggttatggctagtggctagcccttggccattggcagcatcgtgttggcagtgacttgacagggttggctcggcgtgtgtggtgatgatgtgtgatgagatgatgggcttctgtgtgtcaggcgtgcgaaattattgcgaaccagctcgcgtcacatcgcattgagcacagtaccgagtgactactcccgcggcaatggcgttgttgttggccatggccgggaaatggatgcatggggaagaagctggacatgtcgttgcttccatttctgaattccttcagatggccacttgcgtctcaagcggtcacgcatttcgcatcggcatggaaggtagaagtaggagtatactagggtggtaagcaggtgatagagatcagatgtcccgtaggatttgatcaaactattatgatgcacatttcaggttattcagctaaccgatgtccccagtatataactgagtctaccgttgccgttgcagatccaagatgtgggttaagggctgtgtttagttggatccaaagtttgtattttggttgaaattggagatgtgactgaaaagttgtgtgtgtatgacagattgatatgatagaaaaggactgaagtttgaatccaaactttagatctaaacacagcctaagtgcacagttagtattctgaagtagacggcgctttatagtcttgtaccggtgcagccaacagcggctctgttcctgctcgtttcagtgtttggagttgtttcacgagtaaatacggctagtggctcagttaactacccattcaaacgacaatgaatttcgatcaggtactcacagtagtagttactggtacgaagcaggtttcatgatggaggctgatcggttcagcgttttcattactagctcctgaatgagaaaggaagaaattaagacgggaacagagcaacacagcaagtgtagtcaggattccgaaagaaatttgctgtagctgtactgcttagtagacttgctgtggtagtagccagggcgactcatgagcgtagtcacaaaagcccagcccaaacacggtgtttccagcggaaaacggcccaaaatcaatttgtctccggttgcacgagcgaccaacacgtagaagaatccaccaattcccgccgattccgagcagaatcactcgcatcacatgcatgttttccatgatcattttaggagggtcttctccccttcctccaggccggccatggtgtcgtacatgggcttgttcttcgtctccggcaggcagaacacgaggaacccgccgacgaggcccgacacgccgaacagcgcgaacggcacgcgctccccgagcaccaccaccagcggcgccaggatggcgcccatctgcgacgcctgcgacgtgcaccccagcgccgcgttccgcaccgccgtcgggaacagctccgccgtgtagatgaacagcaggttgtacgtcgccgccatgccgaagatccccaccaccccgcacgccagcctcgccaccctgccctctatcgatcagaaatttgttcgcgtagctgaatttgattggatgattggagattacgtatacctcatggcgccggcgccggcgatgaggctgccggcggagcaggagatgccgctgagaagcatggtgccgatggcgagcggcttccggccgaagcggtcgaggagcagcgcggtgaggaggtaggcgggcatctcggcgagcgagttcaccaggacgctgacgtagaggttggtcttgaggttgacgacgttgaggctgaggccgtagtacaccaccgaggcgagcaggttgatcaccaccgagagcaccagcctgaacctcgtcgtccgcgaccggaacacgtcgatgatggagcccgacgccgacgctgacgagtcgacgaccttgcctgcgccggcgccgttgtcgtcgtctccctcgtcgtcgagcttgagggacacgtcgtcaggaatgctcctgccattgctggacgcgatggcgcgcacgacgcgcatcgcgtcgtcggcgcggcggcgcacgaggtaccaccgcggggactccgagacgaacggcagcacggcgacgacgaacacgagcgacggcagggacgtgaccacgtagagcatcctccaggacgtcgggaacagcgccgcgatgccggcgagggcggcgatcccgccggagaagaagtagaaggtggacatccccgcggcgccgcgtcgggaggggccgacgggctcggtggcgaggacgaaggagcagaggccgacgctgccggcgctgaagccggtgaggaggcgcagcgcggcgtacgcccagtagttgggcgccatcgcggtgagcatgccgaagacgccattgaggacgcagaccacctgcagcgagcccttccgaccgaggaacgaatccgataggtgtccgaacacgccggcgcctgccaagacaacacagctaaaattatttctacttcttttttttttctttttctttgtggaactcagctacaattacttctgtcaccaaatcaaaaaggaaaggaaaactggcccatcgactgtgtcagctactgggccaaggcccagcctaataactagcctacgttgatgatgaaaattaggcccaaatgggccaccagcgccggcgatcttgactggttaatgccaccgccgaaacagacatggtgaagtagctattagtagttctaaaaaaaaaaggttaggagctattgatcactaccaggattcgacaagcttgattttggtgattatgtagtaaccgatataatgcgattcaaatgatttattgatctcacatcttggcttccagtccccatccaaaattccaaagataccggtgtcaggcagggagatgctagtaccagtcaaaagattcgaaagtatatcttgttctggccaatccaaacaaaaagcttgaaaataacagctatttaaacatgcgctgagaaacaaggaaggaaatttctgcgagacacaatctgcatccggcctattgccacgtgatttagatcagatcagccgaactagacggctagcttttcatcgagcaccgtgagataacgtaatcaattcagtgacctgatcaattatattgacagtaggttaacaacagtgacaggttgggctaaagcaaataacgacagtgagcgcagccacgcatgcaggaacccacggctaacagggtccaggcagcatattgggttcgatcgatcgacagcttttggaattaaagttagcgaaagatgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaatgaactacagtagcacacgctgggatgttggctggctggctggctggctagctagctccaagatgcggccgtatgcaaccaaactagctggagccacacgtacgattccgggctgcaaaaatgcaccaccacgaaatctcccggaacgtcgcggtctgcaatccatcgtccaatctagtttgaaatgctagcctatttttgtttcacggattagtctcgtatattacgtattgcctctcacgtcgatgccacaattaaggcaagcgtttcatccaatcttagtattttgcattttggcattccgttgcgtaattcgtcaaaaaaaaaaactacttggaaacgaaggtaatttggacgagaattggagcactgaccaatcatgcatccggcgaagaagatggcctggacgaggccgaccttgtaccgctcgccgcagacgaggccccactcggacaccgtcgacgaggcgcgcccgctggcccactcccacccggtccccgcggcggcgccggcgccggcgcagcggtcgccgcaccggccgtccccggcggcgcacaccatggccggctcccggtcggcgaagatgatgaccatggtgtgcagcgcctccagcagccacgccgacgacaccagcacgaagtgccgcagctgccaccgcccgaactcccccgcgtgccacgccagcgcgtcgtcgatgctcacgcgccgcttcacctcgcctccaccgccaccgccgcctccgccggcgaggagcgcctccgtcgacatggctatccgctcggtcggcgcgcgcgtgtgcgtgcgtgcgtgtcgctcggtggcgtggggggcgatgcgtttttgcacggtgcgccctgttgtatttgtagggagagcgagttgcctgtgtttgtgagttgtgtactttgtgtgagttgtgtgtgttttgtttgttttatttggaagttatttacgcagtttcttaactctgcttactgtcaacagttgcgacaaaatcatttttctggactactgctagtacatgctcttccgatccaggatttggatctacagcgtatttgtcacatctggcgtggtgattaccatcgttggatgcattagggctgagtttagttctaaaccttttttttttcaaactttcaactttttcatcacgtcaaaacttttttacacatataaaattttaactttttttgtcacatcgtttcaatttcaaccaaatttttaattttaacgtaaactaaacgcactccaaggtgaagtatctttggacaagttggaattggaagactgtaattgcgattggctttgcattttacagtcatgtactagtacttgtgtgctttttggacaggttgccgtgctgcacaaaaatacctatccgataaggcgactttgaatctaacatggattaagtatggcaatgcatgccgtggctgatatgggcgcctgcgtttggttgtcttgagctgtttattagtggcgtatatatgctcaagagaaatgtgcgtaatgtatttggtctactcatagtccaaccagatgatttgagaagtcaattttttatatctacaaggctttatccggctgagaagaaaaggattgccatcgatgtatcggagtggggcagtgctgcactgctgcccaagtgcccatagctggccatgcccgacacatccctaatgataaggtttttttttttcatttttatggagaactatgattatttagttcggcagctatatattgagagaagatttctctttaagaccgtgttatgcagttgtacactgagaaaagatttctctcattctctgcacacacgtttcccgaactattgatggatttttttaagaaaattatatagaaaaattattctaaaaatcatattaacttatttttaaattcaagatagtttataattactctccgttttaggttataagacgttttaactttggtcaaagtcaaagtttataggtaatatagtaatatttataatactaaattagtttcatcaaatcaataattaaatatgttttttaataaatttgtcttagtattttttttacaaaattgttcaaacttaaaacagttaaaacgtcttgtaatctagaacagaaggagtaataaattatatactaatacttcaccatacgttccttctaaatcttctcttttcctcgtgtccaccatgcgctcccttccaattctcccgtcatcgatcgagcacgtacgatcgtgtacgtttttttagtcccacatggtgtccgcccgggcagtggcgttctattcgctcgcgacgtctcaagggttttggcatgcagtagtagctgctgccaccacgtcagtccaagtccagcacgtgtacgtacgtgcaggatgtcacgactcctgcgttggatcttaacgccgcacctcactcgctccgagatcaatcgtcgtcccgtccggatcccatcccggccgcgcgcgatcgattctgcacgcgtcgcgtggcgtcgcgcgcgcgtggcgcacgcagattcaccggtacgcgggggggctcatcgcgaacagcattatgtggcggtttccgctgcgatcgcgggtgcctgcgtgcggagtgcggtgtcgctgttgcccgtgcgggcgtcgcgtcgcgtggtgtgattcagaatcgtgcgggatatgacgcttgcattgtgatgggcctaatttgtgcggccgatccatcgcttccttatttgtagtagagcccataacaatagaagtacttatcgtatcttgccataccgtgtgtcgtgacaagtactaacacaccacgacaatgacttcatttcacacaagagtgaccagtccaaactccaaagtgaaggagcatcatcagcggttcattgcggtagaatccccaggaccttgccatactcgatgaggtcgtcaaatacctcgtccagatccgtccacttgaactcgaacccttccctcaccagcttctccgacgaatagcacactctcggcttctcagggaacccttggaagctgccaatatacgcatacaagagacgatcaccgattcaccgtcagttctcttccctgattcaccgtactacctccgtaaaaaaaaacccaatcctgaatttatgtccagattcaaatttagaattggattttttttaaaacgaatgtagtagaagtttgtgtcgctataactcgaaactgagagtgccagattgccagttcgtacgtaagtacgtacccgtcagttttgacgttgtaccgagggtgctttcctgccacgaaacgggcgaatgccacgacggtggtgctgaggctgctgcagatgtacctccccgacgccgactccttctcggcgacgaatacctcggcgcggcagaggtcgtccacgtgaactgtcggaatggggccggttgctgccaggcctttcagggtttttagctgcgtctcatcacctgaaaaaacagaaaacagctagcatcgatcagtcgaatttgtgctcgctgatcttcttaaactaatttggcgcatgtctctcgatcaggttctcactagatagcaaggagagcatagctgagacgcttgttgcggccgtcggcgtcggcgctgcacccaaagtgaacaccgggaacacggtgatgaggctgatgttgttctcctccgctaatttgcatgctgccttctccatgagcacctttgagacactatacgcctgcgaaaaacaataatggggtatgctaacgttagtatagatgccaaatagatcgcccggcacagccatgcctagggtgaggtcagtcgggccggcctggccctacacaccgggacgtgccgtgccagctcacgggctacacacacggcccagtaagactcaagccgtgctgggctagcccgaaggcacgacaacctatcgtgcttctctacagaataagtctatttttcctacctaaactctgtgggctgtgttcatatggctgaaaaataaatctattttgtattcctcttgtctttgggctagcataagtctattttacatccctccactatttttgttcgatcatgccgtgccggaccggtccaccgtgccaagggagtggcccaagcacagcccggctgtcgggtcaggccggcacgagcacgaccccggttgggctgtgacgtgcttgggccgggctaaattggcatgccttgggctgggccgcgggtctcgagccatatggccatctataagcattagggcgtcatcatctttatggagtatactagtcttctagtagtagcattgtttcttctttttagagtttaagtacttctattcgtaacgtttgtttgagtggatatagagatggatttctatgcattatcaaaaaaattgtagggatgagatggaggctcaaaaaaggtagaacgtgacccaagctggtggcttctctttcgtcaggtactcgacgtcggaccaggaatcctcgtccaggacatggccgtcgccttgcagcggcctgccggagacggcgggcgccgacgatgtgaggatcacgcgcttcaccgtgccggctctcacgcacgacctcatcacattcatggttccttggacgccggcttcaataagctctttctgccataaattaacgtacaaatgcagctttgtcatcgtagaaatcaagagcaaattaatttcagaactggagacttagagagcatatatatatatatatatatatatatatcatcagagatgagacaacacaacatgcagtggtgtcgattagagaaagcgcgctaattagctagctgttcacctcaggattctgtgactggaaattcaccggagcggcgacgaggaaggcgtaatcgcagccggcaacggcatcgtcgaagctgccttcttcgtccatgtcagcgcggaagacctccaaggggcctagtgcttccaagtccttgagatgggaagtcttcttcatgtcatctgaatacacaagagtaggatcttcagaggcagaactgaactctggaaactcgtagtagcgtcgtcttgagaattgagatcataacgatttgcatcctttccagcatatttcactatatgaattaggtgcgactatcggtttgaacatgtaaatattttctacattatctaaaaaaaatattttctacatggtgcaggtaagagtggcatttggcatttgctaagtagaagggaaaattctattcatcctcaggaccctggtgctctggtctcttggcagccgtggaaggaacggaacttctgggtttttgactcggtgctctcttcagtccctgtggtcctggaatccatcctctcggagggtcatctgtggtgccacttttggggattttttgggagtgtagcgtggctatgccccttcccgctgttaggagttgcgtttagccgccgtagtacttcctaagctttagtttacttttttttttttttgcttttttcctctttccttggcataagccagtctggctgattgtgttgtgtaacaaaaactcattttcttctaatatatattgaagtgcaatctttttgcgcgttcgcgaaaaaaatattcatcctcgggaatgttctctcgttattttgcatttcgccaaaaaaaatcattatttttcttaaaaaattaacaagattgatcaatatgtgatatattatttcacaaacaatacaagttcaaaatcagcttacataagtagaaatgaaaacgacaaatttgactcaaataaaacgtgtaatttgcaaccaaatttgttatttttgttctaataattgtataagttgaaatttgaatatatctctggattggtatatatcttattatttttctagaatcttttttatcacaaagtaggactttctttctgttgttcatgacgacaattcagaaaatatgctactgcggaccaaagattccacccctgaatctgaaaggaaggaaaactttaactgtgcttagttcacgtcaaaattggaggtttgcttgaaattagaatatggaaaagttggaagtttgtgtgtagaaaagttttgatgtgatggaaaagttggaagtttgataaaaatgtttggaacttaacaagggctgaatacgtatgaacagaagattaaaacgggaaataataccacctgggtttctgaccgtcgtgttgacagcatatcccttctgaagcagcatcttgatgagcgccgaagcgatatacccgttcccgccggtcacgcacgccgtcttcatctcaaccgctgacatctcgtcgggaggacacgccgcctacttcgacccctcccagtccgcctgagaactagctaggacgacgatagttcagttattaccggcgttcctctgatctgatcgcctgtcgctaaatgcaacaaccagagatggtatcatatcatcgctgtttcaatttagggcgatgatgcaatcatgcaaggcgttgtttgtaattcattaccgaaagagtcttgcatccacaaactagtcccgtgtgtcctctgtcctgtccaccccttctccactgtgcaccatgtatatttctttttcaggtcaaagtacgtccaccatgtgtttatacacgtctggttgtacgcgcatggctcgagcagtgcaggacgcccgtatcaagattgctagttcccgcaagtcagcgagcgtttcgcgacggcagcgcctcagcttcgcgtctgacatgggcctgctgggcctagtgacttttcaacggtgattaacgatgattcagtcatgtacgtatatatgccccatatgcacgttgagtaacacactcaattagtaatagtatctcctaattgtaattggacaatccacgtacatacatgcacgcagtgattagaacatttaactaaactttttaacagaagattaaatttttaaattgaaaattttgaaaactttcaactcaaaatttgaaaactttccactcagcatttgaaaactttcgatttaaatttgaaagttttcaactcacaattttagaattttcatctcaaaattcaaaaactttcgattcaaatttgaaagttttcaactcacaattttagaattttcatctcaattcaaaaactttcaactaaaaattcgaaactttcaaatcaaattacaaactttcaagtcaaatttcaaaactttcaactcaatttttgaaactttttactcaaatttaaaaactttcaacttcaattttgaaaactttcaactcaacttgaaaacttctatatcaaaatttaaaaagttgaaatcaaaatttaaaattttcagctcaaatttcaaaatcttttgactacaaatttaaaactttccattacttttctaaaaaaaactggtaactgaattatttacgttgttactgttttaaaaataatactaatgacagtaattaacactaattgccataattagcggcggaagcgcgcggacaagacgtcgaggagacgcgcgcggctgcgcgaattaagcagtcggcgcgcacgcgcctcctaggaacccccggtaagtccgcgctaatgctagttagcgcgcgtgctgccggcggcgcgcgtttcaggcccagaaggcccagcgccgctgcgtcggcgcacgcgcgacttctccgcgctttttttcgtttttttaacctttttttccttttctttcctacttttttctgattttttttatctttatcatgttttgagtttgaaagtttataaattttgagttgaaaattttcaaacctaaacttgaaagttttcaaatctcgactagaaagtttacatatctcgatttgaaagttttcaaaattttcaaatctcgagttgaaagttttcaaatctcgagttgaaagttttcgaatctcgagttgaaagttttcaaatctcaaattgaaagttttcaaaattttcaaatctggacttgaaagtttttgaatctcgattctcgagttgaaagttttcaaatctgagttgaaagttttcaaaatttgactttaaaatttaaaacttaaatcgaaagttttcaaatctaacctaaaatattttcaatctgttagtaaaaaaatctcccaaaaaatctccagaatctttcctagttaccaccattagtgttaactatattaactaatatagtggttaagactaaaggggaggagggagtgctcgctgttggcgcgcacgcgccagctagcagcccccgtatcgtatagttgtatgcgccactgttaacaacagaatttggtaagtattcgtatcagtaaaggggatttggtcaagaagagttggaggcggagatcgagttctggaacagagcaagaatcggctggagtctgaatcggctacggttaggatcggctatggctaggatcgcctaatgtcgggttaagctaaataagccgatacagtcgattctgacaaaagaacttgtgcgcgacgtccggctcaggttgatgtgcttcaagatgattgccacgcatggatagagtcctgggaaatcaattgtatctattaattaggattatttatgtaaattccttatagataagtgtgggcaagagtctgccgcaaagacttgtgatagtttagagtttgttagagataatagtcgtgtccggtatgggcatatcttgtaatcctcgggtataaatagaccccgagccctatgtaatttagacagacacattcaatataattccggcgcatcgccaccttttgctttagttttatttcgacgagttcttgctttcgggttgagctgcatcggtttcgatcttcgacaagaggtaaaactcgttatgacgaattatgttcttagggattagcgcttccatcttcatgacactcgtatctcatttatataattcgtcaagttatcatatattttacataatctatagcagtatcattgtctaatctatcttcggcagacatttgcacgcaaaagacagccgattaggttagatctcaacgttgatttagattatataagatatctaccattctatgaatcttctagcggcttgattgtctagatattgttcttcttttcatacttaatgctgcatcaatcgagtttgatctattaagtcgtgcttagaatattgatctctagcctgccacctagttgttgattagaatagcatcggagtttcagccgatcgtatctgatttaactacagttatcctatttgcttcattaatatgttaaatctgccatttatgttaagatactgccataactaaatatgttaaactcttgtttgatatattattattgcttcaatatcttaatatagagtagtatcggagtattagccgatacacgctagatctatctgatcggctacgctataaacatatatagtcctgttatagatgtatatttcgatctaagtgatttatacggtctcggcatgatgaccgatctatcccaatcacctgtgacggagcatggggctcctcaccgggagaccgcgctggcccccctttgccggttcggccggggaccctaggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacgggccgcacctacctccactttcgcc

SEQ ID NO: 33149 - DNA, 7823 bp, Oryza sativa
ctaacccatacacgcggagcgaaaacccacgaggggtcagggcgcctcggccctcggggccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttcttcccccccttcctctcttgggccggctcggcccacctcgctctttccctctctctcctccccgcggcccactcggcccctcccccgcgcgcacgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccatccccgcgcgcattaaagagggggaaatcactccccgtgattccctctccgtttccccccgcttttccctctctctctccctcggattcgctcggaatctttcccctaaacctcgccggcatcaatggcgcccgagatcgccgcggccgtttccttcccctccggcctctctctctccctcccggcgctatataattgttccccgtgcctctctcctccgtttccgccgctcgccgctcgctctccccgtcggattcgtgctcgcgccgtcctcctctctctccgccgtcgccgccgagctccggttcgccgccgtcgtcgccccggacttcctcccgtctcggcgtcacctccatcggcttcgccgcgtcgtcgtcgacctcgtccgctcctccgtttcgcccgccgaccgccggagcaccgtcgtcctcgccgtcccgaaccgcgccgccgctttcctccactccggtcgtcgtttccgccgtcctcgtcgtcccggggtgagccgtggaccgcccctttcgcttccctctcttctccgctctctcgggcgccgctccgccgcgccggtggtcgccggcggtgaccatcggggcgcgggcgcgccgtctcccgtcggccgtgccggcgaggccgccttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcacagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgacggcagtcggggcctcagaggagggagctccaaagggccacgacggcgcaggcgggagccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttctccaaggcagctcttccccacgccttccgtcgccccgctgagcgcagagccccttctgcaggccttagccgccgcaaacaccgcggtgttggatgggttaagtgcccaggtggaggccctgcaggcggagcgtgcggagctcgacgccgcatgggcgcgtgtcgaggaggggcggcgatcggtggaggccatggtggaagcgggccgcaaggcacaccgccggcacgtctcagatcttgaagcccgtaagacggcgctggcggagatcgctcaagaggtggaggaggagcggggggctgccctcatcgccaccaccgtgatgaacgaggcgcaggacaccctccgccttcaatacgggagctgggaggcggagctaaagaaaaagctcgacgccgcccagggggtccttgatgccgccgctgcccgagagcagcgagcaacggagaccgaaacggcgctccggcggcgtgaagaggcccttgaggcgcgtgccatggcgctggaagagcgcgcctgcgtcgtggagaaggacctggcggaccgcgaggccgccgtcgccatccgggaggcaacgctggcggcgcacgagtctgcctgcgccgaagaggagtctgcactccgcctccgcgaggacgcgcttaccgagcgggagcgagctctcgaagaggccgaggccgcggcgcaacggttgacggacagcctgtccctccgtgaggcagcgctggcggagcaggcacgccgcaatctagaatgtgtccgcgccgagagggccgcactggaccagcgggccgctgacctcgaggcgcgggagaaggagctggactcgagggcacgcagcggcggggcggctgcgggcgaaagtgacttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacacccgagggggggggt

SEQ ID NO: 33150 - DNA, 7076 bp, Oryza sativa
taggcaactcagtgccgtcgcccatggccatccgtatggagcccggccgggggacgccgatcactcgatacggaccctcccacattggtgagagcttgctcaatctagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacaaagctgatcttgatcagcctcgcagtacatggtggcccgaggagacctcagggtgagctcggatgggagaaccgcttctgcgccgtagacgaggaagaaaggcgtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggttaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcactcgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtga

SEQ ID NO: 33151 - DNA, 8110 bp, Oryza sativa
  unsure (1)..(8110): unsure at all n locations
cctaacccatacacgcggagcgaaaacccacgaggggtcggggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttctccgcgaggaatatctcggcgcggcagacgtcgtccacgtgaaccaccggaatggagccggtggccgccaggcctttcagggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcgtcagatgtgaaactgaactctgaaaattcgtagcgttgtcttgagaattgagatcataaagatttgcatccatcgtttccagcatatgtcactatatcagttggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgnnnnnnnnnnnnnnnnnnnnnnnnnnnnnnnnnnnnnnnnnnnnnnnnnnnnnnnnnnnnnnnnnnnn

SEQ ID NO: 33152 - DNA, 835 bp, Oryza sativa
  unsure (1)..(835): unsure at all n locations
tgtgggnnntttgattgcttgtcaaacccatnnnnnnnnnnnnnnnnnnnnnnnnnnnnnnnnnnnnagcgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctacaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcatggagcagcgcgcggaccgcctcgctgctgcgtccaagcccgagggtggtgacgagaggcttggcccctctgcccccaccggcccgaggcagcggatggccacttgcgacgaggtccccgtcaaggaggttgccttgggcgacgggccattcaagaacgcacggatcgggggtctttgggtggcgaaaatgaagacgcgcttcgtttcttcttgtggggaaacgctgacggcttcgcatggag

SEQ ID NO: 33153 - DNA, 765 bp, Oryza sativa
ccgccattgaatatactcactctcgtctgcctgcacgtcgactctagaggatccccctattagtttgcatcagaagaacaatcaaaagaagccgattgagtttgttaaatagctccatgtgtttcgaatgcaatgataatggtgtttcactcaacatattgatgtatattgttttatttcaggtatttgttcaatatccataatcagaggaagctgtgccttgagtttgagtatttagcctagtaggtttagaagcactacagaaaagtaatgtcttttatcaggcgagcagacccgtcaaccacttacgcagataatctttacatacataaatttggcactccaaattcaaatttcgctgcacgaagatatgcgtccgacacacagctgttccgttatgggcctgaaccatacaatcctgagaactccttttacaatcaacaggcctcaccaatgccgtacatggtaacagctgatggccattctccatcttctgcagacaattcctgctcagatgtggcaaaagactcaccattggtgtccaatgtatctcagcagaattctcagtctatatcagacaatcagagttctgaacttgaagtaaagtttgatgaagatgatatcagatgaagcttcaagagctggagcatgctttacttgatgatagggagacatcttggatgaaatttcccaagcgggtgcattacacataaatggcttgaccattgaagaaggcatacttcctaaattaccaaagaatctgaa

SEQ ID NO: 33154 - DNA, 3418 bp, Oryza sativa
  unsure (1)..(3418): unsure at all n locations
cgcgctgtttgannatgacattcgacttcgacccagcaccgnnggnggnttgaaggtcattggtcaacgtctagagaaacttgcagaggactgtgggatatcttttgagttcagggcagttggtgctaacattggggatgttacacctgcaatgctagattgttgtcctggggaagcactagttgtcaattttgcattccagctgcaccaccttcctgacgagagcgtttcaattatgaatgaaagggaccaactccttcgaatggtgaagggtctgcaaccaaagctcgtcacactggttgagcaggatgccaataccaatactgctccatttcagacaaggttagtgatgtaaaatatcttcttaattctttagatccactttagaatgttccagccaaagcttaccttttatattttgtctaccaacctgtgaatgtactttcatcgccaactactgactccttatgaatcatgatagcatcaaacatctgaaacatttcacctttggtaggttccgtgaggtttatgattattatgctgcactttttgattcactggacgcgacacttccaagggaaagtccggatagaatgaatgtggagcggcaatgtcttgctcgtgaaattgccaacatcttggcttgcgaaggtcctgatcgtgtgaaaaggtagttcccagtgctattttctacttatacagtccactctctcctttttttttccctgaaaacatgcccaacctgcaactcccaaatagctgaccgtgaacttatttatgctgcagatatgaagttgctggaaaatgaagggcaagaatgacaatggctggcttcacaccatgcccatttagtagcaatgtcatcagcgggataagatcgttactgaagtcgtactgtgacagatacaagttcgaggaggaccatgggggacttcacttcggctggggagagaaaactctaatcgtctcctccgcatggcaatagagcttacagaatgagttggcattagtcttgctgttatttaggagcatctgatgcagagactgtaaanaatgtgaaccactgaacttgtcaactgatcttacctaatcgtagatgtctgcttgtcagaataatcgagttagttgaactatgttgtattagagaattggcacatgatcgtgttgtattctggggtagaattatcttgtcgactctgcttcatgtataaaattatgtgttgctagaatatgccatatttatcatcttgggagcctaaatggtatttgagcctgtgttatgacaaatcgatcgcaaaatcttatcataaatccagtcatgaaaaagaaagcaagctcacaagtgttgcttacatagatcaatggaaatatttatatataccagaatggcagaagaaatcatttgtttatcgaacagaccgatcctgtaaaatacatcaattttctctacaacatttgaaaattgtacaatgctagtaacttgtataagcttaaaagacaatacatcgatttttttttcctggagggacaatacatcgattttctctacatcattttgaaaattgtaaaataacatgtaatctgggtgaccagactctggtagtttctgagagtatgaatcgggaacacaatatgctatacatgatatgtgcatgtcaatcttatcttcagtggaaagcacaatcttatctgctaggtaaggtgtgccatgaattcaacgaactaccatcactgccaggttgcattttcatgcgtttagtggattccaaaagtccaacaagggacgggagaggtcgtgggacagggacattccttgatctgtacagcctcttcaaacttgcattcaagcatttcgatgatccagtaacgcacaaggtacccctttcacaatctgttgtttcttctcctctgaccatgcaaaggtttgaactttcagcaagatttgttgattctgactctataacaacttcagacttttcaggtttatcagccaccggtgacaaactgcactcaccaataggtgaagaccggattgagagtttttctaattgccttggggatgcagcacgctgacaatcatcttcagatcctgaataaccccttctgaccatgcaaaggtttgaactttcagcatgatttgttgattctgactctataacaacttcagactttttagggttatcaaccaccggtgacaaactgcactcaccaataggtaaagacaggattgagcgactttctaattgccttggggatgcagcacactgacaagacgggtcctcatcttcatatcctgaataactctgttgggacttcgatgcttgcactatgacaaaatcagtccgtgaatttggacatgtttcaacttcactgctaccatcacagatcaaatatgctgttgaatatgccctggcttcttcaacagcaatgcgctgattgcacagttcttctctcattatgtcaatttcttcagagccaaatcttgctcttccaaacagtgtaatatctggttcctgaactggaggggatggcatgaacttcagttcaagcgtgcagatatcaaagtctgtacattcttcaccactaggagaggctgaatgatcatgatcatcatcgacagaaatcgagtgatcttcatttgtgtgcgtgtcggaatccagcaatgtagaaggggaggacactgactttcggagaggattcttgaatatcttccacagtggatcatcagcagttaagcaggtcttgaaacattttttctttacatagctcaattccatggcaaagcatggtggtgttgttgaaattacccattgaggctggagaagttccaaggcctgttctaactcatcacgagaggaatggatggagaaacaaatgtgccagaccccacaaccatccagcacagcttctgttaggctaggtttctggctttgagcacagtgcgcataccactgtgttgagggacggataaatagaggttcaggctgaaggctagcccttgcctcttcaatctttgtacatgctttgtcatacaagttttggaatccaagaatctacaaagtaagaaagttgcaaatgaaaaagaataaaatgaacctctccatgcaaaacatagcacagaccagactaaaatgaacctcttagatcctgtactagccaaggttgattataatcctgaatgtactgttctgttctagcaaacaattttagtatgaaatgtagatagagaggctggaattgacttttcggtttggtggttacacagtcgatatcaaatcctcgctggtggtggtggggggttggtgaanaagaatagcagaccactataaagtaagtatatagaaatatatatagtccaggtcagcagatatgaggacacccaataatcaaatntttgtctgcgcagatatacacgccg

SEQ ID NO: 33155 - DNA, 1353 bp, Oryza sativa
  unsure (1)..(1353): unsure at all n locations
agattgaattcttctcccacccctcctatgcaagctataacctgcaatcactgaaacatttctcaatggtgaccatccatgttgtcatatgcacactcctacagttaccaacaagccatttaatctaacggagaggaaaacctgctgaatagctgactccttgcttggtagcttgaggaagcatttggaaaatgtgcagtccagaacacaaagtctaaacggcaaatgttttctttccctttctttgctatgtacttcagtggcaaattatgtacacaatctggcgtcagccgacagtcccccgtgtgcagaatgctaccgaattgaccctcgaacaagaacataaccgcccctggtatcacagaacacgcaagcattagccgtggtcaacccttcccatttctcaatatacaaattcaataatgttgcgctgaaaatggcctcatagaacgatgaatcactccgcctgaacagcggagcaaaaactacaattcccatggatctgttaaaaaaaatcggccgctgaattgaacaatcactcccaccatcacaccctgatccctgacaactaagtaatctactatttctaccagcaaattatcaacttatatatagcacggtaagctgtaacacgacggtatgcagaactgaagaagcggaaccagaattaccagggcagtgattggcgtcgtacgccgtgacggagaaggccccggcggggtcgtccaccaccaccgtcttccccacctccatctccacgaactccccccgctcaagctgcgacaccacgagcgaccattcgattagcacggcacccaccaccaccacacgggaacagaatcggcttccgcgagtcgggggggcagttttacccggggaaaatggcggagggcgaggtcgagggtgagccgcgtcgcgtagacggcgccggggcattccccggagtcggcggcgccgccggcggcgacgaggtggtcccggtgcgcgtgggtgaggaagcggtggcggcggcggcgggaggaggggccccacgtgtcgacggcgaaggggagccgccgcggcatctctatcggcatcctcccgagaactttccgaaattacagttcagtcctccgctcccctgaacctcgccgcctcgtttggtggggccatcgggttgagttagttgtgcccgtttatatacccgcgggaagtggcgccttccaaaggaagaaaggctaacgggctaatggatgataacgggttttatttttttacatccatccatgacccgctaataagtagtaccagtctgattttgatgggggatcctctagagtggncntgcgggaatgcgaatttaatntcaaacgc

SEQ ID NO: 33156 - DNA, 1138 bp, Oryza sativa
gtgtttcggttagatcgcgtagaggttaagttgcatcaggccagaaacgctcccgcatccattggggatctgcacgtcgtacaacacaacgatgcaatttcgtcagttaaactctttgcgtgccattcgtgtgcacggctatagctgctactcctatgctccctccggctcatgaaaaatgaatatgtggcatatcctaatactacagatctggatatatatatatccagattcatagtatcacgaatctacgatgcgtcatatctggttctatatttgtttttcatggaatgaagggagtacgtacgtacgcccaacatgtgcgcgccaagttggacgagacaccgaaaggataaccgacgccgccggccatttcgcggcattgagttgcaaacagcgttgcttgtgcagtgcagtgctgtgcttttgcagcggtttgcatgtgcccatcagacagtacgatcaatcgagatccaaacaaaaacacaaaaaggcatcgatcggattggatcatatgtctcgtcgtcaggttacgtatctttctgtaatcaacgtcgacaggttgcttgtaggcttgcagcaattgacagcgaaaagaaagacgatgagtaaattaccgcgatgaaagggtcgcggccgagcaggccgtagatgaaccaggaggtgccgcacaggaacacggacagggagagcaggaacggcatgaactccacgctcttcgtcttgatcaccagcctctgcacaccggagtcaattgatcagcgaatcagattatggttaattttgttagttattactccctccgtttcacaatgtaagtcattctaacatttcccacgtccatagcgatgttaataaatctaaacatatatatctatttagattcattaatatcaatataaatgtgaaaaatgctagaatgacttacattgtgaaacgaaagaagtactatactagatcatttgtgtggtgtgtactgtcttaccatgatggagagaggcgaggcgtacatgcagatggagaagatggtggcggcgaggccgcagaagagcttgcggccctggccgtgcagggccaggagggagacgagcaccaccatggtgaagatggaggtgacgaggcccaggagatctatcat

SEQ ID NO: 33157 - DNA, 3195 bp, Oryza sativa
  unsure (1)..(3195): unsure at all n locations
ctggcttgattttgaaatgagattccacctgggacccagactgggggatagtgtttcttacctgccaaacacacacacacacacacctaaaatcatactggcccaaaaaagctcacccactttttcgagctacaaacactcgaacgggaggctgcatgtgcttgcacaacggcctcttgggcccacatgtcacagccatcctggccatgccggcagcaagggctatagctgctgctgcacacacaccagtgatacagtgtgtgtacaagttccttcgcaggagtcactgtcacagcgatggcaggtgggtccaggagtagctttccatcgacgaggcaaattggacagaggctacactaggagccaaccactgtggttcccatcaacagtatcatccagtgtttccggatgaattacggcaataggagtaaacatcaagttaactttcagtaatcagtagtactattactgatgagtcaattactaggttcactaaacttgctcatgttgtggagtagtgtgtgtctatcgagaatcacacgaaacttctgagagaaaacgtagtgtaatgttgtggggggagaaatgcacatggtgtggagaggagtgtgaggtttcagttagttaccaagcagatagcaggcagttgagaagtgtcatgttgtaaggcacgccggagaagtcctccgttgatctcttcttgatgatcctccagaaggtgacactgtaaaatgaaaaagagccatcaaaattttctcaccggtcagaagaaacaagcggcattcgtgcgaccgatgcacacgcatcaacgcatgggtagctgccggtgaggccggcaaacaagcaagcaggggaaaaattgcaagattttttaactttgataacttcttttgcgaaaaaggttgaccaaatatcatggtagatgaaactaaggagcagagcaagctgacactctccatgaacaaagacactctactatgttagctccttttttttttccagacacagagactatgagttacaggtatcttttgtttcttcttcccttttcacttgtttttttttccttcttcccacctctgctcacacgttacaagacctcacaaattgggataagattgacgataaggctaggcagcaaggaatcagaaacttacactggcgaaaggaacaggaagagagcgatgacattgcctggaaaacggagccaacaaaaaacttagaacgaattcacagtagtgtaaaacttcaccaaaaattaaccagcaaagtaggtagctctaggagcacccatacaccttcatttcttcgagtgttcgaagatgggagaaacaaattctacatgcacatatagacagataggaaattaagaacaagctgcagctagccatggcggcacactcaccggaaactccaaagaagaacctcgcgatgtgctccatttcgatacgtttatctctcctccttggggctagaatagatcgcttctagctctcccgagagtactgcgctgaatggatggctggctttgctagcttctcagcggtggactactgctacacaacactacaacacggagctacttctaccaatgcggtgcctctgtgtgtgtgcttatataagggagtggagatatacagagcaacactggtgtgtagagaaatatgccaagctttttttttttaacgaaaaacagcactagagtgacttttcattgaacagggcaggagaaaatacaaacccctaggggtaaaaggaaaacggagaaccactatagctgtacactatacatagtgcgggattaactcacgcaaccgcttagctcctgctaaagccaaaaggcttgcctaatctttgattttcgttagtaggaagttcgttgccaagcttaaacagatgttgtttgaaatacgtacgacgataaattttgctcctaatctatgtgaagacagatatcagtaaatttgtcggtacttttatttcattgtgtttttagtagttctgtaggagcataaatatagagtagatgtaggaagccacaactattttgtgaaaactatcagtacactagtacaactttagctatgcaatttcatagaaactgcatcgatgataacatgatttaaacagaaagatgcaactttatatgtccaatatatttgagcccacacgccatacacatatgcaatactcgtgttgttgcatgtcgggtttattatgtcatacacacgtagaggatggagttacgattttcaaataaattattgtcattttccgtaatagctcgacaaagttgtaacaaattgttactttttagcctgtgttcagctgggctaggctgtggtagcagccagtttgaactaccgcagccgcagcggctacaacagtaagtgcctctgaataaagccttaatcatgagtaaattgcgttgatgacatacaaacttgttagataactatgatttagtacacatactagaaaaaccgtgtggcttcgccacgcatggtaaagtgaacctagctcattcgactttagtggagtaactaattagggcccctttacttgaaagaaaaatataggaacttttattctgtatagaaacgataaactttgctataggaattttttctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcatacggtccaatcaaacgattatttcatatatttttatgtgttttataattctttgttttgcgcttgattttttgtcagaattttatgttttccctattcatccctcaatcttcgtttcaaagtagccctcacaagacatatataggttgcattggaccgagggagaacagacaaagggacaattttgtttgtacgattgtacccctactttgatgtcaataccgattttaccctacattttagggttgttgttttttgccctatttttttcaataaatgaggcgtttacccctgtttttgatggaagtgagtgggattggacttagtgcggtaaagannnnnnnnnnnnnnnnnnnnnnnnnnnnnnnnnnnatgagtttcttcatgtnggattcatccg

SEQ ID NO: 33158 - DNA, 775 bp, Oryza sativa
  unsure (1)..(775): unsure at all n locations
cgcgctttggaaatcttcactcttgtctgcctgcacgncgactctagaggatcccccttgtttagatagttcatctgagttagtatacatgcaacaacaacaatggtgaacatccatgtctgtggatagattagctggttcattcctgaaaaagtcagtttcaaggctattccaagtgctttcacactcatgacctgccaaaagcagcaatatacacaattttatgaatagaggatactagaacagcttaactactcaacagtattttatgaatatcaattgaaaagagttattaacacatggaacacataccgagagagaccctacaagagaacaaacaccaatatacaccataatgtgtgtctgaccatattgggggataaagcggaatatgagcacaaaagtcgcagcaagcacagtgactgcataaaatagaaaggctgcaaggcaaaagctaaaaccttagtacgagataaaaatgtggccagtaatgtttttgagattcaattgtcagcaacacagtacctggttcagtagcaagagcccacacttcagctacagaatcaatttcacgctcctgcggcgcatgaagcacaatggttgttgaacccacaacacagaggacacaaccaagtataccaaatatgtgaagcttctccttcaacataatatctgcaagaacagcactgtagaagaaatatgctaagatgaagaatgaacagactgttgaaaatataaacagcaggagatctcaagattagggaagtgtaggtgt

SEQ ID NO: 33159 - DNA, 2643 bp, Oryza sativa
  unsure (1)..(2643): unsure at all n locations
ggttttcctatagcgtagatgtgtttgcctgtgctttgtaaaaagttgttgtggtgtgggaatcgttaccagaatcagcctatgtggcagatggatgacctgagtggtcaagaaacgaatctgtgtgattcgggatgtctacgggcatcatagactaggcttcccgagtggaagcggattgttgtgctgctgggcagttggactctgggagtccgagaaaatgaaaaggctctgggagccgcttaatcaagtgaaatggctctgggagccgagaagtaatgatctgacccaggaggtcggtacattaccaaatgagctattgaaaaacatctcttaaaagtcgaatcgagacacaagtctcttttcggcacaaacttagaaaaaagtagaccacttagtgatttcaaaatgatttcaaaacaatagatttgcaaaacaaccttgcctctcttccaagcttgcattaaacacctaaattcccgtgacttgctgagtacgaaagtactcacccttgctctataaaaaaatatatatatagttcctccatcttgaagagaagattaagtgaagcgaagattagggtttcgtcctggtttccagccgtcgcctgtggtgttgggtgttagtccgttgtttccgctgctgctgccgttgttggtgttgcctcgtccgtgtcgtcggttgtaatctcgggctatcctgagctgcaaccctagttaaggtaaataagtcatttatttatttcaaggattgcaatgatttatatttgtcaccgtgggtaccagcgctatgtcctgggattggtactgagatcgcggtctcgtaggaagcggttctcaccgtttttccgacaacacgcccctgttaggtaccgttgtacggcggtgccggattgggggtgacagaatacttgtaagggtaaatttttatcactaaactacccatactagagtatcactggccttttatatcatcccaagatcccaactagtcgacaattcacccatccctaaggagacaaataaagtatttttatctctctccttgatactcggccgagggctaaaactggctatattgtgggacagaaggagtgtactactttaaatgctattccatccgtctcattttaagcgcaatcatgagtttctttttccaaatttgattgttcatcttatttatttattttatgattagtattagtataattatcattattattatattattattattattatcattattattattattattattattattattattattattattattatatgataaaacatgaataatactttatgtgtgacttatatattttattttgttaaaaaaaataaataagacggcggattaaagttggacacgaaaactcatgggttgtgcttaaaatgggacggagggagtaaaaattaggctcatatggttttactagcatatgtcattattgtaatattcatgagctatcttatgttccattatctccctcatgtcttggccctggttgaatcatcttcctcaatcgtaaaaccaggtataacgcttctcgcatatttgaaaatcgatgcaaatcaacttttttagcggttgcgaagacggttttgtcctatgtgagactcataagactcacatgtcggtgagaaaaaagattaaaaaacggccccacatcttagtattgcggccgtgagtggggcactcgactggtgcgcgcgagagagagaatgggaaagaaagagagagaggaagaggaaaaagaaaaggaggttaattaggatgactaacacatggagctgttatttttttttaactttttatctcgcttacatgaagtcccatgaacgccatacaggacggaaactctttggaaaccatagtaggaatttgatttgcacgagtttttaaagatgtgggaggggttaccgagaatgctaatggacgggtgattgctcccccgtccgcccagcgatcacccgcccgccccctcccctatacgatgcactcctccctcctctccctccttcctcctcccctttttctcttcctattacagtacaccacacaaaatttttaaaaaaaccaaaaagttagaaaaaaatatgtatagaaatactatatataaaaaatttgaattcaaattcaaatttgaatcgggtatgtaaacttttgacttataaactttgggtctataaactttaggtgtataaacttttagatgtatagaaatactatatatatagaaaatatttgaattcaaatttgaatttgaatcgggtatgtaaacttttgacttataaactttggttctataaactttaggtgtataaactttagatgtatagaaatactatatatagaaaatatttgaattcaaattcaaatttgaatcggatataattcaaattcaaatttgaaacgggtatgtaaacttttgacttataaactttaggtctataaactttaggtgtataaactttagatgtatagaaatactatatataaaaaagtatttgaattcaaattcaaatttgaattggatatataaacttttgacttataaacttttggtctctaaactttagatgtgtaaacttgaggtgtataaactttgggtncaacaacgaattcaaacct

SEQ ID NO: 33160 - DNA, 776 bp, Oryza sativa
  unsure (1)..(776): unsure at all n locations
atggcttttgattgatctatcttcatcnnnnnnnnnnnnnnnnnnnnnnnnnnnnnnnnnnnatctgattgccattaacctcataaacagtcttgggattctccacccctgccatgagcatgcagatgaaagattcccactgtgtccggctcatggagtcccccacaaacacaaccctcttccccctcagccgttccaacacatccctggcactgaaccgcggcaagtcgcatccccttggcttccaccgccatttcaggtagccggtgtccttcctcccatttgccaggcaattgaatcccctctccacaaacgggcaatcggagctattgtacaaagggtacctcctgtccggcacccagcttccgtcgaacacgtcgcaggactctaggttgtcgccggcgaactcggcgaccgcatggccgcggccctggtaccggaagagatacagatacagcgcgcaggcgagcacgagcgcgacggaggaaaggaagaaggccaaggcagcgcactcgaacgacggccccgagggcgcccaccaccaccacttgcggtgcgcggccgccgccgccgacacccgcgggctcccgacgccgcccctcgctgtgagccgcgccgacgtgctcctgctaaagctcccggtcaccatctcgccgccgcatccgccgccgcctgatctcccatcacacaaacccccagcagccaaatctgctcgaacaaatccaccggcgcggctttctatcccaatacgccgcgttcgaatccctccgnccaat

SEQ ID NO: 33161 - DNA, 1347 bp, Oryza sativa
  unsure (1)..(1347): unsure at all n locations
aatgagtgtatgtctttcgcaaatcatttacactttcttcaaaccacaacagtagcagtcttgttttcattaggtgcctttataacccaatacaagaagaacaatacactggaaaagatccgatgtatgtgagaaaacacacctccaatgagatggctcatacgtgcggaaaaagacatgtgttcgttttaaatccaccttttccttcacccatgaagcccatgtttcaagtgccattttgaaagcagaattaatggatgtacctagtttaagcaaacctccagcctcaaaatagcagcccctgttaaaaacacaaaacaataattacccattagtgaaacagggaaatgacaatttagtagattgttcgtaaattgtaacaatttgcaataataggaatccacattagtagaaacacttctgaggaatatgcacaaacataacttaatagcataattgaaacacaatgcaattatcgacagtgtatatttcctaactacgactattctggtgaaggacggaatgcaccaacatcagccatcaggcaattttgacaggagaaacaaaaacactggacttgtgttgctttgacctcaagtaacttcactaagattgcaaggcaacccatcacttgtttttgtcaatttgtaactatcaatacttttgatcagtccacttcatgattcctgaacaggataaattgtgttaagctcttaaaaaaaatactgtctagcacccctttgatctaggggttgcttagaagtcacatactaaataacagatatctttcaaagcgacactgtgctacctatatgccaaaccattggcatgcacagaacatctatccaaggatttttcgcaaaaacaaatgtattggagcaaacatatattaggttcatgatttttaagttaactgcagtagatatgacaacaattctaagaacaaattggtgttgctaagtacaagtacaataagaaaactcacatatcaaataatttgctgggagtccaccaatgccctgagttgaaaataagcacatcagcattctcccatttccggctgatattatccatcttatcaagcttgagaattgctcggaccctttttgggctactgcgaggtgcagggctctgttgtacaagaaacaccgaccggaagaactctacattcaggttgaatgacgcaaatctcactcctaaaaaccggatagtctttgagatctgattgccattaacctcataaacagtcttgggattctccacccctgccatgagcatgcagatgaaannnnnnnnnnnnnnnnnnnnnnnnnnnnnnnnnnnnnnnnnnnnnnnnnntnggcacat

SEQ ID NO: 33162 - DNA, 9886 bp, Oryza sativa
  unsure (1)..(9886): unsure at all n locations
gctacacgtgcaagaaatctttaatactgatgcatgaagctattatataccggtatgcacataaatatattttgtagggtctaaaaaaaatatatgatttcctatccatgtaaaaaatataatacttgaaatttaccatgtattgtgattattttttaatagattattgtcatttgatacatcttgtaattcgtttatcagatatatatggctaattaaaggtttcggcaaccaatgttgggttatattagcattggaagttttctttggtagttattgttgggagcttggtgctgaccaagtaaaacaacactaacatgttagactaactgaggggctggttgacagtaccatactacccattaattatagcctcctccaatatatcggtgccaacaaatcatccagtctagctagcaacgtaatcaacagtgatcatctcatgtgtgtagtgttagctctaccataaccatgtaaatcgacaatgattggcctatgtaaagtacgtcagttaacaagtcaaagcttaagcgagtcagaatggtgagccaagcctatttctccattcagctttctagcacgacttggcttgatcttagttagtcttgtgagctcagctctagtacatgataacgtatactttaacaatagttttataaaaatatttttaacaataattttattaatttttttaagttaatcatattaaataaaaaggtgaggagtatttaacattagggataattgcaaatataccactacatttcacacttaatttgaaatagccattaaaaacatgaattgtaaatttgccactgaaattgatccaccgtgcttctacgtgccattgccatctaaactggtgcaattaagaggcaaaaaataatacataaaactagattgaaaatgacataattaattttcccatcttcatttaaaaaaaaatcttcttccaacttacatagagtgccactactaatttattctttttttcttggcactttataaatataggacatgaatttgtgtttcgcatagggtctcgaattcttagggatggctatgatgtcaatgttaaagcagatttacaaagtttacagtgtcaataccacatataaatcttagcaaatttactatatccatgttataggaaaattactatgccaatgtagtaggaaattgaagatttttgttattcaaatgtactatgccttgcttttgttctctaactcctcagctagtagctaggtgaggtgggaggaccagatagtaaagaggagaagaacgaaggattaaaaccaaaagaatgaaagacttttttatagggacatgaaagaacctttctgcaatagatgtttctcgatgggaactttatgatattttgtgtagataatataacggctaaaattttgaaatactagatcgaacggtctaggttttgccatcaacgtggatgcatgttagaaaaggatcctcctttcatttaggggatgcgccatatctatagaggatcaggttgatggtaactcatattcgaaaaatgtgtgggacaggaggatggctaggagtgcctattcaacctcaataaagatagaacatttcaggactgtaactttgcaagtgcatcagtaagaaaaagatcgtcctaccctttgatcaaaggcagagtttattaactaaaagatacgcatgaatcatatggttggcatgcaccaaaacttttggttgaagcatcacacttcagctttttgcaaataaagggtggttggcaatcgaaggttctctctctgtctgctttgttcttgtgttgtaaactgaagggtctcctgtttgttcacatgcggattaattagctggctgagcttaccctacatgtctaattaattatggaatatttctccttgaaaaataattgagttcataatcgagcctggacacgccaacccactttgcccccacacatctgatttatcctatataataatttataatactggcaacttgtatattctctagaaaaaagttcttaaatatatttgtcaataaatattactgagtaattggctctgttgagaaaaacacatgtagatcatttttatattttctctggcagttactaatttttataggattatgcaaaatatttgcacatcactacatttctctactattataaaagtggagtcatcctccttccatatttcactgcatgcagcgccgtttaacatgtctaaccactggatttaatattttatctttaattattatcatgattgacggagctcgtggctcctcaccgggagaccgcgcaggcccccctttgccagttcggccgggggcttagggtgaaatctcaagctctctctctctctgtatgtggaaagatcgtccgtcagcaagaaacacgagacaccggcgatctatacaggttcgggccgctgagaagcgtaataccctactcctgtgttttggtggatctgtgtatgaatgagctacaagtgtgagctgacttctcccccgttctaagctctcaatctggaaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatgatcagtgtcagaccggtcacaaatcggtcattcttgtccaccgcgtgtaatcttggcaacgtgcatgtttgcccttcttcacacaacatcttgcttgtaatggttaggatgaagcctggcatatatcgatcggggctagcgtgtcatctctgggatgtaacacgctagctccagccggggacgagtgcctagaagctctcgtcttgacaggatggggcgaagcgtgcgtctgaccgcctgtcgccacctaacccgtgatctgaccggtctgtgactggtcacagaccggataaaggaacgcgccgtactgcgctgcatgcagcgtgacacgcctgaccagactgcattaaatgctgttaggtgagcacagctgtgctcacttatcccatatatgtggcgcagacttcctaaaaggggtcggggtgccccggccctcggggccggggcaagcgcaacccgaccccccctcggggggaatcaggaggagggcggacacctcaccctcgggcccgacgtccccgaaggtgccaggccccgtgggcgattgtgtctgcctcaagcctctagtcatgatattcccggtcccatatcaccgacagtagcccccggcgttatgccagagcaatttcccttcccaagggaagcggtcaggtgtgacgccactcctaaagcctggtgacaggtgggaccggtctccgtagttgggcaaaatacccaacggtctcaatccatgcacatcggtattgataactttggttgtccataatgggcggtctattcaagactgccacaccacttgagcagcgcgcgaatctgggtgagcagatttgtctcgcccggagatatggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggtaccagattacccggggcggtccatcttcttcctccccttcgcaatggctgggctggtcccgccattttctcatttcttcatggatgtcctggagttctacgatctccagatggcgcacctcacccccaatgcggtgatgacattgcccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagcgccgccggggggaacaacctgccccaggagggggtcgtgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggctttgccaaccagggtacgcgaggcggaatgggctccgcactcgccctcatggatatcagcaagaagctcaacgccttgtttctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtacgtttggatctcagagatccaagcaatcaatctaagggagctaggaacgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtttgaggcagctgtgaggggtccgtgctagcctcgggtattgaggcggtctctggagccggggtccactctgccacgaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccataagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccatcttctgcgccgatgacctcggggtcggaagacgacaggagcggccttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggccataggtgcggcctccccgcagtggcctcggggccttcctgagggtcgggggcgcccagcaccgtctgacgagcggggagagggccgactccggtcatcaggggccttaggccaccgttcggctcgggggcctctcctccctgcctgctcccgggccaagtcggcacagagtgggggtgcgcagaatgaggattgtcctcatcgcgctccacaaccaacgctgcactaactacttggggggtcgctgctaaataaagtagcaggggctcatttggctccggggcgactagaaccgggggagagctgagatatgcctttaactaagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacgtccctaagtttgctgggggggcggatccgctctatagctcgtatcttctcggggttggcctcaatgcctcgggcagagaccaaaaacccgagaagtttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattttttaacccgaaaggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgcggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaatggccacgtgtgccccggcgtcacaccgataatcggctgggacggtcggagcaccatccccggggccttgatggcatcaaaagccgcgggggaaaggatgttgagagccgctcctccatctatgaggacacgtcccaacttcacgttgtagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcaatgtcaacagcgggggccttctgcttggcctcacttcgccgtttgccggaaggaaccgccggggacttgccctcacggcgttcctgcctcctgtcctcctcccatttcctcgttcgctcggccaagtttttgaccgcacgacagtccgcgagatcgtggagggaggtgttgtggacagagcaccacctgccggcgaggcgctccctgctgggtgtaccagcctcattctttttgtcgctcgcaggcctcccctttcgagtggcccgtggagcgccctcgacggcgaggacatgaccctcgtcgccggaacggtccggcctcttcttcctcctcctgtcacgccgccctgtctgagcggcggatccgggggcggccgaagctaccactccggaaccggaggagttccaggttcaggcctcctccttacgagccactcggtctgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcacctgggcgcggatatgtgccttgaaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtannnnnnnnnnnnnnnnnnnnnnnnnnnnnnnnnngcgagaggcagtacaacaatgagccagg

SEQ ID NO: 33163 - DNA, 1173 bp, Oryza sativa
  unsure (1)..(1173): unsure at all n locations
atgggntttgagttgcaatgctgttgccngcaggtcgactctagaggatcccctagctgctatgacctggccatccttgagttggcccttgtaaacatgcccaaacccaccctcacccagcaaattctcatttgagaattcagacgttgcagcttgaatctctgagaaggggaatttcatagattcctttatgtaaagaactgactttagaccacaaccagcacacagaactggtcgctctgatgaatcatagtggtagaacatgtttccttcaacacctttacctgtaaggacaacaggagcatatgtaatgtgcgcaaataggtatggtacatgggctgtataaaatcaactattggagggtaaaattgcacaattttaactctgagaaaaggttttcaaaagctctctaattctatctgtatgaaatagcagaaatacaaccaggacacagtgtttccttttctttctttacacgtttatctagtttgaaattttgagcaaagtacactagttgctaacttacgattttgctttacaaaagaaacatgccataccgttggacaaggaatcagttccgtcaatcgttgtgagagacatggcgctcattgatggtgtcaaatatgacatgctgctcccgaccacactggatgtttcatgcatctcgtgatagcttagagaggcaaaataacttacaggtgatgacttggtcaacacactatgagtgtcagtatctaatgtctccgaacgcaggtcgagtgatactgctaggtgctgcagagcctttacttcccccatgcttttgctcggtggaattgtcctaattatcttcaatggctgcaccaccaagttatcctgaaatactgccaccttgcaggcaatgtgcttttctaagtacttgaaatctctcctgaagtgcctaaaaaattacaaaataagtacctcgtcaagtattgaaccaaacaggcttaagacttgtcacacagatcctctcctgtaatgcagagaggaactgtgtggacagtaatttgtctctgctgctagaatagaaagtctgtaacaatgttaaacaagacataatgtgcatacctatctagtacaacccaagcagctttgctggatttgacttcattgataatgacaaacttggctggtgatccaagaaatacctta

SEQ ID NO: 33164 - DNA, 1315 bp, Oryza sativa
  unsure (1)..(1315): unsure at all n locations
ctgggcnattgaatgcacatcgtgttgccngcaggtcgactctagaggatccccgtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaagaaaaagggatgctatttttgattaatatcaggggatcaattgggtttatccttccctaattaaatgataaatgcctccaaccgaaggagataggcggtttaaacaaaaaaagccccaaaatttcaaacatgtatctagaatcacaggaaaactacaaacaaaaatagtgaaaattagctcgttaggaacccatccaagatcgttatagaccccaacggaattagtgttttcccaaccgcggggtggagtgaaatccaacaaaaaaatagtaactaaaagaataaaaaaagcttttactgagtcatttaagttatagaaaaattcctgaccccaagaattcaaaataaaaaaatcctctttgcccggttgnngggncccgcttgnngtngccnnncgggttctgtttgtcgggggttcctctnnnntcnncggcnnggcgtaangagcagtcatcaaaccgctggngggggggggnnngnaaaagagatttattaaattaattgtataaggacngcnataaagatgcggtaaatataagacatatttgatagcccccaanatgatgctctc

SEQ ID NO: 33165 - DNA, 5070 bp, Oryza sativa
  unsure (1)..(5070): unsure at all n locations
catatgaccaatgacaccatccatccacaaacacagaagctgttgtgcccagtccattgtaagcaatcctggggttttaatttacatcttcctcaaatccgagctgttctagtttctacaagagggagcttgctagtaggcatggttggagaggatggccctcccatggcggtgcgggtggtgagcgcaggcgcagtggacggaggtgaggctgaggcatccgctgatgatgagggagtgccgctccgggcacgtgtggagcgccgggaaggagtcgcacaccgcctggaccgccggcggcgtcagcgccgtgcactggctgatgttcaggctggccagcccgtcggcgccggcgccggcgttcttcctcgccgccgcgtcccagctccggcctttgctcctcacccgccggctgttcgccgccagcgagtacattgcccggtcggtgatgttctggcagtagtagagccccagcgaccgcaggtgagggcagccattggcaagagcgaccacgctctcatctgcagatcaagaaattgatcagataccattttgtcaggcttcgtacagtttagagtaaatcagcatgtcaaagcaaatgttattcaaaattcaaactgaacaattttaacattctgtgaccctaccaaaattttggtaactttaatagtaaacatgctagtttagattgaagccaaacaattagtagtgcccacgctcactttggctacattctataatcttcttcactctcatactaaattttagctttatattggtattaaaccaaacatagattagctaactttgccctaccaaaaaattgatagtgccaaaatttacctagattttggtactaccaattaattggtagtgtagagaaccaaataggccctctgatcaaggaaaaaaaaacatcggagattacctgttatcagaacacagccacacaagtccagagcccgaagttcagggcaccctgatgccaagctggtcactcccttgtcagttacactatcacaccagcctaggttcaaagactgaagctgaccacagttacaggcgatggcctgcatcaaggttataaagatcagaaagaattcgatggagagcaatggcgcaactactttggtacctgcaatgctctgtcggaaactgccctcacacacccgcacagattcaggcatttcaggttcttgcactggctactgagataggccaaagcagcatcgctgaaattggaacatccactgatgttgagccttgtaagatgggggcatccatgtgccagagcatacaacgatcggtcgctaagcctaaagcttctgctaagatccaactcgcgtaaatcatgacagttatttgctacagcctccactgcactgtcctcgagctgaggtttgatttgccgtaaagaaagaacttgcagcttcgtaaatttctgagcaagtgacatcactaagtcattcatgtgagcctggcacctgaaaacaacactctccatggttaaccaacagccttattgtccacagatgcaatcaaaattttgttcagaatgacgaggttttgcagacactaaacaatatgtctgaataaagcatactcctaaaccatatngccaatacaaagttatctgatcatgcttcttaaactctcgtatgactgtcttagtatcaaaagtttcaatcaaacaagcatttgcaccaccttgcaaaaaactagtaacacaacaaatgatgtttatgactcaatgtgaccacaaacaatactcttctcaattggtggcgcgagcaaacagatgaggcagaaaagttgcaacagaaaggactacgttatttttcttgaccacgcctttggagatttggacggaaagaaacaatcgcattttcagagggaaggagtctacaccatcagctcttgctggcaagatcataaatgaaccttatttgtgggaaatggtaggtgccaagggagtgaagggtattatggtaagagattaggcttttgttttttctcaggagtgcaagcaggaagagttccttcacgaatgcctctcctcttctgttctgtacaagttttgtgttctctaacttcttctataatataaaaccagttcgctgggttctttcaaaaaagatgtttatgactcaatagaaaacattggaacaagccagtcataatatttttgtcagacatcataagtggcaaacaggcgagtttctataaacactacaaaattaaaatccggagtttctttagctataaaagcatccaatttaaaagttacataactattttgtggatattatcacataacaattcttctatgtctgtaatattcaacatgtcaatactatgtgagccatctacccataaaaggtcagatagagacgacacgaagaatctaaatgtttcgtgagaatcatattcaggaatgggaggagaaggcaaattgccaaactcaccacgaaagagaaagattcgtgactccccattctaatgtatcacgccaaccggtgcaaacaccagagcccacgattaccatcctgtcgtctccagccatcgataatatccgcaggagcagctccatgggaaggtcctttcaacctaacaaggtagtcccttgtgcctcatgatgtgcctgtccactttcaccctttccagaaaccatgagtgcgttgaacgaattgtccaattcaccactcaatagctggtcacccgcaattctttttttttttttggataatctgaagcttcgaatacagctaaccttgcagcaacagtgaagttatcagggactctgcactgatgtcaaatcccaatctgaacttgatgctaccagaatatatcaaattaatcccagaaaaactcaacaaaacagatgggagcaatcataaagtcgttttgcaactgaacaactcaaatcttcaaaagaaccgaaatagagctaagaatggagagataattcagaaagagcaaccttactatcaacaattctacaccatctagatgagaatattatcataaaaatctcctagagaaacttatagggaacacacagaaaggtacctcaaaggagctcctaaaaaagcacgtattctctgcaagtggcaatttgagcagaaaccgaacttttttttttcccttttgtataaaaaagggagctccttgtaaaggtcagaaccgcattaaacccaaatgcagatgagacggcaagcaaggaggaggcgaggcgcaagctgcccagcctttgatttggccgaaaaattcaatcccttctgtcgctaaaacaccagaggcgtggccggcaccgcaaatcccaatcaacaagaggcaagtaggcaacaaagctaggctttcagatgattccgggccacgagaagctaatccaggaaaattcaccaagaaaaagctcaaatcatttggaggcgagatgaatgagcgaatgataacggagtcaatctccaacgcagataacatccgttcaagactgatagtgacctggtctaaatatcttcaagaaagggaggaaaaagaagaaaacaactccatcgctaaggatcgcagtagctttggcgcacagccagccacacaaacaaaacagctcctcccgaaatgcagagtaaagctcaaagattcatacagcatccaagaaaactacatgggatccaaaccacgagagatggcgatctcctcatcagcatctaccacgaatcccagacacaaaggccaagaaatcccgcaaaagaattcacccccataagacgtgaagcttcctttcttactcacctagtcctcgctcctcctccaagaacacgcgaagaaagaagcaactctagatgaggcagtcgataacccgggggagaattttgtttttggtttttgccgcagttgtgaactggcggctgggttgggaggggagcagggctcgggttcttgtaggggaggaggacgcccccggggagggcagcgacccgaggtggcgcgtggcgggtggaaggaaaggacacgtgggcggtggcgtcggggggcgggggcggttagggccccgggatttttatccccgttgatttgcggatgcggggacgggaaaacgggaggagttcgctgtccggactccaggcctggaagcttttgcccccggcaaggctctggaagggccgaagggagggatcgtacgccttgctctatcaggtcacgatttatttatttattttttaccgggcttggccggtagaaggcccagcagaaattttgtgcttctgcattgttttctccatcttaaaataaacgatcggaatgggatatgatacaccaattaggaatatagggttaattggatctatggctatatccgctaatctgaatttagacataatccggatttattgtattaggcgtcccaatctagattggtttatttggaatagacgtaatgcacactcctgctgtgtaaagattaatttaggtgtgtctatattctatagcactagtacccaataaaaggaaacctgaatagcaagggctagaaattttgaaaaacggttagcatgtggatttttcctcttctgtctactagctcattttcaagcagcgaagctattcgatcaagctgtaaattttggcatgttcgacagcagtggtagcatctgcagtcgcacattatgcatgctgtttataacactattctggctggatacggcgcaaccacaaccctaacagccgaataggccttatgagaaacaactaagcatcggatcttggggcttgatcagattatagccaaaataaaccttaccaagttttggcaatgcaaaaaatttagcaatacatttttggcaagtgataggatttcttatgtattgaccagatttggtaacgaactaaacgtagacatttttttagtagctttgcgaaaaaaatagtagggttgaaaattgaatcagagtgaacatgcacttgataagctaagatatcttagcttctagctactaattcattttcaagtattaaggctatctaattgagtcggaaatattagggtaccagctcgattgcaaattcaattct

SEQ ID NO: 33166 - DNA, 1420 bp, Oryza sativa
  unsure (1)..(1420): unsure at all n locations
cgggccattgatttgccaatctcattctcnnnnnnnnnnnnnnnnnnnnnnnnnnnnnnnnnnagaacaaccgaatagcctcaatgctctgtccatggctggaaagtgcagagatcatcgagttccaccattcggtgtggctggattgcatgttgccgaagatatttcgtgcgaaagcgaggtcaccgcacttggcgaacatgtcaaccaggccattcataacgaactggttcttccggatacggtgctggatgatgaaattgtgaacctttctcgcttgctctagcgaaccgagctgtgcgcaggcagagagaacacctgccatggtgaactcgtccggcttgatcttgtcctttagcatggagtgaaatgcttccagtgccttctcgcagcatcccattttggcataccctgctattagtgcgttccagttcaccaagttgcgcacggggattttgtcgaacaccgcttgcgcttcgtcggcattgccagccttgaagttcccggtgaccatcgacgaccacacaaacgcgttccgcgcaggcatcttgttgaacagctccctcgcggtctccatgtcccccgcggcaacgtaggcctgcacggccacggtccacgtgacgacgttctgcatgcccagcggcatggcctcaaaccaccgccgcgtttccgccatgtcgccctttcccgcgaacccccggatcagcgttgcccacgtgacgggagtccgtgagcccatgccggcgaacagcgcctccgcgctcaccatgtcttccgccgccgcgtacccggcgagcatggcgttgcacgtcacggcgttccggtccagcattccgtcgaacaccctgcgcgcgtcgggcaggaggccgcacttgcagtacacggacaccagcgttgtccccacgaggcggtcgtgggcgttggcggatttcacggcctccgcgtggagggccctgccgaggacgggatccgcgcgggaggcggttgccttgaggaggacgatgacaaggggcaggtggtgagtacgatggggcagtagtttcgagtagatgatagcggcctcccggaggaaggagttggaggcgtagaccttggcgaggttggcccacatgtctgggtcacggcatcctctcgtcaggtagagagcgtggagttgcctcgctcggctagccgccatggcgagcgctcgtccgccctaacaacggcggcggcggcggcggctcccgggcttatataacgtcggggtgtcaaacaaaaatatttctggtattttgggagtgaaacctaacggttcgtaaggaacaatattaatctggtgcaaatgtgcgatttgacaccgacagagatacttattcccccaaatacaagcgggtaaagggtttccagaaagattattcccttgccctttcaagaacagggt

SEQ ID NO: 33167 - DNA, 819 bp, Oryza sativa
  unsure (1)..(819): unsure at all n locations
cggttcaataganatacatcaatctcaatcgcgcatgcctgcaggtctactgtagaggatcccctggcggatctgcaccacgagtagaactcgtcgagctcgtcgaacagcttggcgatgctggtgaagatggagtgtacgcgcacgcagcagggggtctccagctcggcgaagcggtcggcgagcatggccatcacctcggtgagctcgcggtacatcaccgcgctctccttcaccagcctgtgcagcgccgccgccaccaccttgttcgtcctcgccttccccgtcgggcggcacccgatgaaccgctggagtatgtgcttcagatgctgcgccttggagacgagctcctcggtcgtcgtcgtccccgtcgccggcgtgtccctcggcaccagcgcccagacctcggctaccgcttcgcccacctcgtaactcccgtcggtgatgtcggggaagccgtcgcggcgaccgtcggagcaccatttgccctggctggccacgcggcccttcatccggtgcttgagcctgtcgtcgaggtaagcggcgtaggcgcgcacgaacccgtggaagtcccacgtcgcgcgggagcgcgacgatcggtgcgggaaccggtgcgacacgtcgagcatgcgcctcccgcgccgcgtggcgaggaacacctcctgctcgtacgccgggtcgccgtcggcgagcaggcggtgcaccagcgccagcgccttgaccgtcacggtccacgcccgcgttcgcccgagccgccgtgacacggtggacacgcaggcggccacccgcgcacgggagtagcaccgtagcgggaggatt

SEQ ID NO: 33168 - DNA, 757 bp, Oryza sativa
  unsure (1)..(757): unsure at all n locations
ctgagncattgaatgcaaatgtataannnnnnnnnnnnnnnnnnnnnnnnnnnnnnnnnnnnnnnnnnaacattctatgtctgatggagataatctttaggtacaactttgctacttgcttttctatgccaccacaaatgtcttgccccttttcctttattccttctaagccctgtgttctttttcatgttgtagccgggcgtcagaagacagaactatcccattaagtgttatagccgagcgcactaagctttctatcagtgatgtggaatatcttcttatgaagagcctctcggtaattgcatttcttacattcgatctttcataagatattatttgcaatatgccaatatcatgttaattcattgttgggatagacaatgcatgaatgccattcataaacatctagttttgttgtgcataaattgttttttaagattagacattagaatgcttctaatgcttctgtcattttaatgtggcagctgtatatggatagtgattatttgataattactgccttcaattcctcccctttgtgaacttgtctttttttttaattgctgatggtttggtttgtgaatctttacttgtgagttatgggtgtgcgttgtcagttaaactagacatgtgattcatatattttgggttgttgatcacagcaaacccgtggctctccttggtacatgctactattgcttttaccttatacggcttcagggttggacaatgtatcaactagtattcctaggtgatg

SEQ ID NO: 33169 - DNA, 2625 bp, Oryza sativa
  unsure (1)..(2625): unsure at all n locations
gcggccatgaaatgctatctcgctatgccgagccgactctagaggatcccccccgatattctctttcctattgggtgtccgaaccagagcattttcgccagatagatgctacttggaccaggaaaagagttcacatgttattggcatgtttgtaatccgatcaaataactgagatcaaacgcatcataataagggcttcggctcttatttttgtccaatgaaattgtagttgaaccaaacgacacaagtagtattttaacttttttaagagcgaagagactttctaaataaaagatatgggaaggatgaagctatctcttcctaatatctacttttagatgtataactcctaattaagatgacgtcgtggaagaacagaaaagcaagaaaacgtttttaacttactacctagaagctcatatatgaagctcatatatgataggatgatagaaaatccgtgaagagtacgacccgccaagcatcagccaacgcgctgcgccacacatgggactagtatggagcattttccccacatattggactcttgtataccactccctctatttcatcgtaagtgctattgtggttgacccttcgtcttattaaaaattttataaaaaaaattaaaaaataagttagtcataaaggactatttatgttttattatctaataacaacaaaaatactaatcatatttttttaaaaaaaacggacataactttttttaaaaaaaacggacggttaaacgttgaatacgaaaaactacaactgcacctatggtggaacagtgagtactttctttttagagtttttttttttgaacaactcttgtatactactagtatcgtcttttggagtagattgaggaagtctgaacatatccataacttgactagaggataatatatatatatatatatatatatatatatatatatatatatatatatatatatatatatcatgggaccaatttttgttcctgagagaaacaaccccgatttcatcatgaatgttcctggtattgggcctatgaattcagatgaaagtcagctcccacaaatttgccgatgaaatgatgtattgggtgtactccctccgtcccaaaatataaacatttttagcatagtgacaaatcaaacatttttaactttgactattaataaaaaaataaaaatgatcaattatgtaaaattgatgttgctagatttattattaaaatactatcataatatgcaacttttttatttaaaacatgttacttttatagatattgttagtcaaaatagtatctcggagacctgatcagagtttaaaaatacttatattttgagacgagggagtaacttcttccaacaagaaaactgaaattaattatggtcgactccgactcgttaaccacatgttttgcacaatgtcacaagccattttggtggaccggatcgacctgactgaatccctaacacccaagcgccaagccaggcagctgagtcaaacatacgcggtcctcactataaccacgtcatcttgttataaaaccatatcaatttgcagagtatttaaattttcaggacccttctctgtgaccaagccacgcagcctcagtttattatgacaaactcccaaggactcgttcccgcccgtaatgtcaacttggattaatatatagtaactgggtgttacgtacgttacgttgcacctatcgcttctctgcaacttgacacaatacaacacctcaccagacacttgttctttacctacgccctcgcgccttccgggaaccgctactagttataaactgacgatttattatacgtgtccacacgtgatggaagcagctctcgtggagcgtataaaaggagggctggtgatcgatcagctcaagtgctcaaaccctctcaagtttcatcatcacccaacacaatcgcaaggggatcctcaacagggccaacccgacgaacgtgagatggcggcagccgtagaggaagccttcccgatcgggttcacgaaggggataccgtcctactggcgaagccgcaagtaccatagcgtggacagcagcgcggcgggccgcggcacgagcaacctggtgcggctcgggggcggaagcggcaacggcagcgacggcggggcgtgggccgtgcggctgggaggcatgttccgcacgcgcgtcaaggcggcggcgcccgcggcgacgacgaccgccgtggcgaaggtacccgcgcgcgtgctggggcgggtacgggacgcgtacgtggacgccatggtcggcgtggccaagaagcaggcggccgcggcgctgtcgcagccgggagccgggacgacggaggcgctgtggcagaagcgcgtgccggtacgacggtcgcgcgggcagagcaagaagcagctgcggcagaaggcggacgagctcgggcagagactggtcatggagatgtacaagtccgtcctcgcgtcgagggacctctccagcatgctccaggcatcaagggcgcaatagcatgcaacactacatcgtgcaaaagtgatgcatccgcgcaagcttaacgtgaactaacggctgtatataagnnnnnnnnnnnnnnnnnnnnnnnnnnnnnnnnnnnnagaagacntaccttgngacac

SEQ ID NO: 33170 - DNA, 12088 bp, Oryza sativa
  unsure (1)..(12088): unsure at all n locations
ccgtgtgaaatcgctcgccctgtcagccaacgtgaactaacggctgtatataaggagatgtacatatgtttgttgcacaatatgcatggccagaccggctagaagacacttattagacgctcataacccttggattccctttcatccctagaaaagaaaatccgtgttcccttctgttgctttttaagttgcttctgcttcatctatatatgtccaggatcccttcttgtctgtatatccaattttaagcatggttggcgctgccgtgccacctacataacgtgagttgaattgatctttctttctagaggtgaatttgctctgaaattttggtttgctcttcaatcatcatagtggccaataaatccaagttgctattatcccccccccccccaccaaaaataataatccaagttgctaattggaagcccacgtcaacatttaggctgagttcgttttcttcctttcacagcccacatgacccccggtgacctgtctaaaaaaaataaaaataaaaataaaaataataaaaaaacccacataaccacatccctcatttttcgcgcgtacgtttttaaaattgttaaacgacatgtttcttgtaaaaaatttctatacaagttgctttagaaaatcatattaatctattttaaaaaataaattagctaatacttaattaattatatgctaataagtcgttccgttttacgtgtttgatgtattagctcccaacaacagagaacgttgcttcttagcacacggaaaatggaacggctcattagcgcattattaattaagcattagctattttttaaaaaaagaatcaatatgatttttaaagcaactttcatatgaaaactttttgcaaaaaaatataacgtttagcagtttaaaaaacgtacgctaaacatgagggatgtgaattggaaaagttggagaaagaactaagccaagaatcacctcgagtgattgtacttgttgacggcgatatcccgtagtgccttggccaactaaccaccacaaccactaccactcgcggccggtcacgcacacaccacctcaatcaaatttggaattaagatattaaaatatgttactttaaacagaaaattaagtcatgaggcaatatgcacaaagtatagaatcgctaattcttacacagtttttttacaagggaacggtgctgtgagcaagtgagcaacatgccgacgtatataccgcaaaaatcactgttcatttcaacggaaaattgcagtaacagcaatgggtcgagtatgaagaaatcaaactatcaaagagcctctatataccattaataaaaagcctcatgacaccaacaaaatgacagtcgtcagccacatttctttctggggatttcacacctgcacttttgaagtagtacttgcgaatccacgtccttacgggccttatagtaccacgtcttctgaacagaatatgaacaaactgacgaatctgaagtccctgaacccgatcgagctgacgaaaacactaatcctgtttgtggatattcacattacaatatcggtgctactagctctaccatatggcttcctgtaccctgtacgtacctcttatgtgttatttacgatgttcgtatttttgtacattttcgtgtgtataatcgtatatagtatacatgcgaaagcaataaaccatccaggtggtgcaaaagactggccgcgcactgccttaatttagctaggatcggaggaggaggcgttcggcgggggtgagcgagtggcggaagtggcaacggtggccgtaggggcagacgttgccggcgagcaccatgcggcacaccgcggtcttgtagcgagggtggcggatgacggggcggagctcggtgacgccgtgcgcgaactggcactggtcgccgtaggggcagtctcccgtctcctcccacttgttgcacagctccgtcttgaacatgccctggttgtacacctccagctccgcgccgctgtccgcgggttgcgccttctgctcgtcgcctttcttgccgccgtcgtacgcgcgctgctgcatgatttgatagtggtgcgcaacaatgtcaaatgccgatcaaacgggctgagccgtggtgttcgcgaggcgagagcgggggactcaccgagttcggggggttggttgggttcgacgacgtgcggggcttgcggttgggggccgccgaagtggcggtggcggcctgggattgctggttcagcttgaggtagcttgtggaccgcacggagatgctcttcggcagcacggcgagcttctcgggcgtgcgctccttggtggcggccgcgaccttctgctcgccgaggcggagccgacggatctcgtcggcgacggcgacggcggcggtatgcttcccgctgagcagcgcgagacggagggcgaggtcgctgttggtgacgcggagctcggcgttctcaagacggagcgccgccgccttttcggcggcctcggcgaggtgggagaggcaaagctcgtagcggtcggccacctcctggtactgcagcgcgaggcgcgcgagctggagccgctgccccgtggcgtcggcggccgctccttcgtcgtcgccgtcatcaacaagggagccggagaaggacggcgagagcgagacggaggtggctagcggcgacggcgaggagaacccgaagctggggctgaagggggaggagcagcggtacagggcgtcgtcgccgctggggaggtagcgcggcgaggacgcgagccgctggtctccgaagttgaacggcttgagctccaatgccgagcgcaccggggagacaagcgcttcctgcattgccgacggacaccaattgacttccgccgcgaacaaacggacggaaaatgtcacaaacgtgaaaaattttcacacaacttggtacgaacaagtgcacacgtgaaattcctagctgttgtatcgatcgagcttgtaatgttggacctgatcaagtggaggagtaattcgatgcaattacctctcggggcagtgccgatcgaagctagagaccagctgattcgggggagaggacgacggaggaggttggtgcggggatcgcgcgggctgagttatatagcgggggagcgtaaactgtagaaggggagaccgtggggcccgcgcgtctgcgagagcggggcggcaggtgtaacagggaattagccgcgcccgtacccgaagtccccaacacggccgggttcgttagcgctgctgcagcgtatagtagggaattccgtgagaccgtggctacctcaactgcccatcaaatctaacattgtaaacatttttgtctagggtttagactgttaaaatatttttttcaaaaaaggatatgcaaatatgaaatgtatagatgattgtgtcatgtattcatacatattctcctatcaagagaataaaaaaaatcaatcatggggatgtatctagacaatgtgcatgttcaaatacatcctaggattaaactttttttttggatggagggagtaaatttatagtaatgtcaaattcgatatgcacaaagaaacaaaaacatttatcactaaatttattgttttttccttcttttcaaatttttttcatgtgtgaattaagcttaatttttcatgttgatagagggatatacaacaagcgatttgtgcttttatattttttgaatttttataactatgtaaactgtatgttcaacctcaacctcaagctttgcttatctggcatggcggagagccgtttggtttttgctaaagcacatgcaatgcatgcttaatttgcagaaactacagtttagatttcagaaagatgtccggtgtatgtgtagaaaggcagagtagtgtgtctgtgtgtatgcggcgctcgtctagtattgtcctgttgtggaattcgacgcgcggaacattttcagatcaggatatttggtaccaattcccatctgattctggaaacgttaatcctgccaagatcacgtacgggaagtacgctctaacattaattccttcaactatacttcatcgattcccttgatgcggaccaacatgcctacctggctactattttcgtctcaaaataattgtatttccatgatttaaactttgtcccaaaataattgtaattttagagtactaattgccccatcaatcatctctcattcaaatttctctctattataccctcaaccatctttccactctcacataaacatcttttaatgaggagcaccatagtcttttttctcaaaccttaatatatgctaaacaatatagaattgtaattattttagggcggaggtagtacttttgtgtctcgtgtcgtcacgtcgacaaagatgacaagtccacacctcagttgactcaggaacgctctatcgtggcaactaatcgtactcctacaagcgaagtactcggtacaacggtacaaaaggccctcttccttgtacagttatatggagtaattagcggttacactgagctggtagatatgcgcccatattctttgcttacaaaaagccattattcagaaagccgttcacaaaagaaaaaaaaacagaaagccattaaacacgttcatatatatgattatatccacgcagggaaggtccatggaccaattgcagctacgtcggtggtcactagtggcacaagacagacagataagtgactatcagattagttattactacttgcttaacaactaatgaaccatggtgggaccaccctacacgaggagcccctgcaccggactgaggtgaggtgcgcctggcctctgtcactgacctggaagggctagtcaccagactcgatcaccacagcgcaaagaggatcgatccgagctagcgaaacttagcttgctttgcttttacgggtcagtccctgtccgcgagctcaggttgctcagctaacaaaccccgcgtcgatcggatcgatcgatcgatctgtatcccagcggcgtcttttccttaggaaaaccacaccacacctcaccagtcacaccacacacacagcaacacctgatagatgcaatcatgtgttgcttcctgcatacagctttaactaactcgaccgggaattcggaatatcgcctcgcctaccgcaggcaggagcgtcgtattgtgcggcacgtcggaatcattcctggagattggagaccggcaggcgtggccgggggagagagttagctagaggagaggaaacgagaaaaacgggaccatctatacatttgtcgacaaattttctactaaaaaatttgacagatgtaattatagtacaatcgtagtgtaattacactgtaacttgcatgtaactatagtataacttgtacgtaagtttcacataattttgaatcgttagatctattacaagatttgttctggtaaggaagaaaaaaatcacagcacacacatgtgaaaggatttgttcccacgacctctattttactgaaataacatgttaccgagagattcttgaaagttacatacaagttacattatagttacagtgtaattatatacaagttacagtgtaattacactacgattgtactgtaattacatctgacaaatttttggaggaaaatttgtcgactatagtaaattcgagaaaaacacttaagtatgtgggtgcgtgcgcgagatgcgtttcttttcttcccgctgccgcgacggccaaacgaaccgggtggacttttaggtgggtgcttttcccgtttggcgatgccggtaggatggatttgtgctcgccggttgccatcagggtttgttatgcactgtgcggtagatggcgacggttcgtgcgaatgaaggcatgcaccacgacgcgacggggctgatgtgccgcttggaccagaaatggatgctgatatgcgatctctggattctgttccattcgtcgtggcaatccagttcgcccctccacccacccaagatatagattttacattgatttctattaacacatttctcaatctagtaaatgatgtattacatgtgaaaagatgcttttaaatataagataaatctatttttaagtttaaaataattaaaacttaattaattatgtgctcatgacattcttgttttacgtgtatctacttaatcttgaccattcgcaagttggaacggttgcatgtacttaagattaacaaggacaattcgcatggaaggatatagcgtaaattatggcatggcaaaccataaatatagatacaaaatcatattaattatgatgagtataatataaaattagcagggtaacccgcacaattatgtggctagcacagcaacgaatttatattattttttttaaaaaaactatcttttataggattccttattcttatcttgatcttcgtcaaatttggtgagcccctatgacacttgctattcgttaaccctaccatgttatccaccagtccacccctttccgctcgtctgcgcgtcattacaatcatcctcttcatcgtcatcacgactatgaaaatggggttccttttgatagattttagaagtctcaccaattgcctccccttcacttatttggttatgatcccttctctttattgtggtagataccttcaaaattcaaaccttatcattgttaggttcaaatatttatagttcttatgtctcgctagtcaccgccttcctactctttttgatgctgctcctgccacccagcttcgttcatgccatcatcttctagaaaaaattgaaccacaaccattaggagctctatatgtgttgcaaaagaatttttatattaaaatatttacaaaatgtttttttttcaaactttaacaaatctataccacccctcatgttctctgcgaggactttttcaaaaaccccatagggttttattttgaaaaaaaaagcttttttttacgatgtggtagacgatcgttggtgtgtgctattagacgatcatcgggggctaagcactttgtaggcaaacccgcctgcaaaatggcaccccatcttggcaatcgacagttttccaaggtgccccctttaagcgctctaggaggcctgcaaaatggacagttttccattgtattcctttagaaaggctgcaacttgcaagggagcagcttgtaaaatggccatgccaacctctagatggcagcacttaggccctgtttctttcagcctgggattattataatctagattattaagattaagctgaaagaaacatacaacttattaaaatagcttattataatctggagcccagcttattataatatggtaagctcatttatgtgagctttttctagattattgggtgaaaaattacccaccatgctaccccactccctctttagacttgcaaacccaataatctaggctctaaaaatctaggaaagaaacaactaaccgtatattatactacagattataacaatctagcttatagtaatctgactcaataatttagattataataattctaaactgaaagaaatagagccttagctcatgttagcggatgcttgccacgttataaaaaaacacccttctagagaatatttttctttcgtaaagaatggactcgtagaggacgggagaggtataaagttgtgaatgtttgaaaaaaatatttttaataaaagaatggttctgttgcgaagggagaactaccctgcatctcacgggcgagtgttagggtagcaaatgggaagaaaagaaaaatcacacatgtgctctagccaaaacaaaattggtgattaaaaaggaaacgaatacttggtcaaaccttaactgacagagaaatgttgttgcattcacatgggatgtaatgcacgcatatgtaatgcacgatcccaaagtgtgtagatcctgaaggggttcacaagattctcccacgatcggcacttctcccacattgcctaagatggaaagatgcacttgccattgtaatgagtagtcgaacagaggttgataggtgataggcagttgtaagctgaggggatcacatgtgtaaatggataatacgtatattagcgaaggacagctatcacggactatacgatagccgtagttcgccaatggaacacttgtccgagaactaacaaaagacataggcaccccaaactatcttagaaatcaggtcgtgtgaggccggtgcgtgttgacggtcgttatcgatcagtttcgaccgtcaatattaccaaaatagaggagaactagtgatgcttgccatgcataaatatgttagaacaataatattccactagaattaggtttactaaccttttgcagagaatgacaataaaagtggaaggagaatcgacatcaactcagacgataaattaatcggacgatgtcgagaaccagacttgtgtatgaatgggccaagaactcagaattgacacgatgaatcaagccaaaattcacaagtctacgaagtgaagcagcagaggaggccgccagccgaaattgggctggattgggccagccccaggttcggccaaacctgatggttcggccgaaccacccttcccttcgttggatctaagttttggctggacggtcgagatgaagccccaatgacggtcgagatgaagccccaatgacggttggatctaggttttggctggacggtcgagatgaagccccaatgacggttgaagctataaaaggacttcaccttcttacttcactcacacacctcaagcaagagctctatcattcctctcaagttagtttagtagtatctagctgtgtgaatagaattagaataggaatcaggagtccggaagtcttcggaagagttcgggtatggctctagtagctttccttttctcttttgtaagctttgtactttgattagaatactattctacatacatttatggtattggaatactttctgagtatatgagtacctactttacattatattcatgttatactgactatactgctaacttatctaggagatgctttggtgcgggtatagtgtttgcatatgcaattactctatgtcatgacgatgatattagagtagtatctagtagtttaaacgtggtgtctagattacaggatatcattatttggggttatatattgtggatgagaggtgggccgctgatggtgacagctcaataggggtattcctccgcgcctatatatactcctaagttaatttcttggggagggtactcctccgtatttagccccggttggatggtcatgacgggctatcgtaaggaactcggcagtcaggggtggcttttcgaagtaccaggagggcatcggatagagggtattagctagtatatcagttaactagaatgtatgtataatttgtatattagaagtataggaatagatttcctttctcttttctttccacccagcttagattatttattatgaggatgagtagaaatgcttaagtgtcactctacccttggattatcttaacccctgcttagaatatgattatcacaagtaatatataaattattagttgagttctctctacgtgatcttcccacgggataaaataaatacgatacccttggaatactctcaggtgaaatgctacaatggtatatccgtgcgcttgcggatgaactctgtaaccataatataccagaagtatttctgcgccattgctgagaattatgtttctagtaatatcgttaagaaataccaacagtgcgcaatgagcagacaacaattcaattaccacaaatactgtatttacatatccacgtatctttttttttccaggccagggcttcgcaaattaattaatggtgacatccttaaaataaaggaagaaccataagcatacccggggaaacaaaataccgaagtctgctacggatcagatctaatcacagtatacaaagtgtgagatgaatcgccagcacataataatttaatttattctataaataaatcatgacattgcagatgtaaactaccatgaacgcatcattagatctacacatgtaaactaagcagtaaaatataaacagatcaaatatgcgcaacatgtcgaacacgtaccgaggtggcggaaagaccagtttctcggcaggaactactcgtggttgcgggcgtcgacgaaggcgcacggcacgcgagcggagaggaaggcgagccgtcgtggacgaacagggagcagtcacgcgaagcgcttccgaaaaatattattgccgccttctcccggtgcaggacgtcgaaggcagaggttccggagacctgctctcccgattgccggttcacgccggcgagcgggatggagtagtctacgagcgacggcgcagtacagagtaggaggcaaactctagattgatttcgtgtctgttgcgtgaaggtggcgactcggtttatatagagataggtcgcttgatcagggcgcccgcatgatctccactccgcgtaaccgaaccggataagtcgcgcgtaacttattcggactccacaccgaaccggataagtcgcgcgtaacttattcggactccacgccgttttcacgcaccggatttttcgaaatgtttccaaaacaaaacaaatccgaatttcctacagcaaaacaaaactgcaaaagaaggctgcatctgcgcaagggtgaggagccaattttgcggaccattcgacgtgtacgtcgtgcacacacggccaagccaagcaagcgagcgagcgtgtgttccccctcttctctccaccacacatgcttcaagtggctaggaggcattcctcccttttaaggaggtccccctctcctagaataagcaaggtggtactaaactccacatgtatgccatctcatgaggtgggcttttgtgatttttcaaaaattaatctttgagtgggctttagcccatccattaattccaacaagttaattgttacactgatcggcatgcagacaaccactttgaatagagctcaatatccgcaggagaaacatacgcatcttcctcacctacagcttccaaaaagtcgcatatagcaacctgaaacttccagttctctccacttttgagcaaagctctgttttcaagcattgttcatagctttgtcgcaaaccttgctatgtgtttttttacaaaaattttctataggaaagttgctttaaaaatcatattaatctatttttgaaatttataatagttaatactcaattaattatacgctaatggctcaccttgttttacgtatcttcccaatccccttctctccaaactcagtcgggcacctctactacaaccgtatgttttttaagcaatttcatccaggttaacattggttggtacctttgaagaagacaaccaaaatatacgatgtgaattaaaataatgagtcaattatatattatagcactagaacatgattactcaagacacataccacaaatcttctaactttatcctcaatcaatgctctccgacatgaaaaatcaggaagctgcacatatctctcaaacctttgcctaaacaaaacaatagagttaatattaagaagtgcaatgcatacattgataaagaaacatttactattcgtacttacgagttgtaacattattaagtaaacatagtattgacttctgagaatgtttgaaagctactatcactgaatatgcgcagtactttcgtgcttatcccgaaaattgagcaacctatggaacttcgggattttcgtcccattagtctttgtaacgtcatttacaaagttgtatcgaaatgtctcgtcaatagactgagacctatcctggatgagttagtttcgccttgccaaagtgcgtttgttccgggtcggatgatcacagataatgcgattttggcttttgaatgttttcactccatacaaaagaatagaaagcctgagaacgctgcttgtgcttataagcttgatatttcaaaggcttatgatcgggtggactggggttttttggaggtataagctgggtttcgctcatcgctgggttagatggataatagtttgtataaccacggtgagatactctgttaaattcaatggaactctgctctctacttttgctccatcacgcggtctttgtcagggagtcccgttatcccctttttgtttttgtcatagccgatggactn

SEQ ID NO: 33171 - DNA, 771 bp, Oryza sativa
  unsure (1)..(771): unsure at all n locations
cggtatgaattcacttttgaanccngttaaaaaacccgaaggtgcaaaagtatgttctaacatttccggacaaaatcaccaaaacattactgattcatctgcgataaagcaaccactcttgctcattcccgaaaaagaaatccaatggtagattctaaaagcttacttacagcaacatcgatattttaactacttcatatttggctctcttgttatatatcatagggattaagtggcatgaaatgggaagccatttaaaaatgaaggcagtaagacataccttttgctttgagtggaacagcaagttcacaggatccaactggaagtctgagcttctcccttagtgccttcaagtcaggcttgtacatccaagcattgccttcatgtttcacaaggttcttgcaagagaagagatttggaatagggaagcaatccgtcacaaacaggacatggataccacgattgcctcttgaagcagtcactgccacttttgcagcagatagttgcaaatgcagacgtgcaacgttttttgaccattcaccagcttgggtacagggaagtttcacagcaacaacatcaaaatgtgtccctcttggaaaaataggatctggaagcgatggacaccatgggatctttgtttcttcctcctcatcaatccattcaggggaaaagagtctgccaggtgatgcttcccctggcatgctctagcctaatgatcgaaaaatactattcgggagcaatgggtccattaaacaaatttagtggttgtat

SEQ ID NO: 33172 - DNA, 785 bp, Oryza sativa
  unsure (1)..(785): unsure at all n locations
cgtatgaattcgacattgacatacncactttatgcaattaagccaatactttcttcgttaatttcatctctttgttgcatggcactgtccttaaggagaaaaagtagaggataacatcatatctgtgtggaaggaatctagatggagcaagcaaataaagtgggatatgcaaaacagagagggaaaaagaaaaggaagaagagaagattcagtcgtcacttgttttttaatggaagaacagaagatgcaggtactactaaattggattcttgtccagtttaaaaatgcagcctgcagctggtaacaatgaaagaaggggatataatggaagcgaaagatggaacatgacactgcgagagaaccagctgagtagaacattctaccacaaagcatcatatcaagagctatggccaatgaattttatctaagaaagaaaaagagagctagccaataaaacaccatgcaggaagacagcaagggcacatcaatcacgtgtcatgaacaatccccagtggaagtttccactagcttaacagctagctcctcaggacacagagagagcaagcaagaagcttgatttggtcccagctatctagctagctctctctcactgtgtcctgtgtgagagtaagcacaagccatgatgcacattaagccaagcaaaaggattggaccaaaccaaaagtgagagcccttttctgaattctgcagcagccgggagatcacgagacaggacccacaactttgttttttgtttttttgtccaattcaaaagaataccaaat

SEQ ID NO: 33173 - DNA, 1642 bp, Oryza sativa
  unsure (1)..(1642): unsure at all n locations
gtgtccaattgagaaactgctnnnnnnnnnnnnnnnnnnnnnnnnnnnnnnnnnnnnnncttgtaccgccgagcaaaagacctgtgcagcccgctggctttggtgccacctgatacagccggcgccgcgagcattgccacatcgctggccctcgtcccgcccgcgacaccgatcaaccatggcgccaaccacagcgcgtgcatctttggtccctacctgcccctgtcatcgcgcaggtccctcatagtcctccgccggcggtgcagggtcatcggccaccaagactatctccacagcgggctcaccgtgtgcaacccagtgtcaggcgagcgttgggtgctcccgccccacgaggtgtccgacgagaccgtcgtcctcctcgacgtcaaccacaacgaccaggcgattggaacccactcgttcaagttgctcgccgcgcagctgttagtgagccctgccaggacgctcatctttcaagtcttctcctccgacgagcgcgagtggggcacttcccgttgcctgccccatctacaggatttgcttattcgacggcgactccaatgttgtcgtcttgcgcggcgccgtctactggttgtgctgcgaatactcgggttacagcatcctcagcctaaagcgacgaggcgacggcggggagccgaaggcttcactagtgaacctcccggagtcgtgcaaatccgggatgcacaacatgtgcctcgcgctatcgccggccgcggcggcggacgacggcacgagcaacgcagcattgctgagcgtggtcgtccacggaagcgaccgcattctcgtgtgggtccgcagactccgcaccaccgcgcgagggaggtcacgccgctgggagctgcgtcacgttatccgcgagaatagcatcaggcggcctggattttcgcgacggatggttgagaggaaggtggctcgtgcggttctgcgaggggagtggcgccctcgttttggagggggatgagggcgacagtcctctgctgctcgacctacaacgcagggtgttgaataagctcgagacggttagctgggacgactcgtgcaagttgccttgcccgtacgagttagatctgatctcctacatgctgttcgtaatgaaaactttctgattctggttttttacttttaaattcattcatgtatgggacggtttcgaattctatctattcaaatgccggttgctgatcttttctcagtgctgtactcttttcagtgaaaacacacttgtaagtgttgttttccatgtgtttgatcgctatctggtgtaatgcagtacctatgttttaagatgtgaacgaattgggtgctctactacgtcacataagacacggggacgagtcaagatatagaaaaggcataatttaatttggattgagatcccaactagtatcatatttcatacacgagtgatggcgagttggcaacaacagttcagaggagcaccatatattcagacttccatattattgttccttaacgtctgaatataagttcacatcgatacaatggcttttcaaatggtagcctcgaccaatttaggaggaatcaacaagttcgccaaagattccttcggggatcctctagagtcgacctggggcatagccaagtggatatctaatgcccg

SEQ ID NO: 33174 - DNA, 17691 bp, Oryza sativa
caattggtacaaacctcagattttagagtttgtttacaaaccacaagatttagtatgtctgtttatcaccaaaactacatgtattttatacaatctatcacaaaactacagattgaagaacttgtttcacacaactatagatttagtgtattcgtttatcacagaactacgcatttaatgtattaatttaattatcacaaaactacatatttagtgtctccattatcacaggtttaacaatgctaaaacatgtagttttgtgataatgaagacactaaacctgtagttttatgataaatgaagatattaaatttgtagttttgtgaaacaaattcttaaatcagtagttttatgatatattatgcaaagtgcatgtagttttgtgataaacaaagacattgaatctgaagttttgtgaaataagttcttaaatctgtagttttatgataaatcgtgcaaagtatatatagttttatgaaatttactcatttttaagggaccatactaacccgaattttaggagaatatttcctgtcagagaccatcctatctcacctattctcaaacaagcacactaaaaaaataggtttaatctaacctgactcatcccaaccctttaaccaaaagtatgcctacaggatgcatgcatacataacgtaagaaccatagctttcataagcagacaagtgtaggaatgtgggccgagcgcaagagacaagccgggaccgtgagcatgcacacttccttccaactcgaagcacgcatgcctgcccgatcgatcgatcgatcatggatagatgggtacgtgaccaccacagtctggtgagtctggtcacgtacgtacgtacatacgcacgcatgctacgctcgctagttgagctccatgcgccgtgccttggcaacaagttccctgggtctagggcagcatgcatgtgtaccaacaccagtacgcgcgtgggccccgtctctcgatttgctctcaatcattgatgattctctgcccactgcgccgtgggcccccccggcgtgtacgtcctaatcgcgcggagtggcgtacgtggaccacccggccacggccactgccatcgatcgatcgatcacgctcggctcggcgcttcttctcggcgtacgtctgccaccaacaccgcgccgttatatgtctcgtgcgctccgttacgttgttcgatcgccaagttctatttccaaaccgtcggataagagttgcaacaaatggctgatcgatcgatggtacgtgttcaacgtacggtggtatatatatgcccgtgtgggttgtggcacaatgggagacagggccaccatacaataggggtgctgactggtaagggccaaatgagaggcgaacggtatgtctcaataccatggcagtttgtacgatttgagcactaacgggtggggctaggatcgagtcgttgaccgttatacaaaatgaaatgaggattgccgcgacgattggaacagccacaagagagatggctaacttggagttccgtgaaagtttggtcaatctaattgtgtcctagaaagtgatggtttttcaattcgaaacagttatgggtttctctccattttcattcaaaaaaactcaatccgtccattttgtttttatatgttttagctgtcccaccttcatttcacataacagtttgcatatattcctacttccaattagtgaattgtccaggaggtggtagaataatcctactgcaaagagtaccaaaattaagtgggtgaattggagaccccaaatcgaaaaaaaaaggtgaaaaataagtcagacaagtcaaaaagagggtaactgcgtgcatgtgaacttttacatcgattgggatagtactcattttagaacctaaaaattctctttcgaggtaggggcaattaaaattccaagcaagtgatgcagtgcccgataagtaaaaacgtagtagcagataaaggctagctggcctggcacgtagggtggtgtagtattgtgggagtagttactctggtccagaccatcgaagaggtgttacgccagcttaccgcaaatggaagaaaaatccaatggaacggtaccacctcagaagcattttatatatatatatatatatatatccaatggtctctcgatcgccacaaagcatgcaaataccagctagctctagctctctctctctctctctctctctctctctctctctctctctctcgccttattctttcactccctaaatatgaaatttttttgaggctcgattaatattgatccctatatcgagtatattgtttgtaggctttaggcttggaccatggggtagttggaagatggatcagcctagctattgaactagtagcttggaccgtagtgtgcgactgtgtgcgccacagtgaagcatttgttgagcaacgagcgatgcaagaagagaccggactaaacaatgcaatgcagttgatgctcctgcgatagatcatgcatgcatgctcacagtacaggatcccgaatcttctggcaattgagattgagtgattgcgatcgagcaatcgtggggtgagccagtctctaccacatgcatgcatgcaacaaaggaggtactctacgtaggtccagggtgagtccatctttggcactgtagttatggaagcgcctctcgcgctgggagaaaatggcacgtaggggtactctctctaagctgggcatgcaagtttgtgttttgtttggttcttcttcacccaacataagactgctcacgacgcatttgttgccacagttaaaatccgattccgtgttgtacacacacgtatgtataacgtcatccagcaggctccgtgcaccggggggattcgcggaatcgttcggtgaaaaggctattggtcactcaagagtcgagagaccctccacactcaagtgtagtactagtacttgccaagaacggcaaaggagcgacgacccttccttacgctgttacgcacgcaatctccgtgccctgctctcccctgttgcgagctactccacggagtatagagaaatggagaagaaaaagatatcatcatcgtctcaatcattcaccgttcgttgggacgtgacggggcggacagatgtaggagtacgacgtacacgcagagacgaggtgcgtggagtgcaaagacgaggaaggcgtggcgtcagccgcaggtcatctccgccggcggggcgcgcgcgatggtccacgctacatacgggcataccgctagcagctactccggccgcatgcgagcacgcaaattgcgaggcacacaaagccgtagtactagctgcatgcgctcggtggggccggtgttctgcgcttcgtcgcgtggggcgccgcggtaaggtcacgtgacaggcgggcgggcgggggcgtttttgcaccgtgcattgctgcacgtcggtcgcagcctcgcaggcgggatggcatggcatgcacgcgcgtgacgacggcagttggcaggcaggcaggcagcatactctctcgagcgccgaggccgcggcgcgagcgagcgcagaacggagaacggatggatggatcgacggctccacacaattaccgggatattccatcgcattcgcatcctctctctctccccgctcgcgtgacgagacgagcgtttcccgccgaggaacgcgtgacgggaaaggcgagccatccattcgtatgcatctaccgacctgtagtatcccctctgctcgctctctctgcgtacgcacagcctggcaaaacggatggaacgcgcagcaaggtgcagggcgcctgtgtacctttttttttttttgtttactcacagtcacagcacttacagtttacatttgggttgtctgagggagcttgggaccgttaacgttcgccactaaaggaccgattagtgtagggtccgatctagccgcattagtatcgatcggttgcgatttgcaaacatgcattgacaaatcaaagtgatcaaggcatcatatagagagccaccgcccaacgttgagatcaacgggaaatacgctccggatatctttctgctcagagtaaggctaataatacagccgacctgttggctataagattctttttatcattctctcagcctacccatataatagttagctctttacaattaatataggacccacttatctctctcacagaggttcttatgtccaagccagctgtaagtctacagtccgcttctcctctctctccttttttctctcatccgtttagacagcttatagcctgcttgctcttatatgcctccatgagccagaggcgggtacgtcgcaatctgatatcgccactctgctagctgcttcaacctccgtagggtcaagatcagcaacgtgtcgatttgacgttgcgtggacgcgggctaatgatggcaccatgataggcgtggctctcccgtcgtcaaaaccggagtgaaaaagagaaaagatgccacatccacgctactacagctagctgcatgccgtgccacgccgttcatatatgcattgcatgcatgcaaatatcactcgctagacgctagcggtcgcgtcgcgtgtgcttctcgagttgtccgtcgtgcgatcgacgggcgtacgttcttcgatccccggagatccggccgatccggccatggagctgatcgacatgaggtgcttgcattgcattgactgacatcgcgcgttatgccgaggaccccactggagtgtactccgtacgcgatcgtgccagtaccggagcgagactcaattttttatagttgccagtgacctcacgtacgtcgtgcacagttgccagtgacatcatgtgcaagatgcatgacgacgctgcgccgtggcagttctattcaattcatgcgtgctttggcagtactaagcagctacgaggacggcaggaagatacacaggagctatgccgatgctgcagggtacataaacgctgtagttttacatcgacttctccctgcctttaaatcgaaatgtaccgcgtcctccggagtcccgatcgagctccgattggaggagtgtgactgtaggcttaattgtctcctagtactgtctcctgtcgcaagtaggagtagcattttataacgacacagtcactaactaagatactaatttgatcattaatacgtgtatgacacacatcaattatatagtaaaattataatattcaaaaactaatttgaagataaatctagctatcattcttaaaaagttgatacgaaatattcatgcctatactaattgaatattttatagcttccacgttaaccataaatattgatataatatcgtataaatattgatacagtttatcataaaactacgatcgtgtataaaattatgggcttcttaaggtaacctgagggcctctctaaaagcccatcagtatatatatgttatgagttatgacacaagttaaaacgtataggtgcatggtagattggacagaaggtagatgtcaaaacgaatattgttggatgagcttttagagaagctctctgtttacctctaagaagcccgtgattttatacgcaatgtacaagttttacgctcaattaaataaatgaacatatctctctcttatatattaactcctgtagtctcttttgacattgtgaatgatctcagttctgtacttttgatcttcaactcttctaacaatataatagagatttgttaggttttagacgtttcagtcacctaaacttgcattgcgaagcctgaaattgcaatgctacacaatttgcatttttttttgtttactttaactgcagtttgctactatatactccctccttccctaaatgtttgacaccgttgacttttttaaacatgtttgaccgtcgttttattcaaaaacttttgtgatatgtgtaaaactatatgtatacataaaaatatatttaccaataaatcaaatgatagaaaaagaattaacaattacttaaattttttgaataagacgaacggtcaaatatttttaaaaagtcaacggcgtcaaacattttgggatggaggtagtatatggttttactttatttatatctaagtttgagcttttttttcatgtaattttgtagtatatctttatgagctataggcttaattcatataattttgtacttttctatttgctataatttattattcaaccattagggactgataagtataagtaataagggaatggtgagaaccactagattgtcatcaagggatgagaaaagttattgaaattattaaaaatttcaggcacctgaaatcttagacactcccaacataataaatccgcaaaaagctaccgaatcataatgtttttaatcttccttatttttcatatgaatctatcatattgttactttcacatagcaataattttatggagtatttgtgaatatgtagtgtccaaacatttctaagtttagtcgtatatatattcgaaaacgacgtacaaaagaggaaataattaataaaagaaggaaagaaaaagaacgactaggatttgatccgataacctaatgacctatcagatcttgagcaaagtaaacatgcaactaccatagagatacttctaggacttcggttaatcattaggaggaagcaattagagaagattgagagggattaacttcaacctaaataagtatggaattactcctgttaaatctccttcaatcttctttgattaaccgaacaaggcctccttcaatcttcttattaaccgaaaacaaggccaagcattactaaatcttagtggacgcacataataaatagtaaagttctctaaactgttatccagatccctatactctgaaaatgctgttttagatctctaaacttgctgatctgatctaatctgcatactctgataaaaagagaaaaaggaaaaaaaatgtgggccacttatgggagagtgggaaagaagagagaggaggggaggtggcagccacattggctccacgtaagataacaaagaggacatggcaactttggatcgggatgacacatttaaaataagaacttagatctatatattttcaaagttaaaagaactagatgacacatcatgacaagtttaaggactgatggtgaacttcactcttttcccattttcttaaaagaaaaactgcattcagcaagaatacatacaaagcttattgacctttcaatagattggaatagcaattcttggaaatctatttactcaccgcgcataatattacaatgcattcacttggcaacggactataaattgagtgctttgcagagaagcacctgcagcttatttggaagataagagtgcaatacaacagacctaccaagtaggcaagtcctactgataatcaacttgctaaaatatgggtaacaagaaaaatgctgtgataactccactgaactaaaaaacaacactaggtaatgactagaaactggagggtgttggtgtttcattccttgaaatcgtctttgtcatttgctggaagccctctgttcctccaaaaaactgcaagagcactccctccaagctgttacaatagaacgccttaaattagacattcacgaactccagcactcattatataaatatgagatggtatttgctattgatgtgcatgcttgtagcattaggagaaaatagaaatgaaacgtaccgccatgcatacaacactgacagcagatggaacagctacgagtggattcgtgaagtgcttttgggcaagtaaaaatccaagtgcagaactctggaaacaggaagagacattgttaagcacaaatgtcattaaaaattacagcgctctattaaaaattactttgcatactactaaactactagtacttataacatcatcaagattcaagcttgtcaacagcctcgtttcattgctcgaagctcaatagtgtaaaactagacatattcatcctgttatcttggggccttctaatattcaccataattaaacagaggaaacatgttagcctaattaggtggcaacagaatgctgcagagtgctgaaattactgcataagtaaatgagaaactacatctaaacaacaccagcacaatagactgcatgaaacaggcatgttgacttgattatgcctttctggcatgaggcatccatagcaacgataagaaccattaaataaccaaagactgtacaaaccgcaggttctggacaataacagattatatctaagacatttcagcatttatttacctgcatcccgcattcaatagagatagtcctagaagttgattccccaaaagaggaaacttttgataaccaatacccaagtgcaaaggcagcaacatgcagcagagcaacgggaattataagttgaccaccttgagctttcaacacctctgagacttgtccgatctggaaagaaacagtaaattcaagtaaacattgtaactaagttatgtttcatctagcctcatctagccatttacaatattcaaaatgaaaatgaagagagcagcaatttactcaaaataaagaacagacgataatacatcataatcagataaatttgcaaaatttgtggagagcctaaacaatcagcaatgtatggaagtgaaacagaacacggagttgttttcagacttacaggactagcacaaagcaaagtggtgaggagaaccccaatcaatggtgttatggatataatgcgctcagtaaacttaggaaaatactcatgcgccaagactgcaaaataatggaaataaagtcagtaaatctgtcaaagataagatcccaaagtacagcacaacaggtatccattgggcttctttagtacctccgacaatagttggcagtaaaacaacctgaaaagtactgatggccaatccctggacagatgtaattttcttatactgatggacacttgataaataaaaatggattattagttggttttaaatatgaatcatggtgcccttactgcagcatcgacaggaaccagttgaccagctaggagtttagtaaggagtggtgtcatcactatagcaccaatagtcgaacaactgaaatgtaaagataatcacaattagtcagagtagaattgggagcatgacactcaggaagaaaacagagtatctagggtgtgttctatactgcactttcccaacttctactccctctttttccgcgctcacgcttcctgaattgctaaacggtgcgtatttcgcaaaaaaattctatagaaaagttgctttaaaaaatcatattaatccatttttcaagttttttttaagctaatacttaattagggtgtgttctatactcacctttcccaacttctactctctcgttctccgtgcgcatgcttcctaacctgctaaacgatgtgtttttcagaaaaaaattctttaggaaaatagttttcaaaaatcatattaatcaaatttaaagtttttttagctaatacttaattaattatgtgctaatgagtcatcccttttttcatgccggagagaggttctgaaccatcggtgtcgaacgcagccttaatcatgagctacctcattttccgtgcggggagaatgagttacgaaccagcacaattgaacacatcctaagtggtttctgtattaaaatcaaatggcacaacaaaatagcagaataatagcacataggcaaaatagcaccgtatgccctcaattccagcccttaaactatactttgtccaatcaagccatgcatattaggttgttttgcttacacgactaaacaaaattgtgtcaacattcattcagataataattacatcaaactataatagttttggaacatggtcctatcatccaaaaaaagagtttatgtatgaagcctgccatgaaaacctactagaaaaggtacaaggtagtaacattctttaaacgcttcatggctggaagcatgtcaaattgaattggcatgctaaaagcaatctgtgaactaaatctttggaatcgtaaatagtgtgtccaaatttgatgtctcaatagaaagcttgttgagtgtgtaaccatgatatgcagatattttctacgcatgcgagtacagacaatacaaaagtgttggcatcaaataaatatgccggttaaaacttgcgaaactggtaacacatacaaacaatctaaaccaatgtattcaatatttttgagactggctagcatgaaaatgtgtcttccaagaaaaaaacgggtaatttaccatgataacagaatgataagagcacaacagaaatcaattataaaggctgtcactctaattagggataaagaacctcaagaaagatgaaggtacatgtataacaagtagatcagaacaagcaccaaagaaatttcttctcaagcaaatctgaagcttacgttgtcataagaactgaaagtgcgacatttcctttggatatataagtagcaacatttgatgcttgtccaccagggcaacatgacactaaaataagaccagttgcaagaggagcagataacttcaaggtctgtaaaataaacatccatattaggttgcacctaaatatagacgtcaaatttgtgcagatatcttagtgaaaaaaaatgcactagaaggaattttaggttcaaactttttttgcaataaccaaagagaaacactataccactgaaattgtattctatggattcaaatagacagcaatggaaaacaaagaatgcagataacgggtagagtttacatttgatatgataaaattgtatcggctaccctacatagattaactttcttcacataaaaattgcaatgagatgagatatcaccttacaagggaaaaaggtaaaattaaatggaaaaacaaaagaaacttgagatacgtgacatgctcaaagtatccaagacacaggaaatgaaaggaaaaggtcctaaaaatgaaaccagagaacaatcttgaacctttaaaaaaatctttgatgttgatcttgaaccttcaaatctttaaggttgctttgtcagatcagtttattgattattgatttaatcaagacatcaacctttttaatttaattacaattaacatttgcatgaaaaatctcatgaaaagaaaccgtagcataatggcatgtgcatcttttcagggaagggcttgtcaaatcaattatttctttgagcaaggcaccaacctttcaatttaatatttcccagagtttacatgagaatctttaacaagcctgtttcgcatgaaaggaaagcctagcatagctgccatagcagcatatccaaacaaaggaataacagattgtgtttatttcatttttttgttctttcattagaaataataggaaggcatggcctagcattaccatggcaatagcaaatcccagcataggtttgatcaaatactgcgcaagaaatcccacacccacctgcaacaggcaattgcattagtaaacctatatcaagttggaggcctcaagtacagaaaaataatcactatttctttaagagaagacgttcaggagcagaaacatacagtccatggattcctcatgcatctcctgaaatcttcgaaggtcaatgttagtcccattgatagcattaggaatcctaggcccacagtgaaaagatcagtctccaaccaggtaacctgaaagttttccaagaaaactataaagtcagtttctgtggcatttgctgttgagtacagacagtaatgggtattgtcaagttagaaattttaccatcgatggcttgtagatgccaataatggtacctaatatgacctgcaaaaggtgagctctgccttagtacattttttaatatttgctttacaaaccaccaaatgtaacagaactagaagctaaaaaagggcagataaaatcctcaaatgctcccaaatcaacttacccagacagggaaaagagtggtaagcagctcaactattttctcgtactggtttgcttctctaggaatgctctctggcagattactggatatgttagcttcagccttgcacaatagttgacagcttctgaggaaacaacagatcatttcatcattaccataagtaattaaaatcagagcaacaagtgtttaataatgagattattcaagaaaggccagcaatatagttttgctgatctgtaggatcattaatcatgtggatgaaattgcactatttaaaaatataactatgtggcctgtaaggaaagcaagtatgctagctatcacgccttgaaatttttggtctaattagtagaaaatttaattgcaaaaggtactgggctttttttctcaaatataaactactgaactacagattagaaatgccataacactaaaacataaggtgcaacagaaaaatggtgaaaacaatcagattaggggattgaagaatgggtcatgattgcactaaacagaacagcaaatacttcgactgactacagagacagaacataatactatgagaagttccaatcaattcactttctatcttgttctgaggcatgcaaatatagtccagaagatactcaaaatatagaaggtaatgatgaattttcccttaaacatcgaaatgcaaagcttagaaggataggcacacatgccaccttgcttaaaagcatacaatgaagttcaacagattgcatgactaaagtaaacacaactcacacaactaatccactgagttaatctagttgggacagctgaaaatggtagagcaagaacttttggccaccgtgattacttacaaagtcactcttttaaaagttttttttttttgcatctatagcaatgtttagaggaaatttgagaattgatcagttgctagcgtataccatgtacttcaaattcaccacatgcagcatacccattctatatggttattgaatagttcatcaatttcatcccttctagtttacattttacttccttcaaaagcattactcatactaaatgactaaagccagtattttagagttgttactgtgttttcatgataacattaagatacctatacttccaaagggaagtgttcataatgaaaaaaaaactttaagttctgtgaccacatgggaccttggttggagcacatcaccagaaggatattcaggattctccttttacaataagctgcagttgttgaacccccaatcagcagcctttgcagcttcagatgggacttttggttaaagtagcagagaaaggttgcagcacctacttccaattagcacaacgtgactagtgaacactcaacaaacgcagtttgtgttgaccaagtcaaaccctgatctcttctgtaattgggtaatccacgacctaaggaaagcaattccccggacccaataaacatcgacgaggtgctcatacggcacgtacctcagagccggagcagcagtggtcgccggtgcggacgcaatggtcaatccccattcttccttctccttcctaccatagcttggcatcgaacaaacgatccccaatccgccccctgcgtacaagccaacatccagctcagagggatggaatgggaaaaaaaaaagaagcaaaagtctcctccaaacaggctccaacgagcgccgtaccgagacgagcagccgtgcggacggcggcggaggcgatagcggcgtgcggccgcgggcggagggctcgggagacggacgccatggagcgagcagggcaggtggtggacgccgccatgtggaggacgcggggcgagagagagagacgtgcgtgactgctgctggtggagttccggaggtcgcggaagtggggggcagaagggtttaaggctcggagtcggagcgagcggcggagaagcggcggtgctactggtcgttgtcgcgtcgaggaccgaggtgggggcgaggaaatcggggtgcgccgggagagccacacatcgggggcggcttggccgcggcgctcctgtggatcaggtggctccctccctccttgctccgctcctccgccggcgtgctgctgacacccctggcccgcaggaggagtgcgggcgtcgtctcggtctcagttccgacggaatcactggaatgctggatccaaaggaaattcccaaagttcccggtcctgcgggggcaggccggcagctaggatgggccggaccgtgacaggaagtgcataaaaggatcatcaaggcaatgccggtttacaacagtgtttaataacgggttctcttcgttgtcatgcaagtaaatttgatgacgtggaaaaaaaaaggaaagtatggagaaacacattgctacgcatgacaacagctcagagttgactcttgacatttattaatagaaagtttgttgcatgagggtgtagaaaaagaaagaagtataataaaaaaaatatttatgcattaatggtttagaaattttattgtctctaatattgtaggaggatagtttttagtgacattaattaatatagaaagctgcttgtagtcgtgtttatacttttcactcttttttttaaaacacacaggttgagcactaataagattattttttttactgtttttaccctatgagcacatcgactggttggcttggcatatcttgagaaactggaaatatttcgtatcgtttttatctctaccctcttgtaaacaaacaaaaaggaaaaaatatcttggaactcctgtatatggagtaggccaatccataagcatttgaaaaaaaaaatctagcgtgagcctcaatttcttggaatttcttttagccgttcactcttcaagtaaatgtgcaattttcatacgaaacatccaaaaatgcaatcgagtaatcctatgttttatggattggttttgttgactaatcctgtattgttttttttactcctatattatcggactaaacaagttacaaacttttttgtggggaaagggatatattactcaggacttaaatcgtccaaaacaagacgagaaatacaagagcattcatgatctaaccaaaagacagacaggccctcacaacggcctttatttgctaataaatgactgactgaattttggctgcgatgaattttccggagctgaatctccctatcaccggataacagttctgtagcttctttcaccaaaaaagctacctcagacatttccctctcctttgattcgagcatctgcaccaccatcaagcagtccgtctccactacaaactgtttaagcgaccattggagtcccacgagaatgccctccttgcaagctaaaatctctgattccagagcactaccacatcgaggcaggtgtttgcagcagccgaaaattaccttcccgctccagtcccgcataaccacgccaatgcctccactcccagtttgcgcatcaaaggagccatcaacattaactttcatccacccctcacacggtttcctccatttttgatttttatcctcagaaggtcgcctggctggattggttttcccattaacaaaggaaataacatgtttccccttctctacattcgcttgaggatgttgccggatctccaacagtgactttacatagctctccaggaaacgcttggaagcttctatagggggtggttgcttcccatggacgatctcattccggacaaaccaaatcctccaaagaatcagcaggaacacagttcgctcataatccaacaggatttccagttgatcaaaaatccaacccgggtcattgcacagattacccccatttagagatatattacccgcctcacacatggccccccataggttcctggcgtcaggacatctgcacaacacatgcttggtgtcttccttttctaaaccacacactaaacatatatcagattgctccagcttccgctttgctttattctccattgtggctagacaattggtggctgctctccatgcaaaaattctgaccttttggggggcattggtctgccatataagattccacattcttttgcatcttgcggaagaagaactagaactggtctccatattaacaaggttacatgcgagcccatatgcgcttctcactgaaaatttgccatgtttatccgggtgccatgctacaaagtcatcttcttgccgtgaggagacccggatactgcatattgcttcagcatcaacaggtaagaacacctggtttactctggtttcatcccaggcaccattttctgacagcagttccgagacccattttagtctgcagttacctttacgcgtgattggccgtctggaaaaatcccttggcaaccaggggtctctccaaatgcgcactgacttcccattcccgattctccatataattccttccttaagaagtgacagcccatactcaattgctttccacaccggggaagcatttcctccaaaacttgtatccacaagggaaccatttggaaaatattttgccttgagtacccttgcacatagactgtcaggattaacaatgagccgccaggcctgccgtgctagaagtgcttggttgaagagacgaaaatctctaaaacctaggcccccattgctcttcggacgagttaaacactcccaggatttccaatgtgttttccttttccccttttctacaccccaccaaaaattccgtgttaacttggttaactcctcacatactgactccggtaggttaaagatgcccatcacatataccggaatagtctggataacggattttataagcacctccttcccgccactcgacagcaggttttcgccccagataataagccttttccagattctttcctgtaaactttggaatttccctttgcacattcttccttcaggggttgggaagcccaagtatctgtcctcaaaaccagagttagctatttgcaaggtcactctaataacatcccgagtctgcggcggagaggattccccaaacatgattgagcactttgccgggtttatgagttggcctgttgccaaagcataatcagtaatgacctctttgacagcctgggcttgaacgttatcagctttgaaaaacaaaagcgtgtcatcagcaaaaagcaggtgtgaaatccccggggcctgcctacaaatcttcactggcgagagagctccctgagccactttgtcttccaacagcaatggtagtccatcggctatgaacagaaacagaaagggggataacgggactccctgacaaagaccgcgtgatggagcaaaagtagagagcagagttccattgaatttaacagagtatctcaccgtggttatacaaactattatccatctaacccagcgatgagcgaaacccagcttatacctccaaaaaaccccagtccacccgatcataagcctttgaaatatcaagcttataagcacaagcagcgttctcaggctttctattcttttgtatggagtgaaaacattcaaaagccaaaatcgcattatctgtgatcatccgacccggaacaaacgcactttggcaaggcgaaactaactcatccaggataggtctcagtctattgacgagacatttcgatacaactttgtaaatgacgttacaaagactaatgggacgaaaatcccgaagttccataggttgctcaattttcgggataagcacgaaagtactgcgcatattcagtgatagtagctttcaaacattctcagaagtcaatactattgttacttaataatggttccaactcggaagtacgaatagtaaatggttctttattcaatgtatgcatggccttcttaatattaccttttttgtttggttaggccaaagtttgagaaaat

SEQ ID NO: 33175 - DNA, 2848 bp, Oryza sativa
  unsure (1)..(2848): unsure at all n locations
cgtgccttgtgactgtgctcgctgcctgcaggtcgactctagaggatccccctatctggtgtaatgcagtacctatgttttaagatgtgaacgaattgggtgctctactacgtcacataagacacggggacgagtcaagatatagaaaaggcataatttaatttggattgagatcccaactagtatcatatttcatacacgagtgatggcgagttggcaacaacagttcagaggagcaccatatattcagacttccatattattgttccttaacgtctgaatataagttcacatcgatacaatggcttttcaaatggtagcctcgaccaatttaggaggaatcaacaagttcgccaaagattccttcttacggatggctccatttttatcatctgggcctagtgccttctcccggagcttctccagcttctcccttacttttctcttgttctcttgcctggaggttcttgcttctgcaggaccagccaccagaagcgttgctatgaacgcagacgacatgtatgacagtgcatctctacgggataaactgcttgttagccttgattcatgtacagtggttgcctgcaggaaacaaattgctaattaacaggggagcggtttatgccagaactgaagaagaatccatataacacgataatttagattacaagaagcagaggagtatagcttcaaggggtcactgtttctgaagatatggaagacaaagttaaccaaatagggcctacattttttttgaaggaaggcaaaagctttgccttgtatattaatagtagagcaggaaaaattatacagtgttagtcgacaaaaaacgacaaacccaactgacacggttaatcaaatagggcctatataaccaaagattgacatgcatggacatatcaaaatccaattactggtttgttttgttagtatgaatagtctctatgatggaggatttcgttatcaaacttggatctaatcatccaagtatgaactatccaactttcatctattaattaattttcaccaccaaggggatggacatatatagtagaataactgaatatgcatagatgcagtgcaatacatacataaaaaaaatgttaaacctgtcagcataaaaatacagcaggattttgcacctaataatccattcaatacctgagtgttctgaatcaatctaataaaacatattgtatgcacctatagctttgacatatttttctagaaaaaaattaacagcttttgacatatttgtaggaatgtaggcaccaaagtactgcttaaaaatccaagaaatgacaagagaaactggtcatcaattggtgatgaaacatagcaggcatagcatttttcaatataacatcactgaaccacccggctctacttctgattagtactatttccgaagtgaagcgtgttcatcatatctgacattcttgtgcatataaaacctacagttgattcttgcaagttgccttaatacaaagtacttctgaaagtagcagctgctcatccaggccccatcgcatacaggggagatctatctttccatcctcatgagagatgacctccagtcccctgtttccccaatctatcaacctatcctactcgttctaggcctctagctaataaaaagaacatttcgtggttcagctcatgcatattggatcccagcatcccacgatgttattccggaaaacggaagcagttcatcccaaacgaaacagtggaaactggaaagggaatttcagagatccggcaaagccaagatactcggtacctggttgtgcctgcagcaagtcacagtcatcatccgtggccttctgacggcgtagccatttctcgccgtcgccggaaggccaaggattggagggagaagctgcagagccgtgattaccattattgcggctacttgggacttgggagctgggaaggtggcgctggtgatggattgtggtagtgccgtagaagacaagtgctacactgctacctgactgcttgttttcttcacacttctgcatagttccacttgtggacaaaaccactaggaaacggaagcacggaactatagtttggaatttaggagccttgcaccaggaacaaggatgaagtactgtaattttgctttgatctacgaacgctaataattcctctttaaaaaatactactctccccgttcatattgactttttcttaatcaaagttcattagatttgaccaaaactaatagaaaaaaaagacaaattttgctactggagactgctaatatgtggctttagccctaaaacactgtccaaactcacttttgggggaaaacactccacaaacgtggtaatttgccagtggacaccgcgccgattaaaataataatttccggttgaagatgagagaaaaatcacgtgaaatgtaatgcccttggctcacatgtcagctctcttatctctcttctctctatcccctccttccagcggactgatggctgcggcggctagacggataggccatttcgcccgttcagactcacggtcaggatggcggcactttacttacaattaagaactcgcgcgaccacgtcatgatctgacaaactagcactatcggtcggtcgcctacactgtcaacacagcatggctgcgaaacataacactgagttttcttcactacttacaggactggcacaaagaacagcgcgcaggggaaccccaataatgctgttatggatatcatgcgctcaggatacttaggaaaatccttatgcgccaagactgaaaaatactggaaaaaaagtccagaaatctgtcaaagatcaagatcccaaagttcagtacaaccaggttatcctccn

SEQ ID NO: 33176 - DNA, 5668 bp, Oryza sativa
  unsure (1)..(5668): unsure at all n locations
atgagattggaatccagctttggacacanaccacgacgtcttcgttacatatacgacgccacccgcatccttcgcgagatcaagctactccgcctcctgcgccacccggacatcgtggagattaagcacatcatgctcccaccctcccgccgcgagtttcgcgacatttacattatcttcgaactcatggagtccgatctccaccaggtcatcaaggccaacgacgacctcacccccgagcaccaccagttcttcctctaccagctgcttcgtgggatgaagtacattcatgccgccagcgtcttccaccgggacctcaagcccaagaacattcttgccaatgctgattgcaaggtcaagatttgtgacttcggccttgctcgagtgtccttcgacgacactccgtccgcgatattctggacggtaaaagaacaatcctagtactagtacagtcagatatgttgagaattgtgttagcccttaagcacccatcatagtttgaattttaattcgttttgtggtccttttgtcgtaggattacgtggcaacaagatggtatcgcgctccagagttgtgcggctctttcttttcaaaggtctgcaaattttcgtcatgctaaagcctgaattttctgctcaattttacacaacctggtcatttcgtttcagagctactttatccccatccgagattattgagttaatgccgtacattaaatcctttatgttacaaaataatgccatgctcttgaactatcgatacatatgcttagcataccaatttggataatttcaaatgcacttgcaccatactaaactcaaatgtgttttttgcagtacactcctgcaattgatatttggagcgtcggttgtatatttgctgaaatgcttatgggaaagccactttttcctggaaagaatgtggtacatcaattggatctcatgaccgacttacttggctctccttcaggagaaactatttccagggtggggttcactttcccagtctccctgcaaatctgcaattagttggagcctgtcttctatgcaatttcatttaacctttttcctactgatggtcattatcatttcttatacccggacatttttaggaggttcaaattagcgggctgcgggcatttctgttatatttaaacctacaatttatataaatatcagcaaaattactttctatcatgacagcctaaaagatgattacttcaatgcaagctgtgtagagaattctgaacaatgttttagccaattagttcataggtgaatctgtctgtggtcctagaaactttctactcgcgctgtatggaacacatgaggttcgtgagacacatcaaacagttcactcatcacatatttattggaaataacttagttatactcaggctgcataagtagtttcaaaaatgctgagaatggcttggctcttgtctctaggataatgtagtgatggagttttcttgtactggtgttattatacacaaactatctgcacccctatcaatattgaaatactcataaggtgaaacatctacctttatataaagtataaatgtaaaccaaccactgtaaattcgatgtgaagcgtttacttagtttataatgaattatcttcaatattttaaggcatgtttgtccatggttggcttctccaatacttaagttcatttgaggctttagcttataagcctttttccactgcttcagtttatttggagattatactagaaaactggctcagggttgatgttaagctctccaaaactacatatctattttcaagaacacaaatggtgaagatgaagcttggaagaacaaatccgaaatttatattgcatttacattttgaatacattagccttgatttttaatattaatcagtctatcaattaattgtaggatgagttcgatgatggggatacaacctctatatttaaatatatgacattgttgactttattcggtatttggtgttcaaaaggccatgtttgggggagcttaagattctaagaatttactggttggtagccagcttctgagaatctggggaagctgctaaacccagcttaaggcttctaattcattttttgaattctacaactacagattcttagaatctgagtggcaatctagactgtttagggagctcttaattcttggagaaactgcggttgctaaaagctccctctataggtcctttgaccactatttctctattagaatgtaatgataatatctaacaaaattataatattgttaaacgtacttataaagaaaaatctacccatatgatttttatgttttcaaactaaatattttgagagctgttgatggtcaaagttctaaaacattgaccgaataaagtcaatagaacacattatgtgtccactgttttcttccaacaatcagttttacaattgaagaagtacctttagaaattatacttcaaattttgatactatttgtagattcggaatgagaaagctcgacgatatttgggcaacatgagaaaaaagcctcgagtgcctttttctcagaaatttcctggtgcagacccaatggctctccatttgcttgaacggttacttgcttttgatcccaaggatcggccaactgctgcagaggtaggaatgtagctactagccagcatagagcaattgctcaaaaatgttattctaatattcgttatccattatactgatattatagttatgtgtcaaggccttaacagatccatactttactggattggcaaattcggaacgtgaacccatagcacaacccatctcaaaactcgagtttgagtttgagagaaggaagctagcaaaagatgatgtccgggaattaatttacagagaggtactgctaatcttttctaccatgaggattttggtaatagtcttttcttatgcatggtgtctctctctctctctatctttagatattagagtaccatcctcagatgatgcagaaatatcttcgtggtggggatcagtcaaactttttgtaccccaggtcggatgcactatataatgttaccaacagtttccactatctttgtaaactgtatgcagttcatttattcattttaatcatagtgatacacactgcaatcaatcgtgacttatcatacttcattttttcattcacacacactattgattgtggacatgttgcaaataaactgatggctatgctgttgacagtggggtggatcgttttaagaggcaatttgctcatctagaagaaggtgttgctcagggtgacaagactagcccgcagctaaggcagcatgtttctttaccaaggcaatagttctgtctcatatttctactgaagacaattttcttttctgaagtagaaaaaacctatcgtgccccatttcactaaagtgaaattccacagttcattggtttatacttttctatatgaacaagacgtagtctgcatgcctatgaggtggatcaaacacaaacacttttgacgttatatattaatgtcattaagcactatggcaacaaaggggagtattaagagtgcttcccttgttgagacatcaactaaaattcactgccttcaataatacaatttttatagatagtgaaaatggtttacattcccggccttttccatctttcagtcttttttctcttgatctaatttgtttcacatatcgtttcagggaaagagttgttaggaatggtgatgaacctgatccaactgcagattactgcataaagttgcatgtaggtgagcaaccggggcactcatcagtgacagatggactgaacaagccactcttaagtgctcgtaacttcctgaagagcgaaagcatcggtgcttcccagtgtgttgtcataaaagaaaagcgagaaaaagatgtaagtgatttcatgcagcaaataatcgtaagcataattatgtacattgtcagttactaagtcaaaaggtttgattatgtaccactttttaaatcacaaggttataaaaggaatgtgcctgtctgaagtgcagttgaaggttataaaagcagatacccatgtagaactttatagccgactctgttaaaacttacagaatcccatgctcattacatcaaaactttccttcatgaatttgcacagtttttgttggctgccttgcttagaacaaattgtttgttcagtggagccaatttaccatcccaatggcctagtggctcctaactttcagaaaaatgcttctagattcactgaatgtttaggtgtcttttatgattatggccaccggattatcatggcttcccaaactcctaaacagtatgatgtttgcaaaaactttctttatcaacatttcttaagagacctttctaaaatcaacttatcaaccttttaatttttaattcattcatttctgccctcgaataattgtcataaactcacttttatccatcatccatcagcactttcaaatccttcggagtttcatatttataactcgtgttaatttcttaatttctcccctgatgcggtaacaaatgttctaacttcagcttttttccctgatgtatgcaggaagaatctatgtcagaatatatgaatgaagcagctgatggggtgccgcataagattgctcaattgaaaacataagtatctcttactgtacaggtgatcaatccatatagcagcacgtagatatagtctaaacttaagaagggcagataaatgaattagatatttaagtagccacagtttttctcggctccttgttgggatccatgttgtgttgaaatctctcccctgattttttcgaggagctaagatatatttgacttcagctcctgattttagtcgatggatttcactgtcaccctatactttattcttagccgagcataggagacttagtcactgattagatcatgtaactagtgataccaatgtatcaacatatgcatgaattaactcattaatcttgtctatttcccagtctgataatagtgagcatgaagctgtttacctctttaggtctcggtatcaattaggagtatcaaatagcagaaaattagttgtgtatggtagtgaagtctctaaatttacgctacctgtttagtgatatgtagcaatcaaggtccttgattattcaatttcaaaatttatccagtacttttagcacagttgctttatcaagttcaatacagctgttagcaagaatctctcactgcaattcgcgggttcatatagtacttttaccattgttgcacgccatgttgtcctaacgcggtgcccatcactaccatgtgtacaagactacaagttcgttgtgtaccgtcacaggtcgccgtactgtttggttgtggcactgttgaacttcagttctaacatgacgctgatgaggtcacgagtcacccggtaggatgttggccagaattatttcaggattatttgtataccattttgaaaatgttatatagggatgtacctaaagttgggatatgtattctaatcccaaatatggtgaatatggccatgcatgaaaagtttcaaaaacaaaatgagaacattcagaagatcaaagaaaaaaatcatgccaaaaaaattgtaaaatacattctatnnnnnnnnnnnnnnnnnnnnnnnnnnnnnnnnnnnnnnnnngatntacgatntcaatnccat

SEQ ID NO: 33177 - DNA, 932 bp, Oryza sativa
cgcccttgagttcactttgaatacccctcggacccgccattggcggaggaacataactgatcctaggctgaaaacttgctttgagaagttctgcttctgggagagcatgttatggcactggggtgaatccaagaactcaacgaaggaaaaccctgtgccggccacacctaccgcgagcctcacaagttcatgagatgtgtagatagccctataccagatacaaacttctaagctccatacatacatagcaacagcttgtaaaggtagctatgcttaggtttctcgacaaaactataccttgtgtttgctatcatggcttcggctccactctggctgctttgatagctcacaatttttttggttttttggccaataattcatcagtataggtaaattttctgttcatgaattgtttggtcagtctggggttggttgttgctcggctgcaatagcctagttcgatgtatggtggttgaactgtttcggtgataaaatctggagtgacgcaacatgagattgctgaccagcaaacactgcctcattttgacatgaaatacagtattgttttaaaattgagttggattaatacggtcacggctgacatccacagatggttggacgttggagcagctggggccattttgcactggaagtccctgaagcacacgaggttgtatgtatgctttgcttatatttggcatacttagttaaggcttaagagatgggaatctttgtttttctcatagcaattaattgcgggacttgcaatcaaacatgcattcaaaactcaagtgatgagccccattcgtggggcactgatgcacagctgcacaagcagagaggcagtgccaacctaacaatgcagcattgaaacgcactgctgctcactgcaggtgtggaacatgggcacaaccagatttctgaagagatct

SEQ ID NO: 33178 - DNA, 2291 bp, Oryza sativa
  unsure (1)..(2291): unsure at all n locations
agggtgaattcatcttctacccgattgatacccactcaattcagtaacaagcaaagaatctgaagctaccattgactgctattgttgaatgatgatgatgatgatgttgtttgtgcaggttcttgagagccatcttgagccactgacggatcagttgtttatgggcatctgcaacctacagcagtcctcgcagcaggtcgaggacgcgctgtcgcaggggatggaggctctgcagcaaacgctgggagacacattggcatcggcggccgccaccgtggtcgtcggcggcataagcgccgacaacgtcaccaactacatgggacagatagccatcgccatggccatgctcaccacgctggaaaacttcctcaagcttcggtcaaacatcaatggcgaactaaattgcttattaccatggcgtgatgcgatgatttttttttgtgtaggctgatctgctgaggtagcagacgctccagcagatgcaccggatcctgaccacgaggcatgcagcgcgggcgcttctcgtcattagcgactacttctcggggctccgggcgctaagctcgctgtggttggcgcggcccaaggacgcgcgtcacggcgtggcaaagcgcgcattgcaccgaccgcgcccccggggggacggctaggtacgcgccgcaaccactgcatcccgctgtcggggaccttctcccacccaccgggcggctgcccaagaggagaaaagtgagagagagagagagtggaggaagggagaggagaggaaagagataggatgatgatgtggaatcctgccatgtggggctcacatggatccatgctgattcagccgtcacgtcagacaaaatcgggtcaaaaccaccaagagacctaaagtaaacggttttgtaagttgaaggatgttatatatctggttttgcagttgggggacgattttgtaactcgatgacaagttgagggaccttcggtgtactttttcctttgcgatttaggggcacgattcaaccggtggcaagacatgaggaagacagaatagacttattcatccacagttccgtcgtggcatcgtaacatgggcccgaactctcttgggccagaaggttgatgggccgtcatccagccaggctaccgtggtttaggcccaaccgcggccgaaaaatcccgactcgtgctcgtgcacctctcggttctcgcagcctcccctgttcgcccgtctactcccttcagcagaaggggacggatatatattgccaacttttaaatctactactagtaaaacatcaaacttcatgggaaaatcatcagctatttaattgtacaaatgtatgtatgcactacgcacatgcctgcctgctgcaagcttagctagcaggatggtattatatattgtcacagtttactccagacagcgagatacttggtgatccggccgtgcgccagcacctcgccggcgcccttcctcctcacctccacggtgacgcacccggtcgtctcgccgatgcccagaaccctcgcctccatctcgatctcctcctgcgaccacgcatgcatgatcgatcaatatccatcgcgaagcagccgaagctcgatcacgggtactgtacttacgtttgcacgggctgcgtcgaggtaggagacggtgatctcgacggtgacccccgtcttcggcgagccgccggcgaagaacacggcagaccccaccaggtccaccagagacgccaccgcgcccccatgcatgcgtttgctccttgcattcttcactcatttttcgagtcgtaagcatacgtatacacatgtaagcgtagatgtgtgctactccgtcccaaaatatccgagcggatgatttttttttatatatataacgtgtaatcattcgtactattaaaaaattagtataaatatatgaaaatataagttaaaactatagtttcttttatgataaacaacaagttacgacaaaaaataatatttttgtaacttttaaataactagcaaaatgtccgtgcgttacaacgggtgaaaaaattctaatgataatataagtttttcatccataatcatgtcaatgacaatgtttgtattttaatgagcggcttgttttttttataaacggtgttttttcttgctcgattttctcaaactatttttcagaaatagcgcatttatttctaacaattttttcctagcatgttttttccttttttttactgatgacgaaaaccatatttttctccccttttggggatcctctagagtcgacgtgcnggcatacggagttgtcatcaatccgt

SEQ ID NO: 33179 - DNA, 1625 bp, Oryza sativa
cttatatatatctccaacataacctttgtatgcgaccagaaattggtgttctagtttcccactgaatattctactgctgacagaatattgtaataagtttccttttatagggtctactcacaagaaattagactgcatttgatggtcgtacacagatggagtgtacaatagtgtcaaaaatgcagcagacatgatcgcgaagagcagaagttgtaaggaccggaacttgcaaccagagcttttctctaggacaaagacatcaaatttttcgacctctttgaaacttttgcttttctgggtccttctcttagctgtgtcatccctgaaagaaggtatagaagaaacagtcagacagcgacttcttacagtaattatttgggcatcaaataataattggtaaagaacaattcagaaagcaacccctgaatgtaggatagtcagcaagatgaaacaaaactttggaatttgcaccaggtatgaagacacaagggggaattctgtctgaagaagaaattgtatatgaaagaactactgaataaataagtatgatatattttccccaaaaaacagcttacattgttgtactgttttatcgaaagcacatggaagtaataaaaattgctagccaaggtccatatcaattgtaaggccccattgttcccattagttaatcccaaaaagatagcttagaaaacatttttcttggtgatcatgttttgttttcctagaagtttgcactagtcttgtgtgtatttgatctggctggcctatatggacaaacagccctagtaacactaaatctataaaaaaaatatagcacatcttttcaaaggagtacttaatctctcatacggtagtatggaaaagcgatcatagtaaagttgattagctatcaaagaaaaaaggctaaagagaacaaaatagcaaggttctccgcactgagaattaaagaaaaagattagcaaaaagaagtggtgccaattcattttcctccattcttcctttattagtcacaccacatcttttaggaaagaaaagcatcactaatcacaaagatactccagtacctaaccccatgttattggtctcaaatttaaaagtgcgcttagcgatttaaataacgttaaacatgaaacgaaaagctgcactcatgggtaatcccagctgtgaacaccaaagctttgtcaagaagtttgattcaaaacaacggagccggcccctgactactgaacccactagactagcgtgcatcgaagcatccaactagccaaaacccagcattctatacacacgctaagctcgcccatttggcgctgatgggccacacaggcacaaaacaactgtagcttacgcttcaacgtgcctaaagactggtgaccactgaggactgcacatggaactaatgtgtgtagcaattttaatggcaccggcgatgcaaggtgcagtcattggggtcaaattggcagtgaaaacacatgaccaccgacgcctggctccacatcacagcacatccaatttaaccaaattgcagccgctaaaaaggggatcagatggccacaaaagtaaaaccaactttccgtctggagataaaggaaaatccgcaaaacagacatccattttcttca

SEQ ID NO: 33180 - DNA, 3269 bp, Oryza sativa
  unsure (1)..(3269): unsure at all n locations
ngggaaaaaaaggaagggatgatgccataaaaagttgcncaactaccacccnccacaccaccttcaatatgaggaaggttagggagagagccataatgaacggagaccaaaaggagaacaccggcatcttgtacagcgtcctaaaaaccagtacaccatcaccactaccacctcctgcaagaataccccgacgatatggccggcgcggggcgccacgcatcgaccaagaagtagaagtaattagttttgaagtcaatcgaactcgacatgcaacacatgatagcacatggcaaagcaacgcaccacagtagccgggttagcaagcgagcacaatacatcaaagcatgtaaaccagctaaagagagagagagagagagagatagagagagagagagagagagagaagnccagtggaagagaggcacgcaaaggtggagcctttcttcagatcgggacagcgtggtggtagggagatcttacgctgctccggccggccggtaccgcgtgttcgtcgtctccaatttacccatggggactctctttcgttctttgcgagcccacctgaatcttccccgagccgtcagctatggctctccggtctcaggcggtggccgaccacactgtcgccgccgcggtggagcagcttctcatctgaaatcggagcaagaaacaagggaggattcgtgtgagcatggagttcaccgaggcaaaagaaaacaatccaatgcggccacagaggacgaaggaagagagagagagagttgcacgcaaaaaactgaaattttcccgagaagaacagcatcatagtgagagcaaagcccaggagaacaactacacacacacaccaaaaaaaagagtaaataattgataaaaatgcgaagtagaagggagctgcaaaatccaacatcgccactggctaggagcaaggcaacagaaaaataaatctgctagctgctgccgcgcaaaaaaagagagaacccggacaccgaatcgagcaaatggtggcgccacatcgccatcggaaaaaaaaaacccagaagcaccaagcccggatcgagcaactcccaccggcaacgcatcaaacgcaaaccagatcaagaagagcccaggagcaacacaagaacaggaggcacgcagatgccacacggtgaggaagaaggggaggaggatgctggatgcagcagcacacgcacccgcagagaaggcggacttgggagcaccgacgggcgcgccccggcgtcggcgtcgtcggaaatggccgcagttggtggcggccgagtgggttagctgggtgccaccggctctctcactcctctctctatactctctctctctctctctcgctgtgcagagctcgcggccaagggggtgtgaggcagcaggagcgcgttatatacaggaaacaaacggggagagacgggggagaccggagtggaagcgaagttcttcaccgatttttgcccatttttgccgccccgcggggccaatctcgtgtacgtcaagggcccaaatttggggatgggctcacggtgattagcgtagtcggtgagaattgttaggcatatatcaatggtggcaaagaagataatggactggaatagaagaagttaatggagaattatgcatgccaaaattggcgtatattcgtcctagtttgtaaccaaatcaaactgggctttattaaaataaagggacaattgtttttttaccctaattttaagactaactctgttttttcgactttactcattaaacattcttttttttaaacgaagatgaggtttggccctattccgtgaaggcaacgtgacggtgttaactcaaggcaaaaattccaattatacccttgtcaatttaacccagtttctcgtgcaaatttgtgtccaccgaaaaagaaaaacatgtcacatggtgcgctgccacggtaggtgctccctcctttcgggcaccaccaaccgccggcgggtcccttcccctgtgcactaccgctaatcgcccgtcgccgccgtcctccctgctccagtcaaggaggagcagcgccaccgctcgtcctgttcagatcgaggaggagcaacgccacagtcgtcgtcctctaggcccttgtcagacgcgcttttagtcgcaccgccgcggccctccacccgcatccgccaccacggcaaatcccttcacgcctggacgcagccgtcctccctccctcccttcgtggcccgccgccgccgcccctcgtcgagccacggcagcggcccctcctcgacgcgccgctgcggcccacccaccgccgctacctccacccgcagctggtgtcgccatcctccctccgcgagctggcgccagcgcggattccctccctcggaggcccgccgccgccctccatgagccgccgctcctcgtcgagccgtcgcagcggcccctcctcctcaacgcatcgccgcggcccacccacagacgctacctccacccgcagccggcgtcgccgtcctccctccgcgagccggcgccggcgcggattccctccctcagaggcccgccgccgctacccctccgtgcgtcgctgcccaagcacacaggatagggttagatgtgcataggcttggagggcattttggtcattatggaaaataaatttatttcttttatttttttaaatgaaatcttaacggtgctaaagaaacagggtcaaacggagtattcgtttttaaaaagtaggatcaaataagcaaactaaaaaaaagtagggtcatattgataattaggcttcgaaagagggtcaaataagcaactttccctaaaataaaccggtgcaaatttaatggcttccaatatgatagtataacagactatacagtagaataaatctcctacttttgccagagtgtttgtagcacttcgaagtacgaactgagcttagctcggctagttatgtccgtggtagtaaaacatggccacactcgagtttaaattataaacttaacatgggacttgtatttacattaattatttttcactattagcaatatacccgtcaatagtgaaatggttctgatatgcttaatcaaccttcaaatactcgtagaggtaagatgtacttcctccgtcccaaaatataacaactttagccatcaggatttattctaaatataataattttctccaccaacattctcttcctcaccaatcataaccctccatcattcactttttccacctacctctccactaatcatccaatctcaaccataaacgggtaggaaaaatgaaatcaccct

SEQ ID NO: 33181 - DNA, 1767 bp, Oryza sativa
cccaagatggagtgttcggagcagaagcctaatgagatcacacttcttgccgtactcggagcttgcacaccggaaggatttgtagatgaaggactaagaatcttcagcaaattcgatatttacggggttgctgctgcagtagagcattacggctgcctggttgatctcttgggccgttctggaagattgagggaagcttatgagattgtcaagaacatgcttgttgaacccaatgaggtgatctggggctccctgctcggagcttgcagggtgcatggcgatgcagagatgtctgaactcgtatcaagtgagatccaccaattgcactcccgtcgtgtgtcaaccaacgatgcagagtacatcttgctgtcaaatatcatggcctcgtcggagaggtgggagcaggctgaacgcatgaggagaaagatggcgctccatggagttgggaagaccccagggtgcagttcagtggagctcgagattactgaacaccaagtatgtgcaggcagtggtacgttatcccagctacactgactgcattttttgcatgtcccaaatgttcttccgaaagtgttttcacaagttgcccagaaaagaaaagcccctcatgtgctggatattctattaactgtacttcttatacatagatgattagacaaggacattagattattagacaagggaattatctgttctgttgcatccctttatcaactggtgctggcatagaaataactacacacttcgtgtcaattttatatgctaatatcagtcaacaggcacaattgaattatgtatttgaacatcaatttttgtggttgaaatgttaaaagaaaaatcttcactaacgatatcagaaaatacatttctgccaaatttccaagatcaaaggcaccaaaacgacttcagggtgcagttcggttgagcttgacatttctgaacaccaagtacacgcaggcagtggtacgttatcccaactacattaactgcaattttgcttgtctcaaatgttctggcgaagcggtttcacaattggcttgaaaagaaaagggattttctatcaactagtatgcttcttgtacatagatgactgtacaagggaaatttataatctgctgcatccgtttatcaactggacacgatgctggcaactgtgcaattccctcaataaaaaaacggtcatgtcaattttatatgcgaataatgtcagtgtgcaggcacaactgaaatgtgaaatgtgaaattctgtatttcaacattaatatttgagggttcaaatcatcaaatgtgaaaagaaaccaaactatcttcactaatgataccagaaaatacatcaacgccaaatttccaagatcaaagcaccattaactattaccaatttactgcattgcaaagagaacacaagaacagagatgataacgaaatggcatgatcatctaggactgggaattcagaattcaaccaagacaagttaaactagacaatcacttccctatcatagatccagctgaacttgaccttcctctgctcatccttcttagccctgtcctcagcccgctccgcggcccgccgcatcctcttcgcgagcccgcacacgaagtcccgggccctccggccctcgccggagagcccagtctccagggtctccagcttccaccgcttgacgaggaactcgacgatgtcggcgtagtcgcgcgcggtgtagacgttgaggcgctgcgccacggcggcgaagtggtcgaacaggttcatgtcgcggccgtcgtg

SEQ ID NO: 33182 - DNA, 3976 bp, Oryza sativa
  unsure (1)..(3976): unsure at all n locations
cggttgggacttgtgttgaaatttcaccaacaatccgcagaaatccgtggttgcaacactcctccagggtttaacaacgcaacagaatggcttccccacccttcaaggacggaaacacttccgccttttcgcgggcatagagtgcgtcacgcggcgccgcgtcgccgtctcggtctccgcggcagtcagcacccccgcggacacgcggcactgccggcgcgagggcgccaccaccgcgccgcagccattgacacgcacggttcccacgacctgcatgactgccactatcactgtcagtcaactacagtagctagttggtggttggtttcttgatttcttctgcctttctgggatcgccgagctgccgcggcgtggtatatgaagggaggggattcgcctccaatggtgggcgaaaccgaaaccggtgggtggtgcagtggttttgtgcgaacgagccgatggtgtgggagagcgaatcctgtgggtgctcgcggccgttttagccacgctcacagctgggtgcacggctagcctccacggtgtctgaggctcatggcttgtctccatttttggccagtgtatcgggtccacagatcgtagtgaacacgtccgttgctttccagtttccaattttccataccggagatctggctgtccctctcgatacgatgtcgccatcacaaaagggaccggggtcaaacggtactttgtccagctgcatgggacaagtaatctggccggcagtgacgtggccatgttgggaaaaacgagctacggcgagaatttttactgtcaactgtggagaacaaggtgaccaactttgttgaaatgggtggttcgtttttgttctgttgtgtgagataagcaggctggttatggtaaacaccgtggtccgcccctggatttcactaccaagcggaacggcacgtgcggcttgtgcatgtgcagcgctggtccatatacaagtggcatgcatttcgcggacgcgctggctgcagagggattccccaagcccaccaggcgcagccaccgcgcgttgctcgngaggaaacaatcgagacagggctggcctgcccctgcccgtctggcgccgcgacctgcgacagattcaaaccaaaaccgtatgtaaacccactcgctcaccaagcggtttcgtatggccaagcatttaaccgaagatccgcctccacgtcccgtgcaagttagcgtccgtgctcagcacgaactcgccattccttggaattaaatttaaaaatatactattgattcgtttttttttcataaatactcgggatgtaaatttgttagcagaaatatactgtcgatctcgcgcaaccgtttcgcataagtgacgtggacgtgacgacgcaaatagcatctataacaggtgtcggccccgtacaatgaaaccgtgacaccaaacgacgaaatcgaggacgtgcgtgcagacggcgtcagaccacacggtctcgcgcggccaaaccgcgagaccgagcagtctctctcaatcagtgagcgattacgacggttgaaaattgttaattagtgattgattaattgttaattaatcactaattaggataattaatcactagttattattcgataattaggataattgatcactaattaagtagaaccgctggacaagacgttcggtctcgcgatactgcgcggtgtgcgtcgtcacgcttctttgcacaacggttgtgcgagattgatggtatatttctgctaaaaattttatgccacgaatatttctaaattttacgccacgaatatttctaaggaaaaacaaatcaacagtatatttttaaatttaattccattctttgtcattgggttgacgagacgttctggaagccgttcttcttcgttatcacgccgactcggtgactccctggttcgcttcaccgaagcgacgaagatactatgttcggaacgagggttgggaaccgtcactccctagcacgtaaaataaaacgtatgattaattaagtattagctaaaataaatataaatatattaatatgatttttttaaaaaataacttttatataaaaaatttttcataaaaaatacaccgtttagcagtatgaaaaacgtacgcgtggaaaacgaaagaggtgagttgggtaagtagagataagaaaggagtgatcgcatcacaactcacaagcacatcaccggaagttttgcacttccaccatgttgtaaggaaaaagtttatattgcctttcctcaactatagtttaagtccgattcattttctcaccgtaacattaagactccttgaactagggttggacgtttggtcaaaccaaaaaatccggtctcgatctttgatcttctacaagtttcggttatctaaaaatagaaaccaattaatttaggaaaataatgaagatcaagaaaatcagtctcgatctcgatcatgactgaaatatcaaaagttctaaaataatcagggcaagtctaagttccagattaaaaaaaccatacacataaacacacacccacaaaacacaaattgactctcttcgctatcacgggccatatatcgaagcatgctagaggccaaaattcgatttaattgggttgctggaccttaatagtcttattgagccaaaatttgatttgtgcagtttatttagttaatcgaaggtactaactgaattgaccgaatgaaattcggtcctttaacacctgatactgatcaaatttctcagctttttcagtcctagttccggtctttttggttcggtttttttctgtctaccctggcttaacaaataaaatgaggagtgaactcctttgatggtttgctcagcggtttcaaccgacgtggcgtattcacctggtccacacgtgatgagtcagtatacacataagcgtcgatattgacgtagttaataataataataataataataataataataataataataataataataataataataataataataataataataataataataataataataataaagcatttagtccatatgtaatcttctctttcctccccactccccactcccttatcttttcacacatcggccatccttcatcttcgtcaagtgcactgatagcctaatccctccttttgccattgagtgtgtcagcggttggatcacgctggggcacatgcaattcaaggttgtcagtaccccaaactgtataatattttacgatactaggatagtatgctacgaattcaaaacgatatcgatctcatctaatatcgtaattttcatagtaactcgatcttactatttatttccacacgatcctacgaaatcttggatagtatcccgatattacgatctctacgatcctaccaaatattatttaataaggtggattgaaaataatgtgaataaatatgctcaagtttacataaaaaccaattaaatttatcaaaatcaatattatatattttaatttatacaacatattatatatcttatataaaattatgtaatttctaaaatctgatagtcttacgatcctacggtagtatctagatacttattaccttggatcatggttgcaccgatccaacgacgaggccaccacctccaagcactagtgccggagtgctccttcaatcctctcaccaccaccaccatcgttgatactctctgccactactgttgatgatagcacgttattatacgccttgcctctagctggtctctcctcatgcttcaaatccgcaccagtggcggggtggacaagctcgggctcctacttctcaatcgaatgggccacctacacgtgggtcctgatttttttttcttcgttaattgtaatttataaggtgagggtggaaaaattacacgtgatttctacagtatttttttaaaaaaattcatgtaggtgtcatattggtaaaatgaattgatagttgagatggggggtacgaagntggtatgtcagnccaattctattttca

SEQ ID NO: 33183 - DNA, 3378 bp, Oryza sativa
  unsure (1)..(3378): unsure at all n locations
gactgcgnattgtanaactgaatctcgcattccngcangncnactntagaggatccccggggcaacacgaacaccctcgaggcctcgaccgcccaccgacgccaccccctccatccttccctccggctcgccgccgcccccgcccgagcggtcgccggaaagccgggcgcggctgcaaggacggcagcggcgggtctctctcgccctccctgcgcggggttttagcagttgattctgcttaccggtaggccggccgggcgctggtcaatgatttggggccatatggcagcctcattgtgctgatttggtgggctttaacgctcaacgtaggtcatatgtactctagcagaaacaagcccacaggccacaactaattgttcaacacaacgaagtcacgatctctctgcacctgagtagccatgctggaataaccatttacattgatgagaaatattacgtacatatacatacatccacgtcgatgcttagaagttacagcatgaaccagggtttttattgaacatgtcgaaagcgtttataaaacataaacacacatttaattacggcacatttccaccggccgcctatatattgatcgcgccgggcaagtattttttttcccaccttttagcggacgccgggtcgattagatggggatcgcgcttgtgatccgcgggtagacgacgttggccgggtgccccatgatgcggcgacccttgcggtggcggaacaggtacacgaacgcgccgagcggccacttcacgacgccggccaccacgaacgccacgaaacccagcgtcgggccgagcaccttgcacctgcacgggttgctgtgcgttccgcactgcacgcacaccggcacgtaagccatcttctcgctggcgcccgcgcacgaaaccgaagtcctccgcctcgccgcttgcttgccgatcgacgagctctactagcgcctctgcttggaatgcctgtgttgatggatcgaatgagcaagggattgcggatacacgcctccacggagtacgggcttaaataagcaggggctatgaaagcttcgcatcagccatcagggacgcgtggcggggtggaagggggctacgtacgtggggcgctgctagtgtctgtcttggtgagtttggtgtaaagggaggcgatgagtcgtccgtagaagattgccacgtttgcttggggaaggcagagcccaaatcttgagtcgacacgtgcactgttcgtaccggagctttctggaacacagattctcgtttcagagcaagagaaacggtatcgtagtattttttaaagcattgcttttcgttgcctattggagcaagtacaaagcaggagctataaatatattttaaaaagataaaaaagagagagaagagtagtgtgctatagatctgtagcacgatctttaagatgtaacgtgtgtatgataggtgagaccgggtattattaatagtatagtactccctccatttcaaaatataaggcacaaccacccttaacccaaataccaagaaataattaatatttcatggttatcatgaatcacctcaatcaatacaatacatgcaaccaatagaattaaaaatcttgtgagtataggatttaaaataataataatttagaggagagaatgtgctaattaattatatgcatgcatgcatgccttatattatgaaaccactttaaaaagtagatgtatcctatattttggaatggagagagtaaacaactattgtatgaattggctattatattggctataaatgatttggagctagtagttggctatactattaaggccgagtttagttccaaactttttcttcaaactttctaatttttcatcacatcaaaactttcctacatacacaaactttcaacttttccgttacatcgttccaatttcaactaaatttttaattttagcgtgaactaaacacaccctaaacttaactcttatgggtgtgtttagttcacgctaaaattgaaagtttggttgaaattggaacgatgtgatggaaaagttggaagtttatgtgtgtaggaaaagtttagatgtaatgaaaaagttaaaagtttgaagaaaaagtttagaactaaacaagtccaatatcgaacgatacaaggcctttggccaaaggtgggctccatcttgtctccgtacccaactctcaggccctcacttgcgtcatcgcaagttcagacttctgttagaaacgtcgtcttgactaattattgttcgaaagattatccctttctctttcaatttctttcgaatggcttacaaacataaagtgattgtaattcggctctcgttgaataatcgagaatcgcttgaaattatggttttcacttgagatatgaaaatttgataggattttcacaaaaaaaacagttcagttccttcaaactgactagaccctggaaaaagtacaccgaaggtccctcaacttgtcatcgggttacaaatcatccttcaaccacaaaaccagatacaacgcatcccccaacttacaaaaccagtgcacattgaggcagggcccgcttatattgctccaggccaagcacgcttaaccctggagttctttgaaaatcggcttccggaaaagaagttgcaacgtgtccagtgcaccactcccggtccacaccagccatgcgctatgtaacgtcttgcctctcccaagtcaggcccgcttacatctggtagcttttataggtaatagactgccctcacaggccaacacatgccttttctgcacactttgtcctcactcgtgtacacccggaaagaattcctcggtcggtcactcatcccaaattgctccaggccaagcacgcttaaccctagagttcttttgaaatcggcttccagaaaagaagttgcaacttgttgacatgagtattttattaatactattaagccctgggccgggatgtcacactaggtcccctagcggttttgactctggttttctccgacccggttttctccgacatgacagctaactcagcgtgggacccacacgtcagcctcttcttctcctctcctatccacctttcttcctctttcccctcctctctcaccccctctcttctctgtattatccgcgtcacgaagccggcgggatggagcggggcggcgatgggcggagtggggcgaccggcgacggcgaggcggagtggcggatgcgcaacgccgagagacccgcaggggtggccaacgggcgccatggccacaggcgccggcgcgagggacaccggcggcggggggcgcgcggaggcggcggccccgtggagggcctcgagctcggtgaagaagcgctaggttttgtcgtcgccgtggcggcgcggncgtcttggtgctcttttgta

SEQ ID NO: 33184 - DNA, 1983 bp, Oryza sativa
  unsure (1)..(1983): unsure at all n locations
ccaagcttaattctacgatatatgcaaaatctacccaaattgaagctcgaattttgaccatgcgcatatggatgactaattaattctcggcattaagaggttagctagctagctaacctggagacttcctcctagagggggcctttgaggacggcttcccgaaaggcgacgtccatctccgaccggatcttgagcagcgccagcgtctcctgccgtggccaccggttgcctgcccgcgacccgctccggtcgccctcctcgccacccagcagcccgttgtgctccagtagctcccgttgagctgctcctttgccgtcgcctactccggcgacgagcggctgctgatcggcgacggcgccccccactccgcctggctgcttcgctcgcctcctgcaccgccaccggctgcacgcggtcgatgagcacggagaggagcagcgacatgttctgcttcaacgtgcggagcgccgggcggatgcgggcgtcggcgacgccgccgacgtagagcccgtcgtagaacgagtggtgcgagttgagaagatgaggcggtacgcggcgacctcggcgacgtgtccgaccgcggagctcgcgatcacgcaggaggagctccccgccggcctcctccccacccgccggcggcctgcagagacaagattgagagagagagaggaggaggaagggagagaagatggtaaataaagggtgatgacgtggcacgctgatatgtggggtccacgtgagtcccatgctgactcaactgccacgtagattaaaaccaccgaataacctcgggtgatcggttttgtatagttaagggatcccgcatatttggttttgcggttcgagaatattttttatcccgatgataagttcagggatcttcggtgcactttttccactagacccttaaatgtaatctaattctaccgattcaggccagccctaaagtgaaaaccattttagcagttttgatatattgatagcttgttttatttagccagctaagattgtaagccaactacactattaatagattacgtcacctattatttatttcgtttggttacaaataaaatatccgttatgaacaaggttcaatccaaacccagatattaatacctgatgagaaaaaattgtagcagtcgataaaatagctagctagcatgcggggcgaaactagggaggggcggagggaggcctggtctcccacaaagttgcattcttgcttagcatctgctaatcgattatctaattacatgattagttagtttaagcatttttcgtttaagcttccctttattcttgacgattactgcatcctctatatcctgagctatgatcagtagaagattttacatgctagcacgttagatcaagcctacaacaagctaacacgtgcaagaaatctttaatactgatgcatgtagctaattatataccgtatgcacataaatataattttgtatggtctaaatataattatatgatttcctatccatgtaaaaaatataatacttgaaatttacatgtattgtgattattttttaatagattattgtcatttgatacatcttgtaattcgtttatcagatatatatggctaattaaaggtttcggcaaccaatgttgggttatattagcattggaagttttctttggtagttattgttgggagcttggtgctgaccaagtaaaacaacactaacatgttagactaactgaggggctggttgacagtaccatactacccattaattatagcctcctccaatatatcggtgccaacaaatcatccagtctagctagcaacgtaatcaacagtgatcatctcatgtgtgtagtgttagctctaccataaccatgtaaatcgacaatgattggcctatgtaaagtacgtcagttaacaagtcaaagcttaagnnnnnnnnnnnnnnnnnnnnnnnnnnnnnnnnnnnnnnnnnnnnnnnnncaggtctcaatcan

SEQ ID NO: 33185 - DNA, 747 bp, Oryza sativa
  unsure (1)..(747): unsure at all n locations
acaaaagaaataccagaatgggtttatttcatttttttgttctttcattaaaaataataggaaggcatggcctagcattaccatggcaatagcaaatcccagcataggtttgatcaaatactgcgcaagaaatcccacacccacctgcaacaggcaattgcattagtaaacctatatcaagttggaggcctcaagtacagaaaaataatcactatttctttaagagaagacgttcaggagcagaaacatacagtccatggattcctcatgcatctcctgaaatcttcgaaggtcaatgttagtcccattgatagcattaggaatcctaggcccacagtgaaaagatcagtctccaaccaggtaacctgaaagttttccaagaaaactataaagtcagtttctgtggcatttgctgttgagtacagacagtaatgggtattgtcaagttagaaattttaccatcgatggcttgtagatgccaataatggtacctaatatgacctgcaaaaggtgagctctgccttagtacattttttaatatttgctttacaaaccaccaaatgtaacagaactagaagctaaaaaagggcagataaaatcctcaaatgctcccaaatcaacttacccagacagggaaaagagtggtaagcagctcaactattttctcgtactggtttgcttcactaggaatgctnnnnnnnnnnnnnnnnnnnnnnnnnnnnnnnnnnnaatacgatctcaatccct

SEQ ID NO: 33186 - DNA, 2939 bp, Oryza sativa
gcacgggggttcccggcgacggtgcttgagcggtccgactcgctggcgttcacgtggcgccaccgcatgtacgaccggctcgcttttcacctgcccaagcgcttctgcgagctgccgctcctcccgttcccggaggagtacccgacgtacccgtccaaggaccagttcgtggcgtacatggaggcgtacgccgcggcggcgggcgtcgcgccgcgcttaggcgccaccgtcgaggaggccgcgttcgacgcggccgtcggcgcatggagggtgcgtctcgacggcggggaggtgctcatggcgcggtggctcgtcgtcgcgacgggggagaacgccgagccgcgggtgccggactttcccggcatgcagaagttcgccgggtgtgccatgcatacttccgagtacaagtccggcgagcagtttgccggtaagaaggtgttggtcgtgggatgcgggaattctggcatggaagtgagcttggatttgtgccggcatggcgcgaagccctccatggtggtgcgcaacacggtaagaaactagttaaactgagcttatgctttagaacctatctatcatgctctgtttttcccctgttttttttgtctgtatttgatttatctttctgtgtgtcacatcttattgtcattggacatattattgtcatcttaaatccgttttcattgtgcatggctgtattggatcatattcaggaaggagaaattagacctgttaacatcttccattccacacaactttatatgtcgggtgtcttgtcctatcaacagccgtttctttcttccattttgcctccccctgccctccgataattacgcgtgtcattttcattacattattatgatgacgggttacacaaatctaagcgccgtggtgatgtttcgtccaggtgcatgtcctaccaagggaaatgttcggtctatccacgttcggcatcgccatggcgctgctgcgatggctaccggttcagctcgtcgaccggttccttctcacggcggctcacctcatcctcggtaacacggggcagttcggcctaaggcggcccaaaacagggcccatcgagctcaagaacctcaccggcaggacacccgtactggacgttgggacgctagaccacatcaaatccggcaaaattaaggttagtgccaaccattcagctagcctagctcctttcaagaaccagtagtagaaactgagaccagtcaaactgtcgagctgtacatgtgagctgctgggcgtctacttcctaatgtggcacatcagctattcgcacatgcagcatgtacatttctcttgtggaaaatggttctcatatggagattcatttattttatccctgtgggttttctcctgtgctttgattgatgaggcgctgatgggaatcatgcatcactaggtagtgggagcagtgaaggagatgacgaggcaaggggtcaggttcacggatggcaaggaggagcaattcgacacaataatcctcgccacaggctacaggagcaacgtgccatcttggctcaaggtaaagcagagtgtgactcactcttgttcgttttatttttctttctgtccgcactgcactatactactactagtgatatatatctcgagatgatacggattatatggtcaactgtcaagcccaaggatgttaattatatgtctatatgtacgtgtgctttatgtgttgtaggatgccggtgacttgttcacgagggagggcatttccaaggtccccttccctaacagctggagagggcggaatggtctctacaccgtcggattcactcagcgggggctcctcggcacgtcatcggacgccctcaacgtcgccaaagacatacattgccaatggagagaaagggaccgatctgctattaatgtacttgaaataagcaactcttccttttgatttgactggaaatgtacagtgttttgattaggaatattgtattgtgtgcatataacaccatgttctatctcccttttcaacaaagactgataatcttgctctgccttatgtcgattacttgcctattgagcatcttttgggcaaactgttattatgacaagaatttagaatttatatcaatactcctttaaatgggcgtaatggtagccaccaacttcctattttctttgaaaagaaaaaaaaatacagtgtgaaaaaggaaaaataatgattaagtgggttactaataattttcttgaattaaaaccctgtcgcaatacacggaaagacaacatgctagttagcatactgttgttaacgccgaatatacttttgtgcatatatggtcagcgggtgaaaagcatcacatatttgtgctgatctgataaaaacccatttagacaaatatggttctgatccaacccatcttgctcaccgaggttcggcgttgggccgcaagcccacaatccaggagatctacaactttataattaatatattttttcatttcagatcgtttaataatccaaatattccttacaaaatctctaatctacgttacaaacgacttccaatatagacaaacttatacaaatgttgtagatcttgacgagatctacaactttgttgtttaccagcttttatttaggctgtgttcggaatcggacgttcccagcgtgcacagtaagtaccgaaaacttagcggtctattagcgcatgattaattaagaattagctattttgtttaaaaaatggattaatataattttttaagcaactttcgtatagaaactttttgcaaaaagtatacattttaatagtttgaaaagcgtgcgcgcggaatacgatggagaggggctgggaaccttcagttccaaacacagccttaaaattgtttagagtatcaaataagcattattagtttttttagcaattaaaaccgacaagaagatctaaatgcaaaaaaaaaaaaact

SEQ ID NO: 33187 - DNA, 537 bp, Oryza sativa
ggtattacttcttgaataagaaggcctgaacctgtataaatccttggtctccaaacccattcacttctccagcttgatagccacccccttttattattgccgaaatctagtttcgacactttgatgtgacgggatgatgttgatgcccaacaaatagccatggcgcgctatcttcttttttccaatttctttatgtatgttgggtttctctagtttgagttagctgctctgatgtcaaaatggagggatatggcaccattctgataaccgagacagagctagaggaagttaaactctggaatgcttccatttctctactggaaatgggggaggttgtgacattgtgtcctccctttcttaaagaagaaaaacaaaaacaaaaaaacaatcagccgctagtggggttgcttgcattgaagcccagctgcaagccacaatggatgagctgcacacgcaggaagaacaaacgacgcggaggacaaaaacgaggggctggtcggatattcattttcaacatactattttttcataaagttg

SEQ ID NO: 33188 - DNA, 4172 bp, Oryza sativa
ggttgatagcaccttgggcgctacacacacacagttgatctagattttaattatacaaatttctatatataataaaattacttcctgtgaatacactgaccaattacatcaaccccttcgtatgtaacacattatacttgtttgaagtgcccaagcaagcattcgtaagtaataatattttttcaaatctttcaaattaaaattagatatgtcgaacaccgtgagcatcatcgtccacctgagaggccagagaatgtgccgatgcttgtcctaaactccggatatgacatggctgatgggttaaatcctttgctttgcatcaaaggtagcttgctgaaacctagacgtgttggtgctaactctggctgtggcaagtccttgtcgaggtattgcattacctgccgcatatttggccttgaagcatgaaatggatgcaaacacacaagagctaattttaggactaggcatgcctcttcaatgttataatcaccttggagtctcatgtccactgcctcagtgagagatccatcatgccaatgcttaagaacccaatcaaccagcataagttggttgccttgagagttttgtttcactggcctttgtccacaagtggtctcaagaaggaatgcgccaaaagcaaacacatctgtgagaggggatgccttacctgtctgtaccatctcaggtgctaggtagcccatggtcctaaccacatgtgtagtctgtaggtcagtaccatgatcatatagtcgtgcaagcccaaagtcgcctaattttccattcatttcagcatcaaggaggatgtggttgcctttatgtctcgatgtataacaactttctcccatctctcgtgcaaatagaacaatccacatgcaacatctttaattatctgaaatctttgagcccaattaagtatagccctattgtctacatcatgtagatacttatcaagactaccttttggcatgtagttatagaccaaaagtagttcactcttccgtcgacagtagccaagtagtggcacaaggttgcgatgtcgaagacgaccaatgctaacaatctctgttataaactccttcattccttgtctcgactcatgggagatcttcttcacggcaatctccaatttggatgtcgcaaggactcctttatagactttcccaaatccacctactccaatcatgtttttattcttaaatccttgagtggcatggaacaggtccttgtatgaaaaccgctgaggcccaaaatcaatctcccaatcttctcgtagctcagcatacagtagcttcctccgcacaatcaaaatgaccatggtgccgacaatgatgatgaacatggcactggctattgggaggacgatttccaagacattggaacgaggcttggttccaacacgaggtagctttggtagtttggtgatatcaatgtccggagctggaacacccatgccaaagctccagccaagcacgatatgtcgtgtgctaattacgccagttgcagctgaaaaacctatgtacacagggtctgtgagcacagtcgagagatcataggtggcatagagcagtggcctcttcggctttggtgtatcaatgggagccatggtcacggtgatctgcgtggcctcttcgctgtattccatccaaacttgcatagcccgaccattgtacagagtcaagtttgtgaaaatcccgttcttgtcatcatagaagccagcaaaggaggaattcacggagcggacgtcattgatatcaatgccaacatggctgttactgatatccccaaactcattgttctgaaaggtgtcgagctcgactgcgaggatgcggttacttgaattccctctgttgctgatgttaaagagacccaggtacccatctggccacgcagtcgagagattgttgcttggggctatcaagaacgccatgccatcgtagcttctatcggagtagaaggactggatggcgaacatgaagttcaccgagaatgactgaacggtgctgttgggtgaactgcggaaatgcataggtgttgggaagaatgcatggccattgagatcattcttgtcactagtcagctcaaggagtccttccggtgtgattttggtggtgccatcgatagtgaggtttttgccggtgaaaccatggtagatgaattggttttgaccggcacaaagggctataaggttgaagccaagcgacacaaggagcagaaagaagggaggatgctccatgtcacaggtatagaacttcagccttcaaggaagttggaagagcatatgtagcgtatattttgtagttcgaacaccggttaatcgtgcttacacggtagctaggtaagcatcttataaatattttgcacggtggatctcctgagaccacaaccacgctggactatataccctaaaccccaagtcaggtgtctagctaccccggttttccacaagcttccctttctgaaagtaacagttaggggattttttttttctacttcgcattacaatttagagatattctagtgtaaatttacctaaaaattgtggtatcttgctcgatacgtcctcaagtattgtaaaatcactcaataattattttcaagaacatgatattaatcttactttggaatgataccgtgctaaaaatctcgtaaagtacaacaggtgattgacaactgtaagtaaaaaggacgaacagttatgtacacacagcgttgtctgaaattttccaaattatttcgtccttaaatttattttttaaaattttatggtgaattaaaaaaattaaaattccataaaaatgttcttttatggaattttattttttgcataatgaaatactagtataactggtgtgtatatactacatcaactcgctattagatagttccccaacaaactcaagtgaactggagaaagtaaaacaacattttttgccatcatgtaattatccaaatagtaacaaactatatcggttacaacttaggaattaagaattattaaattattaggatgacaaacaaaatcgtgtcaaatcaatgttgagctttcatgtcattaattaatgacatttgatttttaaacaccacaactaaatagtcaaaaattgcaagaagtacccatcaaataaatttgattctatccatctgtagaattactttgtccgttttggtagtttggtctcctcttcagctgtttctcacttgtatattgctagattcgcatcctgctgagtcaacatgacttgggttgcggtagaaaaaaatgccagatggaatattaggacgcggctttaaatcaaccacatcatgtcttcgtcgctagtaaaattttctaatgcactagtcccgttcaatgtagaaaagtactagtctgaaaatgccatgtctggacagttggattacctgttgcctgatggcaatgcagtctagaattgtttcctcgcactccaacaagtcacaatgactagatgttacagcgttatattggtggcggttttgttttaccttttctagatcatatatagccttccaaactaaactataatgttataactttttatttgctataacaatatgaaacatttgatgttcatttcaaaaacagcgtcaatattattaaacacaaatattatctttgctatctttgtagtggttcatgcttacctttttaatacaaataatcacatttatagattatttgaactatttaattatcaaacatggattcaaaatttataagagtaaattgcactagcggtccttaaatatacaagcaggttttatctacgtccacgaacttgcaaagtgtgcattgaggtctctaaacttgatttattgtatcatcctgatccaaagcgttgtttaaccgtggtcttgcctacgtggcatgacatgtaaacgacaacatggcacattattattattattattattattattattattattattattattatttatttatttatttatttattttttctcccttcttcctctttcatttctctcttcttcggcctgttcgacgcgggggagctcgaggtggctttagtggaggaagaagataaaagaataggaggaaaaagaaaaggggaaaggaaaaaacaccatattatcgtccacgtggtgtgccacgtacgcaagaccacggtcaatagacgctttggatcggg

SEQ ID NO: 33189 - DNA, 1623 bp, Oryza sativa
tctaccaggctcaatgggcatgctttctatccaactccgctgcccttctgcaacttctccagtggcctgtgcaatccttttccacatcttttgtatttggtgtccaatctacctaccctagccaaggctttacattcttcatagcaccaagcaagaatttttcatccgcgttgccagtacaattcctgggactcctcaacagcgagaacaatggcgacatgaaaaaccaaatctttgcagtcgagtttgacagcataaaaaatattgagttccaagatatcaacaacaaccacgttgggtttgacatcaatagtctcatctctgtggactcataccctgctggtttctatgatgataaagatggtatcttcagtaatttgaccataactagtagtgaagcaatgcaagtttgggtggattacaatggagatatcgcacaaattagtgtcaccatggctcccatgggtatggcgaaaccattaaagccattaggatcagccaatcgtaacctctcatctgtacttagtgagatggcatatgttggcttttcatctgctgcaggcagggacaacactcggcattacattctcgggtggagttttggtctaaatagtgctgctccaagtattgatatcaccagtctgccgaagatgcctcattttgaacccaaggctagatcaaagatcctagaaatcattttaccaatagcaacggcagtgtccatcctttccgttggcaccatcattcttttacttgtacgaaggcacctaagatattcagaggtacgggaagattgggaagttgagtttgggccacatagattctcttttagggatttgtttcatgccacggaaggattcaaggacaagaatcttttaggcattggaggattcggaagagtatatagaggagtgcttccagcgtcaaaactagatatagcagtgaaaagagtgtcacatgattcaaagcagggcatgaaggaattcgttgcagaagttgtcagcataggccgcctccaacaccgtaacattgtgcatttacttggttattgtcgacgaaaaggtgaattatttttagtgtatgactacataccaaaaggaagccttgacaagtacttgtatggttaagaggacaagccgatccttacttgggctcaaaggttcctgatcatcaaaggaattacatctggattggtctatcttcatgaggagtgggagaaagttgtcattcatcgagatatcaaggcaagcaatgtgctccttgacgccgagatgaatgggagacttggtgactttggccttgcaaggttgtacgatcgtggtgtcgatgcacaaacaacccgtgtggtaggcaccataggatacatggctcctgaattggcatcaagcagcaaggcaacccctctcaccgatgtattttccttcggtatatttgttcttgaagtcacatgtgggaaaaggcccatcaaggaagatgtcaacggtaaccaaatcatgctggtggattgggtgctagagcattggcagaagggatcacttactgatacagtagacacgaagctccaaggtaactatgatgttgacgaggcaagcatggcactaaagctgggattgctgtgctccc

SEQ ID NO: 33190 - DNA, 3171 bp, Oryza sativa
  unsure (1)..(3171): unsure at all n locations
tacaattgatgtgccaaattactgtaaatactaattttttatcggtacagtgatagattgaattattaaaaaatggtcaagctagctgtaagtggtatgggtccgttttatttcaatttctacttatggtatttacatgttcacatcataacaaataatacagccctatttcccttttcaatttctattgaaattatgttattgtatactctatttgtattacagttttttctaatctgtatatataattctttggttctctgggacaagtctgtaaaggtctgatcacacatacaacaaaggagaaactagaggaaataaattatggccagtcgtccaaacaaatttattttagacaaattgatcggtccggccatgctcaaaacttttgtaactttgagcttttctttttgaaaaaaaaataaagacagaagtcttcattgataaagaagagatacacgtcgaccttttaattcacataaaaaacaccatcatcaacaaccaagattccttcttgtgaggtaagaatgtaagatacggtaggcacacgtttagagccgctaatatttacatcagcattaattccttcacttttactctgtccacaaattctttacgtttatctcaaatccctgtacctgtagttgaattaagttttcttgatttggacttttgtggattccagcccgacaatgttgctgtgcgtcacagtcagtcgtgctctgcatcatggatcattcaactagaactatcacgaaggtgacagttcagttctgggaggaaaagtccattgtactccagtaaacatttaacactagaaattttgaaactatgctactgtcctctgaattgtgtctatttgtacaatactttctttccataaatttatttagattttcgattgacaaagtatctagctaggtttgaaagcacctgtgattaataccagttcaaaccttagatatgaaaaagacatgcaaatagccctgcaaattctatgaatatttcataaaatagtgtaattaacgttatctataataccacaaaattataacttaaattcctctagaaagaaataaggcagtaaggtaagctactttaaaaactgtcataggccctaatagaaattcatgggccttaattggaattcatgggcctaaaaggaacaggtttcctatgtggatcaacccattagaaataagtttacttagcatccctcaatttgtcgccgagtttgaaatttttccttaaaccgaaataccatgtatagtctacccctcaactcataataccgtgtcaactttggtcctcgacagtatagagatcggttttggctgatgtggtgagtaggtcccacgtaggccccacatatcaacgaccacttcttcttcctcctcttctcttcctagcacgcgacgcgccgctggggtgtgctctgcgaccgcaccttcacctccgacagatgcgtgctcgacatggtagccgcggcaattgggcgaggcgtcgccacaacatatgctgaaaaaaatttgctaatatacttatttttttaataatttatgtttatatacatgtatcggaaggattagcaaaaatatacccgtcccgcgggatggaaacgtgggaccacgatgatcccatagctccaaaacgtgagaccgacggtcccgcagttttggacggtcccgcggaatggaagagcacggtaccgcgacggtaggcagccatcaatttttaacgttgtgcagcactgtgacaccgtgtagcacttttttggaacgacggtaccgcaggttgaatgtgcggaactggtccataatcagcgtcaaaacagcgatgaacagtagcaaatagtcacagaatagggtcaaacagtgccgatgcagtatataaatcactggctgcctcgctcccgcgttctcaaccacgcgaccgtcgcggtcccgcatattggagctgcgggaccgtcgatgtcccgcgttttgaagttgcgggactatcgtggttccgtgtttccatcccacggaacaggtatacttttacaaatccgtctcatgcaggtatataaatgtaaatttttgaaaatataagtatatttgcaactttcttccaacatatgttattcaacgacgtcaccggcatgggcactagctggcgccgtgctctactcagtcgccggcctagtttcccaagcggacaccaatcgtactacaggaagtggcgcacgctcgacgccgatatacatgtctatgttctaaatacatcacaacacatagactgacatataataatcaatgttatgataatattttaaataatttcacatcatatttaaggcatcaaatatcacttgacgactatacaaagctaatttaaatctacatatataaaataaatgaaacaatgtgtttttctaagtagatctgatttaattttaatttgtttgagaatagattcttacctctctttttttgaattttcagaactatttcattagtatccgagaagtgggcaacataaatattacatagatgtgaaaaaaattatgaaaaatatttcaagctaatgatcttgctataatacaaccccttaatcgatcatgagatttctggccatatatgtatgttttttctttgccaaatagctttgacaataaataaacaatcaagtaacatatggaataaactactcattatatattttcttatagttgaggaattcaaacatggcagcaataatttgatggatgtatgtcatacaccctattgacgtgactacaagtatacttcaataaattagttactgtacatagatgcattctccaaattaataaggtgcctcatgattatgaacaataggttatggaaaaaaacagacacaaaattatagatatttgtcaaaatataatcaataatacggtgctctggagattattgtggtagtatttaaaagaagcactttatcttggttaaaaaatcaaatatagtataaatagatacgaacaaactccattattccattatcgtgacaaagtttttctcgcaaactcaaggctggtttcaaacgcaaagaagacattaataaaaacatgtttaaaatagagtcaagatctatnnnnnnnnnnnnnnnnnnnnnnnnnnnnnnnnnnnnnnnnnnnnnnnnnnnnnnnnn

SEQ ID NO: 33191 - DNA, 6023 bp, Oryza sativa
  unsure (1)..(6023): unsure at all n locations
gacaaagtttttctcgcaaactcaaggctggtttcaaacgcaaagaagacattaataaaaacatgtttaaaatagagtcaagatctattttaaaaatatcatctacatgtaaacatttataataaaaattcaagcaacactatctagttcttttaaaagaccagagtggtggtgatgagtaccaccgtcatctaacatgtaggcccatgaaatcggtggaccccgcattccccacatgagcgttctgtttgctctctttagttttctagccgtttgaaatttgagcaagatgagaagcttcacgtttttatgaagtgcaccacttcatccaagtaaagataagatattttttcctgaccaagataactgataattatatttttatcttaaataaatcgttgcaatgcacgaatattttacttgtaaccagataaattggatcagggtttcggaaaggcaaagtaccacagcaaatcaatcataaggaggaaacaacgtcgtccatcataaacctggaaagagatccatgtgaacacgatcaagtgaccaacgacgggtgcagtataaccaaaataatcaacaattagggaagcaagcggaacgggtttgcaagcttcgaggcttgctaatcataggattacaaaccataaccacaaccacaaaacagaagtgcataacagagagtatctaaaaataatatgtgcataaaagagagcagcagtaatagacgcagccggctgcgagttcttttcacccccatttctcttcagaagaatggttctgacgagagtgaaatggttacaaagagaaatactacttgttcttgtagccagcaacctctgaatctggtcatttttaatgtaacaggcatcacctttgatgatacccctttttgcctaataaaatttggtcagcagcttacttcttgcctggcaaaaaatagcattaagcgatagtaactagtaagtaaaaggttgtattttattcccagaaattaattatgaaaaagtcatcaaccacccttttcaccttgcaagaatgagcagttccattagcttctttcagtcacggtcttcgaatcagaaagtgccatctccttcttttctgaacgttgaagacctgcccagtacctcaaaactattattagtctgaataagatgtctggtgcatattgccctttttattttggaaatgggaacagttccaggcattccagactgaccaacagactgccaagaaacgcaaggcatatggactaattttagtatcacccagaacatgttttagttatataagtcccagatgcctaggttaataatctgtattcatatgcagaaataaccaatggtaactcaatttagtttatcttaggaaactattcacatgaagcattactgacttcttgtggaagaatcgcgcaagtgtagacacataataaatctatctattttatactaaaagtccattaaacttcctatgaatactctgaagccgccacgtggcactcctacaaacactcctaagtcgccacatggtattatctaatctcaccgttgatttttacttaaatcgatggatccattagtttacaccattagattagatctattataaaaaaataataacctcatgtttataacatacaggcgctactaatgtccgtacgtatgaatttgtatgatacaaattctactgctgatctttccatacgtacaaacgtacacgatctttcctaatcttgctggaataaaaaaatatacacatggacataaaaaaagacagaaaaatcatactaccttcgtcccaaaataagtgcaaccgtggatatccgtacccaacgtttgaccgtccgtcttatttgaaaattttgtgaaaaatttaaaaatatttaattacacataaagtactattcatgttttatcatctattactgattaataaaaatactaatcataaaaacttttcaaataaaacgaacggtcaaacgttgaacgtgaatagtgcaaaactgcacttattttgggacggaaaaagtacatccataaaaatcagcggtctttaaaatatgattttagatcaaatatattacttcacaaatataaatatatttagttaaataaagatctataatatatatccaatcaatgttctttaaaccatattctaaatctatctaatatatagtaaaagtacattaaactttctacaaatgcttttacactgctatgtgactctcaaataaattagaaaaatcctagaaatctattatatactaaaagtctattaaacttcctgaacgctcctacgttatcacgtgacgctctaatttagagaaatcctagaaatttagagtaaaaaaaaatccaaccttcaattttcaacttaaattagtggcccattattttaaacattggattagagctctttaaattcccatgttgctaatctctatcccggaaaaaacataacgtgcttacgtcatacgatcgtctccctacccaaaaaaaacaaaacttaaatacctacaccatatacgatcgaaaaaaaagataaagccgaaaaagaaaaaagaaagcatgcacagtagaatcggaaagaaatactaatcaggaaaaaacatcggtgctggcacagatttgttgtcaacagcctttaatctacgattttaagatcttcctccccaatctgatattgtagtcctggtatagatagaaattcctttatggtctaattccgagcggtagtaaatactaatctgattttgagttttcgcttacaacgtttgaccactcgtcttattcaaaaaattttaaaattattatttattttatttgtgacttactttattatctacagtactttaagcacaacttttcgttttttatatttgcaaaaaaaattgaataagacgagtggtcaaacgttacaagcaaaaactcaaaatcccttatattgtgggacggagggagtaggacttagcaatatttgattgatcacaatttggtatattccatttattataaaggttgctaaggaactcattatagggatgcttccaatagaactggtttgtttttgcacatcgaaaccaaaaattaatcgcgcagagaagaataggtgagcaattcatacacagcatccctttcttttatcgaaggttctagcaattgatatcgggatttttaccgaaggttctagcaattgatatcgggatttttatttaaatctaagatccattcttatcacattagtagtatattgaaatctaccgtttattttacggtaaatatatttctttttttattgtaggataatctaaattcccttacagtatatatatagtgacgtatgattccttttagcattttttttaataacaaataagaagcccgtgcatctgtgcgaaattcctttctgatttatattccagaaatgtcctccagtttatattatgtcgttatagtgtttgaaacacaaactataatacatgctgacgcgaatgcgcaggctaccttcctcttcctagttaatacttagatctataaaatggagcgcaaatgagaaatcttactggtgaatttccatcgtttcacacggagagcatgataacgaatctgatgaatgtgtttaacatagacatgatcctctgcatgtgtcctctccatgaattcttttggcatatcccagaggcgtaaaatttgtagtgatgtcagatatttaaatcctactggcacagatatcatattctgcagcccacataataccaaaatgctcaagtttggcattgtgccagcttcaatatcaattgaacgtaactggtccatgtcagctaaacccaatttccctaagatttggaaaccagccagcctgaaaggtcatcaacaaaccatcataggctttctgaaggtaaagttctgctaggttcgacaaatgtgagattgcaggaagaggatcaacctgcaacctggaccaccctatgcttaggtatcttaatttactgaaattctgcaaatttgatgtagcacctgctccatgtaacttccctcgtaggtgcagccattccaaatctggaacatggcccaaatgttgtagatcaagtatttcatcctcaccatgtgagactatacccaacctaacaagatttggcatactttttatggagacacatagtttctccatatgatcctgcttcacgtcgcagatgccaagacatcgtagctgtgttaatctactaagnnnnnnnnnnnnnnnnnnnnnnnnnnnnnnnnnncctagcacttgtaaatccgtcagaagataaaattcagaacaaattcgagtggcctggaaccgaggaaagtgtctgtgtaagttgctaggatcacagtcaacatcgacagataggaaccgcaacttggttagaaactttatttcttctggcagctgttctacaaatgtctccctaagatccaaaagtttgtagcttcctcagcttcccaattgactgctggatctcttgaacttctgtatgacgtaaatcaagataatgcaaattgaacagataagttacagcatcaggaagcttcacaatttttgcataacgtaaggacaagacccttagcaatctgaaattcgaagttgccttttgtatccatgagaattgcacttcctcatcgaacaaaataaaggacctgatctttcttgaaccttggccagattccattgatttcccgcccttcactaaggaaactcgacgtgcttcatcactcagttttgtaacacacgtgttgtctgctaggagagaaaacttttcagttttgcattttgtcactgttatgtctctcacaagatcatgcatgcgaaatgactttggtctctcatactcttttgtccaagcaacttgaagaagtgaacgttgaacaagttctttgaggtagtcttcagccacttcttccaatgtaatatctcccctttcttcaataaaaccttcagctatccatagccgaattatctgttttcttctgatctcatggtcttcagggaacatgctacaataaaggaagcaattttttagatttgctggtagataatcgaagctgagattgagaatacttgttacatagttgagcttttggttcttggttagttgccagttaagttgaccatagaacaacttccactctgcctcatctatttgcttataggatagaagacttccaatggcaacaatagcaagaggcaatccttcacacttgctgacaattttttctgcccagtgcatcacaacttgaggacaaccattctggtctagcctgtgaaacgcttttcggcagaagagatcccatgcatccccccatggtaggtacttaggcttaaaagaacacccgttatttgcaattgatgctacatcttcatttctagttgtaatgacaattctacttccttttttatttttcacaaaagcacgatccaatagaatccaagcatcttgactccacatgtcatccaagaaaattaaatactttttgtcctgcaggtaatttcttagcctctctaccaagcttaccctatacataatgtcagtctgatcaggaatgttctcattcatatccagaaattgtttgagtattcttctaaacaaatcttcaaccttgtagttttgggagattgtaatccacgaaaagcaatcaaagttctttctaatctcattctttttatagatggcccgggcaagagttgtttttcctagcccacccattccacaaatggatatgactgtacgggtttcttcgccatgtatcaataatttcataactttttcggattcttctttattgccagccatatcatcttcagtatcaaaatacgctgaatcagatgtaagctcctttaggctctcatgacttgaagtgctaccatcttcactgtcatttgctgaaatgccataacgagccttcatgtttgtgaggttttgaaggcgagatttgatttgtgaaagttgtgttgcaataatgtgccaatcactggtagttttggagcaatgg

SEQ ID NO: 33192 - DNA, 35466 bp, Oryza sativa
  unsure (1)..(35466): unsure at all n locations
gtagatccctagctcattccacggttatattatgcccatgatgcttgttccttacctccttgtgtccatgtcacatatagaagatatgagattttgccagaatatatgggatttttagtcatcattttcttgctatcttacctactcactctctgcaatgtgaacaaaagatttgattatatctctaaagtaagctgcttgtatgccaagctgaaaaccagagacttgaccagaccagcataagtcagtcaactgtagtaagtccttttctagtgatgttgaaacaaaactgtagtaagtcagtcaactaatagacaaacttgctcatgtcagtagctattattttgacaaaaggttcaacataattgatctcaagtcaggtggccaagtgcaatatctctactattataaaaattgaagatgtttttgccggtattttggtacgtcatccgtgtatgagtcggtttttaagtttgtttgcttttggaaatacatatccgtatttgagtcggtttctaagatactccgtagttcacttttggtaatacataaggaatcatataagaaatttgtttaaaaaaactcgcatgctaacttgaggcgatcggactcctaactgcaactcataattttctaaaaatatatatatccaagcgaacttccacagtgaatttcatcttaactaaaccatataacaataatatgattaaaatagacttcacccgttgcaacgcacgggtattttttctagtaaagtactaaattgaaaacccgaaacggcaagaccagtgtttgctggtcggtcgcaaacttcgagtgtagactgtgagctttgaaccaattactcctgaaacatactagtatatagcaagtttccattatatgaacaaatgtgaatctcctaataaaaagtgagtcaggtgaacactgggctgcaatactgcagcatagagacaccaaaagtgaatgaaatcacacaagcagcagcatcagcagcagtcaggaatcacactattatttttctggaaggagcagcacaaggaaatcgctccatgttcatggcagtggcacatagagaccatcgcaccttgtgtaaatcaggagtctgaaacaacccccaccctcaaatctgaagcacctaatataccttcgagatggcggcggacgatagagtcgacgagatagactcacgagggtatcggggaatcggcaggttggtcgccggtccgcggccgagcgaccggcggagcgtgagaaggtccttctcttccctatctcggctttgccgtcggcgcgtgctgatgggatgcggcggagtaacgggacagggcgattgggattgggccgatccaccttggcccaaaatggattcaatttatgagggattaagttcactataggtccctcagtttgtcgccgaaaccgaatacaacgcatcccttaacttacaaaaccatgcaaacgaggtacctcgacagtattgacctcgattttggctgacgtgacctacatggatcctttcactagattttcgtcccatatagcattgacgtgacgcttacgtggcaattagatccgaaaaataataataataaatggtggagcccatatggctccacatgtcatcctcaaaactcccctcttctttctatccccttgcaggcaaagtggcatcgcaagggcaagtagcggctaaagcaggcaggcggatcaagccacgaagcagagcagaagggcggagtgggcggagacgaccgctccctactaagcgggcggcgatggccggagcaagctagcggtgcgaagcaaggcgggtggagcgggcggtggtcaaagcggcagcaatcgctcctactctctctctcccttaccctttttggcatgcgggtggcgaagggttcagagcggccgaccggcagagcaaggcgtgcggcgagcggagcggcggtggccgaagcaggctggcggtgcgaagcagggtgggtggagcaggcggtggtcagggcagcagcaatcgctcctactcctctctctctctcttccttccccttttcggcatgcgggtggcgaagggcgcagagcgaccgaccagtagagcggggcgtgcaacggccggtctcttcccctttttggcatgtgggcgacgagcgcagaggagagtttgtttgacatcccttatcgtcaatactagaaatctttacccctaaattatacaaaaccgtgcaacggtcaaccgtgcaacggtcctaaggtagtatgagcagctggtttcactggcgtggaatcctagtcagcaaaataaaaaataaaaaacatgcggacccgcatataagtgtgaagaaatagagaatatagggcccacgtgtcagcacctacttcctcttctcctttattccccaaccacgcgagggcgacggatcgatggcacctgtggaagcggtggcctcaaatccgcgaggggcgcgccggtggagaggatgcagcggcggcataggtgggcagcggaggtggcgtaggcggcctcaaatccgcgagtagtttcctccatcaaatcatcgatctattcaactagattgaactctatctgacgactaatgaagactaacgaaactttactcactttggtcgtcaaaagaaaagggaagcagaaagcccaacaaacgtatcaatcgcttcaacttgttttacacggcttcatggtcaatgaaaaatattgtgcgacagcaatgcacattgcatgactatggattagcttggagcttactgtgccagattaacttaaattatgtgcatggaaaacagacgacaccccccaagccactaaaacagaacactggagtactggactgaagcagcatctctctttgattgctgactatccccaaagattgtacacacatgggaaattatattgtagctagactcgttgaaattccgtagagcacagccaatcatttgtacatttcgtctcttcattgtgaacctgcgggttgtaaattagggtaaataattaatggaagaaacggataacttaacaaggatataaaaatatgcagaagttgaatgttagattgcataaacccttcaaacttcttccataatcatttttttctggacgcccataatttcagtcaaccaaatgatcataaaggcataaatgaatgaaaatttcaaaacaaaatcggtttcaatgttgcttattgagtagttcaaagaaagtgtgggaaaagctaggaggtatcaaaggtttgcagggacagtttgaattagatggaaaaactagtctaggccagtactaggtttgcccgagaagtatttgtggaagtgaagatggacagcagctcaatccataattcagtgaattcaaatatatcacattagaaaaatatttccctagaaaagcttatgcagtcaccagggaccaatggcaactggcccatgggccagagttgcaggtgactaaaagcacaggtacaactggagcagtgttctttgggatgatagttcagaacatggggcacagcctcactaaatcagggttggatcatttcaggcccaattatgaagctatatatttaccaataaatcctgaacaggataataaaagttagaacctgaagcatgaagcagcataataaaagtaaaggaaaagggcgggaataatgagcaagacatctagcccactaggcacaacacccagccatccctcccatctccttcccttaattatcccagtgtcccagcccacatgagcagccagcttccctcgcttgtaatctatcccccattgcacgccctcttagcactcaccctcctactgacaatgcctcacctcttgttctcagtgaggttcatgggaacagaggcagctgcttttgtaagcagcactgtcagcagcttcgacaaaaagggatggaggcaacagcagagctgtcaccaattagatgcaacatcgacattgatatgttgtgcacctactcctttatcaagaaaggaaatctagcaacttaatttagaataatacgatgagtgctaaaatacataagctaatgagcatattttggttcacatgattgataccagcaagtaacaaatctcgcagtaactgagagttcatattatcctgatacacaagtaaagtagtatataacaattgagatttgcatgtatttatccatgtagtataagtaagcaattcaaatgtttatacaaccgtaattttcatatataataaaaaggcatggtacaatctaatcaaacaagattttcctcaaaaaaaatctaatcaaacaagataaatcaataacctgatcacaatgccatttcagcttgcaaggctgcaagctcatcctcctcagctgatgctttctgtggagcagggcgagttggtatcctggtgcctgggacctgcactggatgcacaggtggagctgcaacaggctcgagaagctgagattccaattctgctccctccagttcttccagttctgcctctagttcgtcctgtcagttttatggtacgtattaagtgcaccgcaaacaaaaaaccatgaagatattacacattgtaaatgtccacagtgagttacctcatcaaaatcagcagatgctccaagaggggctgacaaagcatcttgtatttgtttcatgttttcagtctgttcattaatttcatccatagtcttatcaacgtcatcaatatttctgcaggaaaacagtaaatagtcatttttgagacataattttcttgaaagaatcaggggataaaccactaaacccaaaataagaaatgattcagaaaatactcacgtcgccttttgcattgctttcatagctgcagctccagtcctcaaagcatcaacggtttctgtcgtagcttttgcagcttctaacatgatcatctgtatttttcaatattattataatataaacatttataacatgtagtaatcagatgtgaaaattttaagttggaagtaacctgatcatgaattctcaactggaagttccctagctgctcaatttgttgttcataaagcttttttctcttcaaggattggatagccgctggtgaacaagaacaatttcattaacttaaatattagcacagctatgtatcacttcagtccagattaaaacggttatacatcaatccagttcagatcaaaagaaagcaaaaaatatataatacaacttgcactatggagataagccacacctcttttattctttgcttttgagaactccttagccctctccagttctgcggctgcctttttctctaagactttctccttcttctccagcatgtcaagggtctaaatacacataaagtaagatttcagttccaatatatttgcaagtgacttgggacatgtgcattattgagtaacaaagtaataattgaattattcaggcagaccaaataagactcagacaatgcgcatagcacaagagaatcaaggctaagatcatagaatggagaggaataagaaagctttacctcatttaacttatcaagcgtggccaacgcactagcattggcctgctccttgggcttaccaaagagcctgttgaacatggctgcgcctgtaatattaaatccaaactctgcaggacgaaagcatagaagataccatcatttacaggcaatcggatgagcgaaacaaatcaaaatcaacgctaaaccgaagaagcaactaggagctaactcacacccctgatacaactaatgccccccaactgtaatatgcccacactatcacaaagtttactgatgcaattaacatttgcaacaagcagccgagaaatttaatagcacaatccgatcgtaatctcccaagatggtgggctaaatagcaaagatattaaatcagctagactgtcaacaaaaaaaacacacccacacatcgccttctactaacaaacgcaaagtcgcagttcatgagggaagtacaatcggctaaagcctgcaacagtgttcatcgaaccatgttccggccggaccaccggcgatccgagcagagcccgcgccgccgcggcggtcaaaacctagggcgaaggatcggcgcgcgcatcgaatcgcggagttaggtatcggcgggacagcccgggcggcggcggcgggtagatcgggcgctacggatctatagcgggagggggaggagggcggcgcgctcacctgattcgtcggcgggcgggcgtgcggcggcggaggaggcgcgggtttgtggtggtggtgggagcgacgagcgaggcgaggcagcgcggcggcggattggttttgggggttggggttggggattccgtcggttgaggtcgctcgtttttgattgggggccaggccaggccaggtcaggcaggtgaggaagagggaaaaggcacggaaacaggttgggactcgactcggaggcgacgccgcgtaacagcctacgtccccgcgtgtgcacgggaggaagatgaccacgcgaagcaaacggcctcggctaagatactactctctctcagttgtgccactctccgggataaacaaatcttgaaattgcagtatgtttcgctggttgactcgctttaaatttcacattcccttaagaaaagtttaatagtacagtcaactactagcttcaaatcatctgtagttaatttaatagttaatattatataatagttatttatcaacatatactatactattaatatataatatcacctgtcatacatattgtgttttgcagtctatactatagttggctataaatctagataagtgtatatctaatattcgtaggcaaaatgcttcgcgggtttctacagccgttgatgaaaagaaaaattacaaaaaatgattactcaattataaacctctttgttagcattccacataggccaggcagacacgaacaagactgcatccaatgtccaaacatggcacaacaaaaagggaaaaaaggaataaaacaatctgatcaaagtatcaaacaggtcaaattaatcaatatgctcctagactgaatagggatgctatgtacaaccgtgtcaaacatggatttcctattcgccaacccaactagacaaacagataatcaaatatcagtcggggattgtagccattgtacgctccagcgaagcacagcaatgtcaaaactaacccctaaaagaatatacagattagaggagctgctgccggagctgttggttctcccttcttagctgctgcacttcctttgtaaggccttccaacttctctaagaccaggttcaacacgcccgacatttccatctgttgcaagaaggtattaaaccttgggtaaatatggagtcctcgaatcatggattaaactacacaaagaaaatgtcatagcagatgcaaatgcacaaacacatcagaacagatggaagctaccagccataatcgtctgtttctaagtatacttgaacattttttaccaatttttttcctaaaccaccccaattaacaagattcatccaatcccactaatttgcctccttttatcctggctcatgcttgtgatatcactgtcgtctgtgaagcattctctctccgctttttgttcaaaataccaccaacttgataaatgctaaagcatgagctggtgaagtgtaagtatttgggaacagagggaataactattatacttttctttcgaaaagctgtctgcagattgcataacggctcatgatgccagtgctcctcttgacacatctagagttctccaggcaccaaacgtgttaagtagactttagcatggccctggaacaggttatctaggtggttgccattgacaaactaggttgctgacagactagaactcaatccagtgtaatctagtgcatggaagcggagaaagaatgtacactataagcatggttgcttataagatttgtcttacctcttgcatgtgaaactgtcttagaagttcgatgtgcagatttctcacgtcctcatggatggacttctgaacagaccctagggattcttcaagcatccgctgcacatactgaagtgagaaggatgaagctccctgttgatcagctgacaaacctgatgttggcaattgtggtggcaccaccccctattaaaatagcaccagtaaactatgttattcagacatttatcagtttatgtcacacgagaatactagcaaaagggtggttcttacattgtttgctacaaggttggcagatgaagaggcagctgctgcttcttgtcttgatagaagactgctgagcagttcatcttttgtttctgccccagtcttctttgattttggtgaaccaaaggctgatgctaatccttcactgaaaacagacgatgtgctcactctatcagtatatgttgagggtctccattgagaactagattgtgctgctccaggctggtcggagtttactggtggcatagtcttggccattaagcctgaggacagtgaactctggaggctagaagttgatatgtccagggaagggcgtgcattgctcaagacacccttgttttgtaggttcattaaaatattacttgttagagaacctttcagtgagttaccagttgttggagctgaatcttgtaagcctgcaaatgcaaagctgccagtctgaaaggctgaagccccaaagcgcgagacttgttggcggtgagttaacctatcggataatgcatttccagttgctgtctcaggtgaagtgatagatagttcactcttccatgatggcatggatgtagtggttgctgatgaggcatcatcctgtagaatagagatatgaagaacaaaattaagaaggctttacatctttgcatgactcggttatgtcaagtcaaacagtgatatataggaccagaataaatcaagtaacctgtcttgaattggaaattgacttccagtctgagattggatgtggctcattattgtcttcaataaacgggaattttctagttgtcgacaatttcttctctccaagtttatcatccttttttgtttcatcactcccatggtcatcccacaggctgccactggacggtgtgaaaggttgaacatctacaagtggagagaatacatccatatcatcctttagactgaagttactacgaggagcctgtagctttgataatggtccaccagacaatggccgtgtcctgtatggagtttcctccacagtggacgaggtagaggtagaaagaaatccacttgggtttgcagccaaagaagaccgaagatttgggatgacacctccagaatgaaaagctgaagttgctgaaggcaagggatctggcatgagaacagattcttcactactcccacccagaagagcaacctcagaagaactattctcgttaacaatgacaggctttgacctttgccaacataaacctgtcacagcctgattaaacattgtggattcaaaatctcatcaatgaaagtgcagatacaataatatctgtgaagaaattttacatcaggttcatatcagtttattgaactgtttgtccttcaagagattagttgtcacttatcatgttaataacatggccatagtacagaataaaaagaaaaaatggtctgcataaactgaaaatcaacaaataattcatgcagacattatcctaatgcaatttgctcaacgtcaacaattcctatgagcatatgcatactctagaatataaacttagtctgcaaaatacatgcaaatagaagagtgttttctctatttttcaggaaggggtggaaaactggaaatatagtaaaagatggaattgtgaaccaagtagaaggcctaataataactaaattgctcattataagtatgtgaaatttcactacaacaaaaaaaatccccaccctcacttaaataaaattccatctttgattacttctttttctaaggagtgatacatttgatcttcgaatgtggtttcataacatagtactgaaatgggctagtaatgtaatactggaaaatggatgaacttttgacaacattcaaaatcaagcaagggttctgtgatatacttaagcaaccaagttatcagcagacatgtgcgcaagctccaccgatatagaaatcaatagtaataatggattaattcatttacacatagagaacaaaatctgtttgtagatcatgcaatatatttgcagacagcaatgaggaaaaagaaaaatgtacaatttcgcacctctgagctattgtatgcacgaagaatagtcaatggctgaggttttcctcgaacatcataaaataccacacgaccactatttgtgcctgcagccaatattgtaccatcatcattgtatgccaatgatgagaaaggggcctcgtgaggaatagtgtgtgttggtcgtcttgaccctgaatcgagtgtgtacaacttcttgtccaggccaactgtagcaattatctacaaaataaattatagaccttaataccaagatatgaagatattattcattcacacaataagaaccaaccatattaactagtaccaaaccttatcactggagggcgaaatacagacaccacttatgggtgcagaatgttgcttcagccatgagacctatatgatgaataaaatcagttagatgatagcattagagaaagcacaaagcaatgtaaatgtagcaatcacatctaagtctccataaacagagaggactattcaaatcactgtctggaatttttctttatttttcataaaataataatctgaaccagcatttgtatagatagatatattcacttgtcacttttgactataacacacatatctaggtaattgtttgctttcaactttcatacgaaatgtcatattgccctccaaaactaactaaatgcttcattcaagaatcaccaaatatgtggtggagagaatagaaagcaagggagttaatatggataaaatagggaaaatgcacattgggaaccataaattgacaagtatttgtgcacaaataaaacggtcaaaagtgacaagtattcacaaaatgagggaatatttcccaatcaatttaattatatttccaagcttctaactattggtaacagatagtgaagagtcaactttggcaattattaaacttagatttcctttatcacctatatgacatgctaccttcgaggctctattctatcttttgttcaaattatataaaaatggcatagctttgatttaagatgaaccctaggagatgttcaactaagcagcatcaatgtactttaggtacctttggagttcttgcagttgtatcccagagatgcacagaaccatcatctcctgctgtcaccaatatatgcctactattacgtgaatagtcaaggactctcaaaacctgaccttgcagaaaaagtgcaagaaaactaaatcagaaggggaaaatttaagaattctcgagaacttaaaatccacaacagggcatgacagcatcaccatactacacagaaacacagaaagtaaaaagttattcacctgcccatttgggtcactaagttcagcagcacgtgctccagaagcaagattatggagaataagatcccccttcatgctgattgaagccaaatgttcatctttgcaattatacatcacacccgtaatggtgtcagtgtgaccacttaaccatttgatgcacctcttccgctgcaaatcccatatcctaacgatgtggccactcccaccagagcaaagatatcgtgaacccttgttgctaaaactgatagaatatatgcactcctgataatgatgtgtaatttgctgagttaagctacaggctcacaagtcataattaccaaataatagattcaatgttcctctagtagtgaatcgacagaaggaattaaaaataaacatgaaacatatcgtgaaataaaaaatgtaaacataattttgaactctgaatcaataatacagaaaataataaaccatcgtagtttccatatctagaatataattttaaacaaattgcacgtgatgcgttatataagtaaatcaggtagggcatgtttggtagagctccaactcctaaacttaacttcaggagttgtgtctggactctggagtggagttgtggagcaaggcagcaagctaaacccagctccacctctctagttcattttgtgagagtgctccacctagctccactcccaatataggtggaactggaactgtttggctgggctctagctccaggagaggtggagctggagctggagctatgccaaacaggcccgtaatgcgtcgtcaaaccaatcatgtactagaacagtaacaaaattctggagtccagtaacccagtctagatttaacattttcatattgccaataactctaatgctaaaacaaataaagatcataaatcgataatgtgtgtaacagcatcaacagaaaatgattgaaaatgctaccctaacaatagataatatatatactctttgaatcgatgctagatgaattcctggtagaataatgagtaccatgcatggctatctggagaaagccaagagcacaaatattataagagtgcacttctacctctatgtcatccccacgatcaacagttgatgttggtagctgtcctacattttgaccttttttgtgccataatgagatctttttatcatccccagcacttgctacaattagatctgcaggtttaaagcattaaatgaaagtcatatagtgtagctgagctcatcatgtaatggcattattgaaccatttcttccagatgttgaggctaagctttggtaaaaaatctagacagataggaatgcacactgttaggctaagaataacttacgcactaagcagacctctgtgcttatttaagcacagaggcatcaagaagagggaccatttgtttcttgctcacagaacatgcagattgaacaaagagataactaccattgttcatgagttagatgggatattaacattttaggcatttggtttaactgctgaaggacattgtcacaacccaaggccgtgacaggataaacaccaccgggaggatagccgggcggcatcggctgctagagaaaggagacttaggatggggagaagaacaccagggagagattagactaattctgattcattgcttaatcttgaatgatgatacaattacatcgatatatagatggagggaagtacccagtaccctaaccaactgagctacctaggtaaacaagatgaggatagggatttccttggtatcaggctgggccttgacctatcggcctgatcccatgacagatatattgcaagtaagctgatggcttgctgtaaacatcacattggttagatttgctaaggatgaagcaacaaagaacactctaccacgtcaaggccctgtttggtgggcctacaaactaagataattcaagcagaagctaaagttcctccaaacagggtgcagtggcttcttggacttgggtttacaagagcattctcaaaaaatacctaagaatttctaaggaactatgagcaccacccaaatgcatgtgcatagtaacgcaaaatgctcttaagcaagcacatttgacatgaaactgcttacaagctcagactccatctctatatgttaccccaaacatattatagaaccagcaggtaaaatgtgcagttcaaatattagtcgagcatagctatcttgctgcttatataatgagatggaacagcaattaccccagtctatcaatgcaccatcttgattatgtaatacagctaaaattactggtagcaaacagagtacatccattcattagtcgtgaaatagaaaaagatatctcgattgattgcattctgtgtatcgctacatacaaatagttaaattctggctctacattgtaggatcagaaaacataagcgcggtatctaactgaagatgcaatgcagaatttcagagctcgggaagaatgacgagccactgggacagttcaacactctcagcctgcagtctatccgcgccaagcccactccacaatacccagtagatcacaatgctggaaataaatcctctcgtgccactatctcataacaacgcggcaggggcatcgctcaattagacaggggagcgcggacaccctcagctcgaatcgcccggacagtacggatccccatggccgggaggctccggctgcccaccgagagatcctcgcgcgaacgacgccaaaagtaaacccaactcgggagatctgggaaggggaggggggaggggaaagagagccggaggcgggacgagcgggcacgcggtggagccggcgaggcgaggctgggggtactcactggtgtggttccagcggacggcgttgacggggtgtcccggcgcgggggtgtaggcgagaacgcaggggtcgccggactcgaccgtgacgtcgaacagcttgacggtgtcgccgccgcacgtggccagcagcggcgccgccggatccacgaaccccatcgcagccggaatggcgcaacggcgagggcggcggcgggcggcggatttagggtttggggatggctgggctgggtggtgggggtttgaggagaaggaggaggaaatttgaaaattgaaatggtttttttggtttttggtgggtgggttgaaatgaactactttgcgctagtgaagtgaaccgaccggttggtgccgttgggggaggaggacaagaggggatctgaggtgtcgttgctcgatagtgtgagttcaaaggttccttgctggctgcaatcatggggccgccggcctgtttgtttcgagtttttgcacacgattttgttagttttcttttcgaaaggctggaattagaaatgacaacgggggatgtggtgttggtggggcttggtcatgtggcaacgataacacgagtctagtaaaatcgacggtacgttatttgggttgatttgttcatcgtgctacatgcaggatcgatgcgtttggtaggacgaaggattgtgtaagccatatctcgctctcgatgattgtacgatccgtccttccctcatcccctgccccagcggcggagctatgtatagctacggggtgtcaggaatccggtttaaaaaaattttagctataatttatctattttcaccatatatatttcttgtcagtttaaacttaggcacttgtatcaagctaaatttaattcaaaccagagtaaagcaagcgagtgaaaccctcttcattttattctagctccgcccctgccctgcccttaacctgatagcaaaggacaccgagtaatggatatggactttggagtttgtgacatgagttaattaagtttttaggccgcgttcttttcggctattgggtttggatgattagctacacataaaacgagaaatacgattagcatatgattaattaagtattaattattacaaatttgaaaaatgaatttatttgatttttttaaagcatcttttatatagaaagttttcgcacgaaataaactgtttagtagtttgaaaagcatgttaacggaaaatgatgaatagctaagcttaactagctgtttagaacgtggccttaggctcattgggctttttcttatgttgttgggctgctaagtgactctagttggctccctcctcactcccccgctcgttatgcgaccaagcgatggataactgaagcggcagagccatcgtaggcaagcggtgggatggcagtaatgagcatgataagggctataaccaacgggcagaacactaggcgagccgtcgagctggctaatgtagcgcctagcgtgcactagcactgttggagatgcatcatgtgctagcaacgaggcaagggtgatggccagcggtatctcgagctagtctagtagtattgtaaagatcaagggaaccacccccatcccgttgctctgaagttttctatgaagttttcgctatgaaggttgagagaaatcatcggttttcgctctgaagtttcctttatactcaaagcctaccaggtactactccaatgtcttcttataatagtatctaagtcttcccaagaataagttgtcccagccatttgtttctactccaaccctcattggctccagtgctagaaatacaacgtatggctggttcttcttgctaaggcctcaacctcccttgcgagaccctatttgggtttatgccgaggcatgatcttctgtagctcattgtgatatctctgttttcatcgtcatagtgtgcatcgtcagggttgcagttgtggacagggcatagcaaatcagctgattgttttttccatttcttgttagctccttctttgcataattctgagcctatgtgtaacttgaccatatttagagggtttttatgtaaaacttattgtacttctaatttcttttcttgaggcagtagccaggatactatagccttagcttgtaaaaaaaacaaccggagaatatcttaattcttacctatcaatgatttttggtgtttcattgctctttatgggttgtagaaagagtaactgacatgaaactaatttcatcattggcacaggaggggaatcgatcaagctgtgatgggccataatgcttatgaggattgagctttgggcccaattcatagaaacaacagggtatcacgtggatcgaatgaatcgaatcaaacggatgaacgttatggatttttcacatttttgaactttttgaaaaacttattctaaaaattaattcttttcacggcgccaatgctattggggcagtggcaacatgacagaacgttttttttatctttttgataacttattttgtaaatattctttattaaaaataggtcattttcaattcttttttaaataagttctcggcgtcaatgatattagtgcactcccctagcctcccaacggaagctggtcactgatgtgaaggggtttggcgccaatgttattggggtcgaggatctatttgtaaaaaaatttcaaagaacttgtttgtaataaaaaaaatatttacaataggttcccagtgagaatgtcattggtactatccccatcgtatcagtgacttaacttccatggataagctaagggaaggcgccaatgtcatttgcgacgtcatgttgaaccacgacaccaataacattgaaaagaatatgttcttgaaataagtttttctatgaaataacttttaaaaaagatctaaaatttaaaaaatccaggttgaacgttcgtgatgacatggcttaaccaaatatcatcttaacagcgttgacttgacaagttgacaaccaatgatatgtggacaaatatgatcaatgttcgggttagtgtatccattttgagagattgctcaaaaaccacaacaaaataaattaatccacccacaaactggtccgaagatactttctatttgtcgattgaatgatagttactcccttagttattttggatttattttaaatctttgatcaaatttatagaaaactataataacatttttaataacatatataacaatggatttaatgaaattgatttagtgttataagtattgctatgttattaaacttggttaaacttaagacaaactgtggagcagggagtgattaattaagctactctatctgtttcaggttataaaatgctttgactttagattaactttgtagaaaaaaagtagtaacatttttaacccaagacaaatttttattacgaaaatatatttaattattgatttgataaaaactaatttagtattataaatattactatatttgtctataaacttgatcaaacttaaaacaatttaactttaaccaaaataaaaatgtcttataacctgaaatagagaacagtcaacaaataatgatgagaaactacttataactgctggtgtactaaaaatagcttttttttttaactttctcttctctgaccaataacgcaaacctattaatttcctcgtgttagttaatgaatcatcacgcgcgcagcttccctaacaatcaaagttcccgcgtcttttcctcccatcctctagctcatgccgaccgaaccagctaggacggacaagctccacaaatatatagctcacgctctctcgtcccctccatgcacggcctagctacccaccccccaccctacctctcctccgccacccgtcgccggccggcatctcgctcggagccagcgcgccgcggcggccggagcccggagggacaacgcaacgatctctctctagctagagctagagctatagcttagctcagctaattataatacatagctaggaagaattaacaattaatggggaagcgcagtgcgccccggtaccccgacgacggcggcggcggcggcggcgggatttgctgcgtgctgtgctggtgctgctgcttcctgttcctgatcgtcgcggcgctcgccggcgcggcggcgtacgccctgttcctgtacaagcccaaggcgccgtcctactcggtgagcaacatgtcggtgtcgcagttcgacttcaactccaacgacctgacgctctacaccaagctggtggccaccgtgcgggccgagaaccccaacgagatgatcggcatcatctacggcgacggctcccgaacggtcgtctcctaccgcggcacgccgctgtgctccggccacctccccaccttctaccaggggttcaagaacgtgacggtgatggagatctccatggaagggaggcacggcttcgggtcggggctgcagagcgcgctggaggagagcgagaaggaagggaacgtgccgctcgacgtgttcgtcagcgtgcccgtgtcgctgcggttcggctcgttcgacgtccgggaggtgagggtcaacgtgcactgcgcgctcgtcgtcgacagcatctcacccaagaagaagcccaccatcaagtccgccacctaccagggcaacgtagagttctgatccattgcatgcatcgaacatcaatgccttcattaatttcatttaattgtttgttttaatttgttattaactttgctgttcagtggagttggggagaaagtatgtttgtgatgtaaacactgtagtaagaaatggttccaaactaaaattcctttggttgaagttatatgcagaatgcagagacatcttttgatcagaaggtggttgctttggtgctatagtctcttttcttgagactaattcccgctgactgaaattaacttgttatttttaaccgttagatcagttttgagattcgtccgtcgattgaagaaagcgttcttttttagttaatttgatccataccattataaatatgcctattcagataaataccattacaattcgtaagattcatcttattcctccatcctcccctcctctttttccccatctctctccactatttctcagcctcctccccaccaatccatcacgtcaaggcgctgaagagcccgatgctgacgcaggtgctggagtgctccttcaagctcgctgttgtcagagagaggctgccgacgctgtgttcgatccatggtgacgaggcaggtcagcctggactacggcgacgtgcgcaccgcactggagagccccgagctgcagcggcagcatgtcaaccaccggtgcacgccaccgccaagtggctgaagtgggaggtggaggacgagctcgctagcgccgagcaggacaatggcatgatctactacatggcggtgccagtcgacggagtgaccgctgagctgctcgggctgcagcagcggcttgtccggtccacctcgctgcagaacatccagtagcaaggaacgcacgacagctagccgccgtcatgcgcgtagctgaagtggtggacattgtagttgggagagatgaatatgacggatgggtcccacatgcagatggaggagaggatgaaaaacgtgacggcgatgatatggttccaattttgtaaaatttgagtgacacggttacgaatagacgaattgcaataatatttgtctgaataagcacatttgcaatgacatagatcaaattaacccttttttctaaccctgagatgagttctgagatgcttagatagagcttccagatgcgtgtgccggttggagaagcctcttttcaaccattagatgagttttgaaatgtgtgcaccagttcgagcaaaattaggcaacctttttaatgcatcagaggagttttgagatgcctagatgagctctgagagattgagatgcgtgtgccgatcggtgaaaaaacacttgcgcagggccaatgatcaaacacacgatgcgccaggtattcgcgcatgcctccagcaccgatctacactatttttttcgagttacaatatgaccacatacgtatctacatatgaattacacagcataattattttactatcgtaacataattatttacgtatatgatctttacggtcgaagatatacatcactaacctgacaacctgctttagaggtttgtcgtctattaaaatattcatataggtcaccctaaaatgacaaaaaaaacctctcaagtgataagagcaggtacaataacaggctataagctaagctataaacatattttaaagagataaaagaaaagagagaagaatagcgggctacaaatctgtacccagcacggactcttagacgtaatgtatgtatgacaagaatagtataataagcaactattgtataaattagctattacattggctatcaatgatttagagctagtagttagctatactattaaacttactctaacgatgcaaatcttcagcgtgttaccaataaatcccaaaattttcgaaaataccggtgggtccggatgacagtttacctccgatttaaaagcgccgcatcgccccgtgcgtccgcctccacttcgccgtcaccccccccccccaccccggcgcgcgcgcgatggcgtcgtcctcccagtcgccggcgccggcgtttccggccgtgccgctcgccagtatcgtgtcgctcctcgccgcgccgcgccgcttcgcggggccgccaagtcgctgctcgcctctccctcatcaagccccgcttgctcgctgacctggccgccgcctcctccaccggcgcgccgccgcaccgcacgccgtcaccgccttctacgacatgctcttccgcgcctacgcggactcgggcgccccgactcgatcgcacgggcacggccgaggccttggagctaaccataccccgcgcctcggcggccttgatcccactccctcacctcctctccctccgacgaacaggccatctcgacgccgccgccgacctcctcaaactggctgccacttcttgtcccggctccgtcacgcttcttctccgcgtctattgtcgtcgacggattctgcaagtccggccacgtcacctacgccctccacctgctcgacgaaatgacaagcttaatgcgctatgctataactcgctgctcgatacacacgcgctaggaagaacacggtcaggtagcggaggtgctggagttaatgggaaatcaaggcattgagcccacagttgggacgtacaaaatcctcgtcgatgcttcattggcggctagagatatcagcaaagtacggtggacaaggctcttgcggaaaagatggtcatggtctcatggagaagatgtgcctcgagctggatgtgtatacggtatacatacaatatggtagggcagataggatgcatgaggctgagaacctattgcatatcatgattgagaatggtgtcagaccaaacaatgtaaggtgcactacgttgatcagcatccgttgcaatgaaggtggcatggtcgaggcaagaaggctgtttcaagagatggcaggaaatggagcaaaatcaagtctggtaacctacaatgttatgattgatggtacatcaagaaggggagcacatgcgaggctgaaaggttcagaaaggagatggagaagatcttatgcagcggtagttcattggcagtgtgtcagtgggaagatggatgtgccactggggctttttgaactttgaaaagatgaagcagaggggtttcagatccaacgtgtggcatatacagctctgatatccggcctaaccaaggaaaggagatcagaggaggcattccagttgtatgacaatatgctgggagatggattgaacccagatgacactcgctgtattctgctcttgcagggagtagttctttttctcaccaggccggcaaaagctggccaaagtttaagtttattaagagaggggtgaacttgtagggagtcttcactcggaataaagaaaaaaaggaatcatgaacaaactaacttctgttgggcagcagtgtaagttgtaccagccgaaatgcattccagcatgaagtctatgggtgtgtttggttgctcgtatgtcctcagcctggctagggtaatgcaattgactgtgtttggttgtttgcatgggttgatcctggatgatatgagatgctgtttggttggttgtatgacaggatgctgtacactagagatggtgtttggtttgttggttggaccttgggtttgagtgacctcttgttacctatggtaaagttacctcttgtttgagtgatctctcagcagaaacgcagctggagagccaaatgcaggagtgcttataaatggattgttcaatgctcagtttgttacttaaccatctagattctacatgatttgattcagagcatgtggctgtgcagagttcgtttcagaatacagagtacatggaattgttacaactcaagcaattggttcactattgcaaacatatatttttgtttgcacaacaatacttcagtttgctggtaatgatatacatagactaactgagtagtgactacttttggtcattatttattgtatgaagtggaaaaccattgttctgagtatggtgaccttaaatttgtccatgctgttataaactgtgcaggggattgtagttcctttttcagaatatttgtgatggtaataataccacatggcaatactttccgatgatttattcaggagatcgggtgagatacatcggttctctacaagcctacaatcaacaggaattatccttgggggacaaaggtcggtgcatgtattaagcttggttttctaatgttatttgttgaattcttaaattcatgtacctcaatatgtgaagcagttttcatctctgtgttcacttaaaagttaaaagtacattttgtggtatgatagtaccaagggtgaggaattttgagagacaaattactactgtaatgccaatctggaaaacatttgcatcgcagtaagttatgtctggcatagacataagcttactttcaaaaatattcaactgatgtcactgtttggaacgcatgagtctcttaagaatatcgtaggaatttgtacacaccagacaggatgtcatatttttaattcttgtaggatttttgtattccaaacacatccaagaaagcagatctcatctagtaatcatggtaataactagctccattttcttatgaacatggcatgtgatattttctcaaacttattgtatatactagtattgtacttaggttctataacgattgtctgatggtgtagattttcttactgaacaaactgccctgattggtttgaatttctgattgtcaatctgacatgtgatggtgtgcaggttttctgaactatatgtattttatttatgaattatctgtttctatgccttctttttacaaacaacctcttaatgttaccatttgcatcttttacttgcaatcacctctgggtctttttccttttattaaaacaatcttttggtgtcatcatctgcatcctctgagtggtttcttccaaatgatacaatctgcagagttccagattatagttcacaagtgaagtgaggcttccttttgaagaaaatgaatccttgaaagttgggagtcagatttgataagaagatttctggtggcagtggcattgatcttggaggtaattgtgaggttgaccctggtttcttctgtccaggtgagcctctttgctctgtctccttaaataatttaaaactatatcattcatagattctgtaatatggcatttattgctaattcaacataaggtaaatttgtaatcacttgtttatgtctcttcatatctcgagttgattctctttgcctcgatggtccaggatgggaagatagagccaaacatccctctgatgtaattcaaggtgtgtacaatccttttgtcacgtgcagggattatttgggggtgaaggggaatatattagattataatagaaggaagtaacaggaatggccctggacctcaacagcgtgacagagtctagatcaacgccgtgccggagagacaggctatgggtactccgataatcttgatcgaatcctgacctgaccctccttatatagatgaactccataacctaatcccatcctaattaactctatccaactaatctactctatcctaacaaacactatccaactaaagctacgtacttaccgcgagggggccatcccctagggaatccgttactctcaggcccatgacatcttttgtgttatgtactttgtcctgttccaattcttgtcttttacttactgggttctttctacagtttgcttctgaagaaagtcagcatggccctctgatacagtcaaacaacagtttcttttttatttcaaaatgcccatacaaccaagcaatattcaatctcaccttcgaggtgcacttttttagttttattgaagcaccttgcaaattgaagtttgtgtcattaagctatattcctgaagtaagtaataattgcttgcaaaaatatggattatgatatttgtcaactgtatgatatggaacgtgttttaacttaaatttctttatcttaggaaataatatttttgaaggaggttcacctgctggctttaaacttgtcgttttctctgaactgctggatgtggagtaaaaccactggtgaccaatttgaatgctgagaagggaaaatgttttcatccctcgaggggatatgccgagaaagatagtgaaccatttctaagtaagcatataccgagattcttgatagaaacaccttttgtactgttatcctagtattttgatggtgatttggtggcagtaataatgacaaataacagactctacattctatcctgatgtaaggtgtttaccatacatcagtttatatacttgtaccatactaccactaaggcagtaattcatagagtttgtttgaggaaccttctctagcttctgtgcggttaatacattatattccctccatcgctgtatcacgccgttgacatttcatatgccgtttgaccatttgtcttattaaaaaattatataaatatcatttattttgttgtgacttgttttatcataaaagaaactataatcttgatttatacttttacatatttatactaaattttttaataagatgaatggtcaaatgttataaaaaaatcaacggcgtcatacattttgggatggaaggagtaattttttggtttgttggtatgcataatgtagaaatttgtaaattgcggtgcttagcacgtgttgctttggcttgggaccctgtatcaggtctgcacattattccaaatagttacttcaagactctagtggttgactcatcgcctgccttttgggattcgacatcaagggattgaaagaactactgtgcttgtcctggtaagtttatctgctgtgatattatgtttttgacatgaatgtaatattagtagtgactaatgagtagttagactgcaaaatataaattatggaacaccctaatttcttgtactaacacgtaaggcattagccatttattatcccagcttctctttttgtaacttataaattgtcatcttgatattttgcatactgttttaatcccagcatattatgactttattatctgccatgcacggatgtaccacctgccatagccacctcccagcagcatatgctgctcccactcccacgtgtaccaacaagttgtcctgcttgagttgctgacggtctcactatgtagttttcaatgcactcacctagtttctaagctaccattcttcatgtttggtgcttgcagtattggtaacccaattattgttgccagttactaaagtcactaaagtccaccagctgtgaacatatcagccgacacataataagcttctctccaaaattcagaatttaagaaatttggggtgtccatttgcacggtatccattttacaagtgtcactaaactatccatgaaatttttttatctactgctagaaaaactaaaatactaatttctcaactgtatacttactatataaggtgtcttcctattattgtatgctgattcctgcattgctcgtacgaagtgattcttcatgtttcacttagtgctgcaggaagcagatcctttttgctgtaccctgtactcgtcacagataatcttgttgtgcatgcatcataattataggccgtatccttattgctcaatttggatttgaggatggtattgttatgtgaaatatcatcttatttacacgaatcgcttggccagataacttattaaactgtattttttacattttgcagattgttggtttcatgattgctgtaatatttttttggcctgatgcggatacatgatttttctgcgccatctattttgtcagcttcagagtctaatctgaggctgccaggagcattcatgttcctttgcttcataccagtgccttcctattcttcaccagagagcaaaatcctcgatttgaaaccttcctgattgttaccatgatgtgctacatggttgctaatggtttcacaatatgattgatactaagttcaaaattgattttttatgttgctgcgattcaaatgtcttcatgaagacacggttaatacacaccaaatactgcttttattaattcagtaagtaatgtttttatgtttatctttgcgatggagatgttcatttgacctttatttcgagtatgctcagcatcattttttggcacttttgtgcaacgtgcgaactcgtatcctggattagtattgcaatcttactgatttactatctttttttttcagttaaatatttcctccatctcaaaataaatgaaaaatttaccacttatatacgtgctaaattatgagggaaggtaaatgttacgcccagaaatttagcccaaatttccagactattttgtatattaaatccctgtccagaaatcagccagggtacacaaaacaataaattaatatacagatccaaatgtaaataaaacgtaaatacttacagaagaaataattagtcctcacaccgaaacgaaagcagtagcagcggaaaaaggcgatcctagtggggctttagctccactccacaagcaaaacttaactggggtctgagccttggtcctctaacttcgtctccacgagcaaaactcaactgaggtctgagctttagtcctctaacttcgttttcagctcagaagcactacacttctgaaaaagggaaaataatagcaaggctgagtacaaccactgtactcagcaagccataccaatgatgcaaatgtacaaggggatacaaggacgacttgtggctatttgcataaaggcagctgtaaagcattttattgagcaaaacagtaaaactgttgagtaattaaggtaatattaaatctccactaatcaacgctacaccatgttgaacaggctcaaccatcccacctgaactatccagtgcattgcattgagtcgatttattaggggtgagactaatcacggtgattttgatcgatcgcccataatcgcaggcacggctattcgaatagttttactctagccaaaggtgcacaactgtacccataagacacaatccaccggcatgtcaccgcatcaggcctgacacgtcaccatgtcgagtgattgtgacaagacccttcatataactccccctgaccaagtacaccacacctcaggtttcgctcccactcctcaacaggcagcgggcagcctccctcgtgcctaggcgaatgtcatagcctgatttttcgtttcaggatttataaattatttaataaattatcattataatttatattaaatgttcattaatttacaagtgaagttaaatgtgggaaataaaatttcctaaatataaagcatggctcgatttaattttttattaaattctctatggttaattatactctctgaaattttctcggatttttcagagctcaattactaattttaataatacaaagaacattttagcaattatttaaacaataagttaatcattaaatggtctgcttataatttttttaaatacttatagtgttcaagtattttcaggagttttcttggaattaatctcgtgaaattcataactaaatcatatgaagtcggaatgaggccgttcaagcctccaaattcatataaaatcatgatcactttttatgtactgtttatttggttcttattagtctttttctttgttttgcgttttagtttctcgtttccatcgtttcgggggtacgtgtgtgtgttggaagtgttccagaagattaattgaagaccgattattgcaaggcaagtcacacagatcccaaacacaatccctttgagcatgttgatcctatatttaaattctctatttatttcaactgtgcatttattttcgaatgccatcgggtggtgtgaacttatacctttgttatggccaatttgcattgattactctattccttgataccttgggttattatgatttgactagttgagcaagtattggtttgactagatattaatataattgcttagccatgcttagaaacactagcacacaattgggatgattaatgtttcactattacctaaagatggatatttaatggtagctcacgatggtcaatcgtgattggataattaatagtcaactaaaacttgattaatggtgggttgtgagcacacggttggaagtttggattgttgtgctcatgacaattaaggatcggttcatgagctactgttgtgagatattaaccgtactaaccacaagtcagcatgggcaacggctggatactttgtgtagcaaggctcattgtggggagccagactgtgaagcggtgagaagtccgtgggggtcgctggggagtccatacctctggtttttgagggggtgactacaatccaggaaaggtgcgccgcttttagttgagttatgcgaggggtcttgtcacaactacacaaatggtgacatgttcagcatgggcacatggtgatatggtgacatattgtggagttgtgtcttgtgggtaaatttgtacacctctggccagagtaaaactattcgaatagccatgcccgcggtcataggcgggttgagcaatgtttttcgtgattagtctcacgctactcattaatgataataatgtgacaattaatttgactcctagtttggaataacaaattcctggtttgggggtttgatatgtacgaccggggttggttgttcaggtttggttgggctgtgcagcattggggtgctgttcagtgttgattaatattgatgattaattactctactgttttactactcttaaatgtttgctaaatgctgcttttgcaaatgagcctatattatgccatcctttggtatccttgtacacttgcatatttgctgtgtggtttgcgaagtattccatgtactcaccttgcaataatcaatcaaacctcagttgaagaaaaaggatccataaggagaagacggttgacttataccctagttgagctgcctgtgggagtgtagccggagcttcgctagaccgtaattccgctgctgtttttcttttcttttgtaagtatgtaacgttattattatgatggatttgtatattaaattgtcagtttgtgtacctcggctgattcctggatgagggttttatgcataaacaagttcggaaattatttgtgaatttctgggcgtgacaagttggtataagagccatcttgactgcaggataagctaaatggtcaaaccttaaggacaaattttcgaaaaacattatttgtgaaaattttcctttcttccttctctagaattctttggaaatcattttattctctcccctttcctccttcaacttgagtagttgttaaacttgatggagaaactcgaagacgtcgatgtggtctacttatggaagtcaagtggatcaaggaataagaagatgatggttgaattgaagtgccaagtttttgtgatgggatgaagtttggatctgaccctagaacctaaaccaccaagggactttgcagaatagttagtagggtagaatgtttgttgcttgcttgtgtgtaggtatggttgcatttccatcattgatgtagttcagtgatgagcgtgtaactatactaggttgcttgtttaatcaacttaaacaatataatggtctacacatgtcacgcccagaaatttagcccaaatttccagactattttgtgtattaaatccctgtccaggaccagccaaggtacacaaaacgacaagtaatatacagttccaaacgtaaataaagcgtaaaatacttacagaagatcggcacttagtcctcacaccgaaacaaaagcagcagcagcggaaaaaggcgatcctagagggcttcagctccactccataggcaaaactcaactggggtctgagccttggtcttctaacttcgtcttcagttcagaagcactacacttctgaaaagggggaataatagcaaggctgagtacaaccaccgtacttagcaagccacaccaacgatgcagacgtgcaaggggatacaaggatggtttgtggctatttgcataaaggcggttgtaaaacattttattgagaaaaacagtaaaactgttgagtaattaaagtaacattaaatctccactgatcaacgctacactacgttgaacaggcccaaccaacccacctgaactacagtgtattgggtcgatttattaagtgtgagactaatcacggtgaatctggtcgaccgcccataaccgcgggcacggctattcgaatagttttactctgatcagaggtgtacaactgtacccacaagatacagccccacgacacgtttccgtacgccgacatgccaccatgacataccggaaagaggccgtgacaggacccttcacatacccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactataagcccagccgttgcccacgctggcttgtggtaagtacgataagttcttccagggcatccgcgaaccggtccttaattgccatgggtgcgactagcaaaaccacgcacccacagcccaccattcagttgccttttatttggataattacgaccataaagcatggccagatgtctcgagcacgcagctcattctgatactaaaaaggtctaatactgtaattatcccatcaactgagctagtggtaattaagcatggctaagcatacagttctagctaggtcacataagtaacatgagctagtcgatttattacccaaacttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcaaaacgatcttccgaactcttttcctcgcgaccgcggacttccgaaacgacggattctacatgctggcgcgcaaaatgaggaaaaactctaataaaaaccaagaaaacaatacataaaaactaaacaaacatgtagagctcaattttagatgaattttgcaagttgaatggctcaattcggagttcgaatgaattaggtatgaattttagaagttttaagccatttaaatgaatttctagaattaaactcgatttattgcgcaattattatttatttttacaaaggaaatggacctcgctgacgtcagcaaggggtgaggcgcggatcacgtccacaaagggggcgggccccacacgtcagcggcacggcccaccgtggaccgagtccacggtggcgatcggccacgcggccgcgcacccgacggtccagatcggccaaggccgatcggacggctggggacggccgggcggcgcggcctggccagcgcgcacacaaggctggcggcggcggcggccgggaccaaagcgacggcggcacacgggccgggcggcgcagggagcggcggcacgcagcgcgggaagcggcgagagcaaacgggggcagtgagggagagggaggtggcggagctcaccgaggggcacgtcgatggcgagagcagccggcggagggaggcgtcggcgctccataggttgacaatgaggaggggctcccggcggcgtaagtcggcgaccgggcggcggacggggaagagcggtacgcggcggcagccggggtgatggcgaacggcgtccggagacggaaaaaaaatgaccggtagggtagtatggtgggaaggtggttctggtggtggaggggaaaaagggatgggcggccgggcttgcccttccggtggtggatctaaccgaggcagtggcgcggcttgaggtggttgagnatggcggctanagncgcccgnagccggtagccggtggtgcccnagccgncggtgttccggagttgaaaaggggaaataaagtagaggccgggctgcggcacggcgccgcgaagccgacggtggtggcggattggcccgacggtgggtgtaccaccggtggcggccggccagagctcgccgtaaagcgccggtgcgcgggagcggcgtggggagggggagagagagcgcggctggctcgggtgaggaggggaaaagagagaggatgctccggggttcgtttttatagggtcggagcggcagaaacggggccgagaggggcggcaaccagcggggaagtggggcgccgatggggggtggtggtggctcggtcggcgccggtttttgtgggacgagcggggaaaatggtggaggacgtggaggggatcgtgcccacgtcgttggatgcgagctcgggtgcgggagggcgccggattttgcggcgacgtgggcggcaatggcggttggggttggccggcgagaggtatgaggaggagctgacaggtggggcccacggtcccacctgtcggccggatggagagagaggagggaaaccgggggacgtaaagtagactttcgcaaggcgcgggccggccgagagagggaggaggcgcgcggcccacgagagtggaggggaaggcttgggccaagcccaaaagggaggggaggggattttatttgttttcttttttttaattgattaaatgaactttgtgctattaaaattatttcttgagctccgaaaattcacaggaaatttcagagagtattttagggcaaaagaatattgcaaaatattcccggccaatgatttttaagggaaaattttaattctcccattaattcactcgaataaattgctttaacttttaatataatttcttgaaatgcattattaaatgattttaaaacccgaacgaaaatcggggcgttacaacacacactagatcaatggcaacctggttaacgtctttgtctttagtataaccactctccttctatcttctctaatttgcaacagatggtgaaccctcgtgccagtggaagtggaaacaataacaatgaagataacccaacccttgctcaagtgctggctcaacaaacccaactgatcaacctgttagtgcaacaagtgcagaactaacaagggaacaacaatgccaatgctccaccgccacctcctccaccgctgcagaacaagctagcttattttcttcgtgtgaagcctccaactttttctagcactactaacccagtggaagcaggtgactggctgcacactgtcgagaagaagttggaactgctccaatgcactaattaggagaaagtcgtgttcgcttcacatcagtttcaaggacctgcttcagaatggtgggatcacttccggatgaacagagcagaaggacaaccaatcacttgggtcgagttcactgaagcattcaagaaaacacacatacctgcaggagtggttgctttgaagaagcgtgagttcaggacacttaagcaaaaggatcgtaccgtgacagagtaccttcatgaattcagccgtctagctcgttatgctccagaagatgggcgtactgacgaagaaaggcaggagaagttcttggaaggcctaaaggttgagctgccaattatgttaatctctcatgactatgctgattttcaggagctggttgacaaagcaattcgactggaagataagaagaacaagatggacaaccgtaagaaaagaatgattgttttcaaggaggcacaggatagtagccagaggcagtgtatgaagccactccaaaatgttgaatcggcttcgacatctcaagatcagtcgcaacagttcaacaccagtggtgagatcaactcagagactaatgcaagcaatgaagttaacattgagcaagctattcaatcagtgccagatcagcaggattagtctcgagaagacaacaatagaagggagcaacgggtatgtttcaactgttatgagccaggtcactttgcaagaaagtgttcgaagccgaagcttcagcagacacaaggtcaagtcaacaacatcatcatcacatgagcaaatgttgtgccagttgcgtcttcaaggaatacaactcagcaaccagtttcaaagcagcagtggtaattaagcatggctaagcatatagttctagctgggtcaacataggtaatacaagctaggcaatttatcacccacggttgacaaaggacatactcaagtaaacatggcacaagcgagcagataggtaatacccccctgatcccatgtaattagcaaaacatgcaattttatttgcaaacgataaaacatttgtaaattaggctcaaaatgcccaaggggaatgtgtgacttgccttgcttcttcacttggatcttctaaattcttttcctcgcgaccacggacttccgaaacgacggattctacacgctggcactcaaaatgaggcaaaaactaataaaaaccaaataaacagtacataaaaattaaacaaacatgtagagctcaattttagatgaattttgcaagttgaatggtccaatttggagtttgtatgaattagatatgaattttagaagttttgagccatttaaatggatttctagaattattattgatttattgcgtaattattaattatttttggcatcaaccgaggggg

SEQ ID NO: 33193 - DNA, 693 bp, Oryza sativa
ctacccgtgcactgccacagggcgcaccacgtgacagcataccggacggggagggcgaagtggcaccaacgtggcgccacggtggcatccacattgggcggcaccggaaggccacgcgggcggcccggatagagactggggccgatccgacagcccagatcggccgcgcggcagggaagccgccagccggctgtctggcacaaccggcagcggcgcgcggcggcggcgactcggccggacgaccaccggcgacggcggcgcgtcacgagcaagcccgggaggcggccggtgaaggggttgaatgggggtgaggtaggggagggagtcctcaccgtgctcgtgtaacggcgagaaggcgacaggaaagcggcagcgggctcctcggggaggcacgacaacggcggtccagcggtgttccgcgagcgggaaacggcggccgacggtcggagggacctaagggagataatggagctattaggagagggaagggagttgcggcgcgatgagaaacgctggtcggagggggaggaaacgatggagcttacagacgtgcgaaggaaactgggttccggcgaggattggaggaggaggaggggtggccgggctgcggacgacggctgtggtgtcggggaaggagacgacggaatgcggggtcaactagggcggcgagaagcggcggtcggaggcggtaaa

SEQ ID NO: 33194 - DNA, 4601 bp, Oryza sativa
gtgtgacgcggaatcggcggcgtcctggggcagcatggcggcggttggggggcgcccggaggtaggagatggtgctgaaagagagggccgtgggggttgagtggactctggagggaaaggggagcaagtgggctgagcggcccaaagaggagaggggggggggtgggtggcctagcttgaggggaacggaggaaggagggggattcggccgaaagcagcccaaagggagaagggggaattttatttgttttctttttatttaaatgagtttaatgaactttgtgactttaaaattgtttcttgagctccgaaaattcacgggaaatttcagagagtattttagggcacaaagaatattacaaaatattctcggccatgatttttaaatgaaaattttaattcccccgatagatcacttggttaaattgctttaacttttaatataatttctagaaatgcattatttagtgatttttaatcccgaacgaaaatcggggtgttacagtaaatgacatagatgctccttattactcttaaatgagtgatgtttgtgatagggagggtagtgagagtgataagataggaagaaatttgaattagatgtgattaatgaaacaaataggagtaatacttatgaagtggcacttattttgggataaattttaaatgcaaagtggtcacttattttaggttggaggagtataactattttcctaggtttgctggggaagtagttattactgtgctcatcgtgcaacaaaaatcaattgtcatggcactactggagaaacatctttgctgggttggccaaaaaccacaataatcctggtttaaataggtaccgggactaaagaatatatcttgtcccggttcaaaaacctaaaaacacttaccaaacgggactaaatatcatttttagtcttgggtcaaaaaaggcagacggtgtcagacccctctactatctactaaagaactatttttagtcccagttgttaaacaatcgggaaaaaaaatcagcaaccgcgcgctaaaaaaaattggatttactgcccccgatctcatccttatctcttcctctcatctcatctccttatctcctctcatcaaccttatctcttctcctcctccttccctcattctctcaccccccccacatcttcttttccgccccacttcaatgtacttccacttctaattccctcatgcggctaccttttgttcaatatttactactacttcattcccttaatttaatgatgttgaagtaaataaattgtagtatgtctttcttgtaggagcagtgtatggtcctatatcattttcttagatccaatatatcttagtttatgtgcatctgcggactttacattgttgcttggaaagtgtatattattcaagtacattttcagttctaattggtttatcataatagcctataaagtagatggttgctccctatccttacatgattatcccatctaggtcctagaactataaaaaatacagagattcaaatctcacaaattgtcagaatatgtgaccctttagctgaattgccatgaccctttgagattctacgtggcgatgacatggcatcatcactaattctacactaacactcgaaggaagaagagaaaagaaaatggaaaaggaaaaggaggaaaagaaaattttttaagtgggctccacttgttagtcggtataggattgatgaatatgccacgttgtggtatatcacgtcaaccctagagaaggaccatggtaatttggggccagaatgatatactagtataatttttcatcaacatttgctttgttcaacgcgcgtgcacatctgtaaatttgagggaatacattctatttaggaccacgttttcttcttctccatgttcaactttctgcatatgcaaattagggtatgtgcatatgcaactttctgcgtatatgtaataatgtaaattagggtttgtgtatatgtaactatgtaagagagctcatcagcgtactagagtcgatatgctcaaaattgttaatgttgtaaagaagtggtttaaggtggtccaaagatcatgaactctatcatgggctgttttacggctaaaatatacccacgatgcgggagacgaacgaatggttgcaacgaagaacgtgaagaaatagaagagctctaaactcgaagcagacaggcagggcaaggctgggctctagcatctgtgggcgtaataataatgataataatatatgttcttcaccggccgctattagcttttctctggaatccaaattttctttttgctcaagcggcccaaagtaggagattggattttatctttcttttattaccttttcgatcactggtcaaaatttggggtatccatcgaatggattcgattccaaaagtaatattctcctttaaaattgtcttctagatcattaagtgttagttcatggaccacagggtaaaagagcggtccatgaaactaatatcaaagtacgaaaataacctaaaaaataggagtatatatcaaagtacgaaaatatatatctgaaaagatatgtttggctgatattctttttcattcgtccagatgtgtgtcgtacgtatgatcaatcagaaaagccttccgcgaatttaaaattgtgtttcagtgcagctttaatttaattttaagatcttgctcaatcgcaatatatgcaagtttaatcttatactagaaccagttgctttctgcgccgtttgtggtggtaggatcaaataaaactcatcacataccggagatgcgagacgcttggcgcgggaaagtgttcatgcaaatgatccttaattcaaaatataaatacattcagatttgcatgaaacaagaatgtttggattattttatatatatcccgcgtgtgatcaatgagctagatgtaaacagctttttttctcaataatagaaatcaatccggccggcatccacaaacacgaatatcctccgacgataactaataagagcatcacccacaggttagcaataatccattcccaaaatttgattttgggttttctaaactgaaaataaaaaagtgaaaaaactctttctttcaagggatagcctaaattcaataaaaaaaagtggacccttatgttaaactaccaaaatttgattttttggtttcctaaactgtaaataggaagtgaaaaaactccttcctccaagagatagcctaaattaattcccaaaaattaaaagtggacccttctgttaaactaccaacaggaatttccctttttttccattcacgcgtacagaaagagatcacgatgacacgcatgctcccaatagaaatttcgccgctcgcgcgggaaggagaggagaagcgcagggaaggagagagaaacacgcgaacgagagattgggagtcgctctctcaccctcaaatctacataatgaaatatatggagatgggaactccaaaactaatgtaaggcttttgggaatatgttggatctgatttgtaaaaaaaaacccctcaaaatccgttttgggaatgaaatatgatgactgttggtgatgctgcgatttaagtgcattcatatttaccttgcccttgtattaatgaagtatacatgaattttagactatatatatattcaatctgcaataaattctgaggtatattctcttcttttaagcgtgtagcataacccctaactgtgggtcattatgtcatattaggtctgctccaccatggcttaatcggagccacagctttaatcttgaacctacatgacccaaaaaactagttagtctgatatgtaagaactgtctccacatgtcacaaatcaggcccaataatcttctccgtcatatcaatctatgtgacccgaatacttgttactggggcacccccaccatgagaaccatgaaagttattctgggtttccaaaccacaggtcgaattagagctacaactttaggtttaggtctttgagcctacacaattcaaaagattagtctgatgggtgatgtgtgccccaccttttaagttgtgctaccccgttatcaattattgatgtgaaactaaacccaacaatctctctcgtcacacatcgggtccaacaatcttcccatcacatcaacccatgtgaacccaaagacttattaccggggctccctactgtgtgacccatgaaaattattctgggttttcaaacctaggctatgataccacttgctagagtgcgcagtatagcccaccaaccgtgggtcacctaggtcatattgggcctactctactacatgattaatcggaagcataactttagatcttgggcctatgttatccaaaagactaatcttatggatacggaatgctcccaccttttatgtcgtgctcctccatcattaattaccgatatgggattaaacccaacaataaaaatgaaggtgaacctagtcttcgaggagtttagaatatgcaagtgatggaggaatccaatttcgcttgatacgatgatagtgatgatgggagaaaatatggagcattgttacaagtggagttcacacgaaaaagttacagggatagcggagtttctcgatgatggtgagtctggg

SEQ ID NO: 33195 - DNA, 2247 bp, Oryza sativa
ttagtcccgcattcgtagccccggtttgctacctgggaataaaggggttgcaaaccgggctaaaaagatctgtgcagcagtgacgctcgcaacatcccactatatattaaaaaaaaacctttgccttgaatcagcttttggtaattattatgacataaataatggtgtgacgtaaccgtctggagagaatgctaaagcgaaaaggaaaaaaagtaggacgccgtccatcgattaccagacttagtacgcaacttgaattaatggtgacgggtgagtttcaattagtagctttttggttggctgctaactcgtcttgtgtgcttcgtaactactaaacggtaagttatttttaataaacattttatgtgcaatattttttaaaatcagataaatttcttttaaagtttataatagttaatgcttagttaatcatgcgctagcagctcttctcaatttacgtaatacacgaaaaagccaatccatttagctgaatttcaccctaagtcttaattttaatatggataacttattgtatgggctgttggtgtatgctaggataacttgttgtatgggttatctgtatatcttttaaatatgacatagaaagattatatatacaacaactgttaatacccttaagagcaactttaggtacttaaaagatactataatttggtatttctcagcaactcatgtagcacggtacctcatttagcaggaggttggtactcttaatatcgttacggatggttaaatttcttatttattaatgaaatggcttaattgcttaatccaagatagttagatgacccttaggataggagaggaatcttgttagaatattacaataatttaaaacctatacaatatttctttgctcacaataaaagataggtgtctaaggacatgattaatgtggtaagttagcgagtggcctcccaatgccaccttggagacagactgccagctcggccagagcggtagctctgtatgggcacatgtgacctatagagcgcacggtgacttgtgcatgaggcggttgctttggtggtccaagcctagaaaaataaggggaaccagggagggagtaggaaaaaaaagaagagtaccggagacttggagcatgtcaagttggtggaggatcctggtgcagattgtactagattgggcagtcaggaagcagatcaggctatcgtcgacgaaattagcatggcctcgatagagaaattgacgtaacctcactgtccttgtgtcatcgagatatcactaacttgagataggagggagggatgggatggggcagagtaaggtgacattgttggctgcatcggtaaagagtgtgagtattatagatatggcataccccgtatacccgcacttactatcattgtgattatttcatacttattcttatatggaaaggtatttctaaatatggataaatatacaaacaaggaatgactgtaaagtccgttccagtagaaataaggccttgtttttccatacttatttgagaccctgagttttatttgcgcaaggagttatatcacagtataaacatgatgctttacaggagggaagggcatcaaatcataagccttacacaacgccacatcgagtttataccaggaggaagccctttcgctagatgccgagtacaacctgccgctttgctcatcaagatcaattggttggctagattaggttgcttgctctccttttgtacttggtataatacatccaagatagagcaatacatataaacaggagtatggctattacccatatcggggtgctgtgttgaatagaaggacaaagggggttaattggtaggagagagagtgggggagggagaggaaaaagagtgcggttggaggctaactgggtgtccatcacgatgttaagggtatacactggtggagaaaccgtttgtagtcccggttcgtaacccccctttagtcccggttgtccaaccgggactacgaatcccggttcgtgttaccacccgggactaaagatcggtcagccacgtggccggccaaaccatctttagtcacggtttgtgttaccaactgggactaaagattggtgtatcattttttttatttgcatggctctgtttgctgcatggttatatatatatatatatatatatatatatatatatatatatatatatatatatatatatatatatatatatatatatgtgcatatgtgtatatgtataaatacatatattacaca

SEQ ID NO: 33196 - DNA, 1229 bp, Oryza sativa
agctatagctacgacttcgacgccggcgttatgactctagaggaaggacccccttatgaattgtcgatccgtcgtaatagaattcaccattgggattaaggacttctttgttgatgaatcccatcagttgttcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatatgtacatcgagctctcgtgtggtgcatatttggtttgataggcagtgggcatactcgcatacgtagtagccgcataagttagttccctggtcctgctttgcacactacatgagaaacgatgagagatttaatatactctttatattaactgtaattagagattcaattcaatataattttggatcatgcatgtactcactggaaaatgaaacctccgtccaggtttttcttcccaagtcccgtggaccaattgacggaaccgatcccaagccctacatatgcagttgcaagctatgattaattaattattacccgagaccaacataatagcaatagaatccccgcgactttggaatagatggcattatattacctgtctatcagttgaaagaccttgtcaaaaatcttctcctctttattcattgagtcatacacagtgactctgcatgcgtccaagtcgaagaataacaggacccagtggaatctggaatatgcgtgagatgagatatatatgaaaatgtacatgctatatgtatgggaacgaaatttgttcgaacgataataaaaactcactctgtgttgtacggcagtagtatgtacgtcttgaaatgctgctgcgttaggagatggacgagattgtcctctgtgtctttcttgtacttgtcgatcatttcggtgttgatttttcaagggtcgatgaacccagtatcgtagaccctccgccgttgggccctttgaatctccattctacaacgatgagaggggaaattattattgcttatatatatgccaggagctaattattgaacgaaacaaatcgaactcaaagatactcacaaaatacatgcgctcagaagagagacgtcgagggcgtctagatggtacagatcaaagagatccttgaaatggatccagagaacatcttctccttgcaagaagtcggggttt

SEQ ID NO: 33197 - DNA, 9743 bp, Oryza sativa
cgtctagatggtacagatcaaagagatccttgaaatggatccagagaacatcttctccttgcaagaagtcggggtttctgatcctcgctccgaacatctctctacccttggcgctcatttccatgtacccttcatggaatttgtacatctgcgttggtagggactgcagctgctcaggcgtgacaagcggtttaccgagttcaaacttgtatgccacttccgccttcgggattggtgcgcctcgaattagctgatccacagttagaccggtgtttgaaatgaattccgttatgccaaaatctttgctggtcactaacggctcaacctcttggtttggttgttctccaagctgagggattggtttggacttcttgtgataggctttctgaagtgttcggtcatagtccgatatctgtgaggcctccttgtttgttgtggacattcccttaaagaagttcttcatgctcgggtcaataggtatcttcttttcaggactccgaggcttgagttgcctcttcacttctcctgccacataagcatcaagctcctcttgactgcaatcgtactgcggctccttgttattggtggcgtcaactttcgctttcttcgttgcccttgtgcgggcaggcggtggagcttggcgagaccttgtcttgggaggtgcaggcggacacggtggaggtggagaaggcgaagtaggcaggaaggcggaggagccggaggagatggtgcaggaggaggtggcggaggagccggagcagatggtgcaggaggacgtggcggaggaaccggaggagatggtgcaggaggagatggcggagccggaggagatggtgcacgagacgccgcttgtcgcccaggcaggatgatgtaccgcttgtcgcgatagtataatggcatggcttgtgtctcgtagatgcgtctcactgtctcctcctgggtagtccaactcgaggtcctcgtacgcggcttccaccagttcaacttcgaccctcgagtatcctgctggaatcggcctgcagtggtaagtcccggaagggtccgttgggatggccattcccgacgccaccttcacgtgatgagaggttatctattagtaatcaacctaagtagcaacttgcggaatgtacaagtcaaaaatcatcaaactacgagcataccttgattgataagttcttgaagggaatatgcagctcacatggtgtccgctgcgtgatctcatcaacggggcaggtggttttgtcctgggtttgcatggcgtccatgctctgtgatcctacctgccctgttgaggcgcagctgctacgattgcctgatgggctgaccattgcaggaggaatgtacggctggggatcctgggaccgatgtgtggccatacgttcatccaccttccttgccacctcctcttgcatgctgagctcgtagctcgataccctatactcaagatctacaatcttcgcctcagtatctctcttgctcctcatccgactcctgtacgtgtggatgtcctccttgaatccaatcttccagggaatcacgcctttccctcgtgttcatcctggatgctcgggagtctgtagggcgagtaacagctcgtccttctctctgtcgggtcggaatgtgccctgagaagaggcttccgctgcgttcgttagtcgactggcagcctcgcgtatctgatcgctgaagacaagggagccatcaactgggttaagcgttccaccgtgagcatagtaccagaacttcgatcgatccagccatttagcggtggccggttcgatacccctctcaatcaatcttgcctccatctcctcccacttcggcattgcgacgctatatccgcctgaccccaagtggtgatggtacttcttgttggcggcattttctttgtttcgggccatcatcgcttgtccttgttgccctgtcttgtaagcaacgaactcgtcccaatgatcccttagctttgggaatacgtcgaagttcggtgttagtcccttcaggatgtatttgttgttgagatctcccttgaagctctggaactgttttgccattttcttcagagtccactgtttcactatgttctccgtacccacgggtagcgtgaacgtctcgagcattgtggtccacagaccacatgatctctttctctgattccgggacaaagctgtcattatccccgcgtgccattgtttgcgctagtacaccatgttgacagggacgttgtccctcacaacccaaccgctgtggcgtataaaattcttggctgcttctgccggggcactaggtcggccgtcttcgtccacctcagttatgatgtgccgattctctatcttcttcgcggcacctcgttgtccgcgtgccctcttctgtccagcggagggatgacttccactagcctcctcctcctcgttcccctccgcatccctctccacgttcccctcctcgttcaagtgctggtttggatcctcgttcccctcttcttcgttccagtactggctgcttccttctgcgattgtatcgtacagtatctgttcctcattgcgatcagccatctgtgcatacaaaaaatatttgttaagtctataggtcatatttgctaagcgtaatactaaaactctactaatcttatattaaatctctaataatcttatattaaaattgcagtaatcatatatgctaagtctaacaatcttataataaaactctaataatcttatattaaaattataataatcatatatgctaagtgtaacaatcttatattaaatcgctactaatcttatattaaaattgtaataatcatatatatatgctaagtctaacaatcttatattaaatctctactaatcttatattaaatctctactaatcttatattaaaattgtaataatcatatatgctaagtctaacaatcttatattcaaactctaataatcttatattaaaattttaataatcatatatgctaagtctaacaatcttatattaaatctctactaatcttatattaaatctctactaatcttatattaaaattgtaataatcatatatgctaagtctaacaatcttatattaaaactctaataatataatattcttatattaaaactctaataatctaataatcttatattaaaactctaataatcttatattaaatctctaacaatcacttctttacattattgcctgcacgaattccttcgatggctagctacaacttcggcttgagggacgacgacgacgtcttctctgcaacattaccaggaaaatgtattagtctaaatgggccaagttacatatattgtatttcacgttttaacctatatatataatcatatatgtatgctaagtttaataatcgtttaattatcttgttcgtacaagtttcgctcgcgttcgttctcacacttttagtacaagtgcattcacgcgtttcgttcacgtttgttcacgttcgttcgcattcgttaacgtttcgttcacgttcgttcgcgtttcgttcacgttcgttcgcgttcgttcgcgttcgttaagcgttcgttcacgttcgtccacgtttcgttcatgttcgttcgcgttcgttcacgtttcaatcacgttcgttcacgttcggcaaggtcggggcgcgcggcagtggcggcggcggagcggcggcgtggcggcgtggtgagctcaaggcgggggcggtggcgtggcagtggcgtcggcgtcgtcggcggtggtggccgcggcgaagtcggtcgtcggcggtggcggttgaccgtggcgtggcagtggcgtcagcaacgagctaggcggcggcggtttggagagagagagagatcgagatcgagagagagtgagagagagagagaggcagcggcgactctcacccaagagatgcggcggcggtgtctacggtggaggcggcaaggaccgccaagcgacggcgagagacgacggcggcgtcggcgcggggttgccctaggcagtggcggcgaaggagaagccgagatcgatctcgatggaaaaacgtctaagtgttggtggagaagacgagggcacaccgggaatatatatacccctagatctttagtcccggttggtgagaacatccgggggtacagatcattactccctgttcgtaacaacaaccggggctaaagaaaaatagcactgaattttgaatttcattacatatgtgtttcaaaaatagtaaataatgcattacaattatttaaagccgaaaaattaatgacaaaaccttcgaaaaattattgttacctgtagtaaactaagtggataatatataataagcacatgaatgatttaaaattgttaaaaattctaataatcatatataattagcatatgcatgatattaaattattagaaattctaattaacatatgtaaataccacatgcatgatttaaaattaataaaaattctaataatcatatataattagcatatcatgatattaaattgttaaaaattctaattaacatatgtaaataccacgtgcatgttttaaaacttttaaaaattctaataatcatatataactagcatatggatgatttcaatttgataaaaattctaataatcatacataattaaaatatgtcatacaacaattgatttgtttggatattcaatacatcaaaaatagtttacatcgtgtacacaacaattacggtaatacatcggcggtgacggttgaccgcacgtactttctcctcactattgttcctttcttgtgatcgctacgtgagtaaggagtgtcttcatttgataggagggtgctagggtcaatcgtcaccgtgaaagggggtttcccatcaaactgatcgtaatcctcgtcagtcttgtcctctactttgacgatttttctttttcctgggaaaaccacgtggcgcttcggctcatcaggccctttgcccttttttcctttgctagacatgtccttgacgtaaaaaacttgcgttacatcattggcaaggacaaaaggttcgtccgagtatcaaaccttgttaaggtcaaccgttgtcatcccactgtcatcgatcgttacacctccaccagtcaacctaacccattggcaccggaacagagggaccttgagaggttcatagtcaagttcccatatgtcctcgatggcaccgtaatacgtgctagttgtaccatcgtgtcccatggcatcgatacgaataacaatgttctggttcgtgctcttcatgtcttgggctctcgtgaagaatgtgtacccattgatttcatatccctggaatgtcgcgatcgagccagatggtcccctcaccaggaaggccagttgttggttaatcgtctcgttacccatgagatgttgtcgcagccactcggagaaagtatcaatgtgatgccgtgtaatccatgcatcggacttaccgatgtttctggcgcgaattagagccaagtgctcctcgatgtagggagccaccaatgaagattgttgcagaaccgtgaaatgggctttacggaataaattgttgtctaccgtcattattgctttccttccgagagtcccctttcgccgtaatctcccttcatggtgtgattcaagtaccccgattgggcgaaggtcttcgataaattctatgcaaaattcaatgacctcctctgttccaccccttggcgatgcttgcctctggacgagcacggttatgaacatacttcttcagaacgcccatgtacctctcgaaaggaaacatgttgtgtaggtacacagggccgagaataccgatctctttaacaaggtgacaaagcagatgtgtcattataaaaatgaaggtggaaatatcaactcaaagctgacaagacattgtaccacatcattctgaagggcttctaatctatccggattgatgaccttctgcgaaattgcgttcatgaaagcatatagctttcttattgttgcccagacattgtctgggaggataccccttattataactggtagcagctgtgtcatcaacatgtgacagtcatgagactttaggtttgtgaacttcttctccttcgtgcttattattcgctttatattcgtggagtattctgacggtatcttgatgctctccaagcattcaaacatactttccttctctgccttgctaagagtgtagctggctggaagtaatggcttcctttctcctttggttccgggtgaaggtcgccgcattgttccatatgcttcagatcattacgtgcttccagtgtatctttcgactttccatatacacctaggaagccaagaaggtttaggcaaaagttcttagtgaggtgcatcacgtcgattgcgtggcggacgtccaagaattcccaatagggtgtcacataccatgactttgggtgtttggaaaatatggaaatggtggaagaagtaaaataaataaaacttttgtttaaaacttatatgcttgcttgtttgtgcattttgtggtgtatgcatatgctttataggatcatgttcatatttaactaaaaccaatggatcaaagaaaaattcttggaacaactcaaaaatctgggaagaatttgtggtaacttcttgctgaccttagaaactaaatgtggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctggaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcgcggaagaaccgaggtaccccgcctcggattcgccgggaacggaggcgccatctccggcgccggcgagataagtcctcgactccgtcgcaatccggtgagcccatttccgttcaatatgcgttctgtaatcccctctcaatgccgtctctaacaccaccaagaacacctcatttggtgcagccaatctccgggaacgtgaccgcgtcaaatcggaacaccgtcgcgctctggacgccgctgcttcgcctttgctcgtcgcccggcttccatagttcgttacaggctgagccacttcgtcacgagcttcatcaacacctgtagatcaagaatcccgaaggaatcgacgcgaggtggaccacagtgggagatcctcttcttcttctccaatcccagccgccgacgccattcctttctttctccttctctggtgagcttcggcgcaatattttccgcctagagctaccttgtgctgatctaaacagaggcatgcttcctctctttgcagtagaagcctggggatacgccgtcgacgacgaccgtagcagccgcgccgtcgccgaaccagtacaccgtcgccaagacttcgctgagctgcgtttgcttcttggtgagcctcctagtagtccctagagtccttaccatacgcatgcacgattagatcgagcctcaaaactcacatgcatgtgcaagccgagcttagccgccgcttctaacaccctgacagccgctatagagcaccaaggcttgcaagaaaaacaccaataggttcgtacggttgttctctacactttttgttttgggagcttgagctgaatcgccgctgttcgccgctggtgatactgtgaagttcgtggctgtgctgctgctctgttctgtccagagcaagggcatggcttttgaaatttaaagactcccagggatgtattagcagcccgagcaatcacttacatatggggtcgtgcactaatctgtaaataacatagaactcaagtcccattttgaataaaatcctggaacacgtgctaggggctgcgggatctatttcctgagaacccaggagcttttgcgcaaaatgttagtctctgtctggtggacctgagaaaggaaaatgatgtatgaaaatttgagaaaatacaaaaactaatttcctatcaactgaaaaatgtcagaactttagaaagtggtagaaaattcatcctgactctaaaaattgcaaactaaattatgttggaatcatattttcatgctttgcatcataaaaatgtttgacttaacagaatcataaagatttatgtctcaataattcgaaatgcatttaggaccataattaacatgtaaacactttaaaaaaaaatctgtaactttgaatgtaaactgttagattgaagtttctttcactgaaaatcaaactaacacagagcacaccaactccataaaaaaaagcattcattttagagcatgttggatttttatgtatgtttaaattttaaatttttgcatatgtatgtttagacgattcgcagccgagtctcgaggaggcctactttgtagctgagcaaggagtggaagagcaaggcaagccacctcccttctttgatcacattgaacctatgatttggatgtttttgaaaagtttgcaaaatatgcatgtctattgtacactaatccattaaaatcttgtaaaatttgttagatcaactccttaacttgcattatcacctgaactccacaaaagaccttaaccattattccaaaaccttaggaacaatccattgtgtcacattaagaatgatgtttgagatagcaagtctataaaaatgctcagccatgcttagtgatgagtttacttaccatttgggctcaattacatatattaaatgatttattttatgatctggattaaaatgataaaatgtgatatttgttaaataaaatgttggaaaatgtggattttaggtttgggccgcatgtggtacacatattgtgtttagttgtgtactgatagggggagagtgtgcccaaaccgacctaaggacttcactcagcgtcaattcatttcgtatacagtacaaccacatgtgctagtatgggatagcccaagcttagtaaattatttatgatttagccttacattctggtaggccggtgtgtatgagttagtcgataattctgaggaattagtcgttgattcagaggaacttctatttaccccgacgtggtagtttaggtgactaagtctgtccaatacaacggtattgtgccacgtgggtgggttcccgttgcgtccgccaccacggcgttaagtttaaggcgtgggcccgccacttaacggttctaggtcatatatcgagtatggcttaggatggagtaacacgtatcgtgctggtgtaaggctaaatcatgaatcttggaagggctttgttgtgagtaataaatcgggtacttatgtatcgcgtgccatgcttttgcatgattattatttcgcatcatgtgggtaaagtgtacgtactctgcagagttaaaactaatcgattagccgtgctcacggtcaagagcggcgtgtgaatatgtcatgagtttagacatgtgttttattcttctaaagctgaatttgaacttcaaaatgtgatgtg

SEQ ID NO: 33198 - DNA, 4493 bp, Oryza sativa
ggttgcaggtgagatcactcctgtggaggatgatttcgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggatgaaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacagctttggtatcagagccaagaccgactgtaggaacccttttaagactgagcggtagtaaggcttcaaaagaaaatattttgagggtaatgtcctcactaaaatatatttgcaaaatctaatctattcttacttcttagccctgtttggataaattcctttcctatgaatcttgttttgattttaaaaccccatcttactctataggaccggaagatgcataaatagagaagtagtaactcatagagaagaataaggaatgaatgaaacaaattcgattcaagtcagtacttgaatgatttgaaaacttctcagtaaatagatgactaaatttttcccttctaaatttgaatttaaaattttaaaattttatcgatggcctagaaagtggtagtacggggtaggatggaattgatttgttttaaccatagtttgcttgtcatataaaggccaccagatgtttgtaaagcctctacattaagttcttagcatgtcccaaaattggtacgaattttacatgctcgcattttttttaaaaaaaaatatataattttttttaaactgcgcagattctagaactggtagcagtcgtccttctcattttttactcagagcagtatgctggacagaacctgacataataaccaaaacaccatttccaagttcctaaagagtttcaattgaaattctaattggtctatacttccaatatcttgtagatgtcttctatgtggcaaccatcgggctattctggaggttttgaggaagaatcactgcctcacatcctgtggcttatgctgcaacatctaggttatgatcatccaccggagtatcatttcttttctcatgagcggagttcatctctcgagcatatatggctgagctgtgtatacagggactttggacccatgaaccacccctttactttcaagcttgtggttgggatgcaccctcagcaatgcaggaagctgcattacaagcgattgtgtattaccgacattataggccagggttggacgggttctttcatttctttccagctcgcacaaaccaatcctccgctaattactatccaggtcttgagggaaacatgagagagattgacactccaggactattcttagctggcctggttcgtgctatggatagatatctcgcaaaaactataactgagttgcgtagattgcaagctagggtggtcatgcttgatagacgaatagaaccactcgggcatcaaggacattttgataatgccatcatttatgggaatcatgaactccagcctcttacagagactttgcctcctcccatgggtatttatcataatataaacactagggcccgcatgagagttggttttcatcgaaatcgtcgaaccatgccagaccctgcacttgctggagatccggtgctgctggggccattctatgagttcgagcggaatgggagacaataccgtttgactatggccactccgtcaaccacagtgcctcaacctcccatcggattctccgaagttccatagaatggtgtactggaaaaaaagaatatgtatggggtgtaactttcatttcttttctttaagatgtatgagatgacaccctaatatgtaatctttttaacggtcaaaattttgtaacaccaaggcatgaacttggtttcttatgaccattatccactcctatgtatctgtgatcacttagatcctttaaaactaatgtactggaatgaacttatgctccttttggaatggattgcttgctgtccagaaatttgtttcatgcaaatatatgatggatgacttgtaaattcggctataagaaatcattcctgtatgctacctatttagggtaatgtatatgccaattctatgctcaagcagctcatgtacttttgtactttgagtgcaggatgacacatactcgctctatggctgctcttactgatgatgccaatggtgagggagcgagtcagcctcgcactggcccatattcttctggacgtgccgggggtagtcgccgtgctgccactgcagaacagcatgatgatgaaccatctcttgctcaactcctggctaatcagaaccgactttttgaaaggatggtagcgaactctgaaaacatgggggctgccatggcacagcaggccaatcaagcaccctccaagctagcagatgttcaacgaacacatccacctcatttctcctctgcggctgatccactcgcagcagatgattggcttcgtgatattgaaatcaagctgaacctttgccggtgtgatcctgtagagaaggctacctttgctgcttactacctgcaaggtgcagcagctgcttggtgggagacatacaagactctcattcctcctgacgagccaatcacttggactgttttccgtgagggattcaggtctgctcacatccctgctggtctcatggaaatcaaaaagaaagaatttcttaacttgaagcaaggaaacatgcccttcatggagttcatggaacgcttcaattatctgggtagatatgccgcttctgacttgaacactgaaacaaagaaggttgagctatgcagagatcgtcttgcacctgaactcaagcatgctcttgctgctcatgaaatcaccagcatgaagacactggttgcccttcgtgttgaatcaagtgaaaaggaagtggttgaagaccgtaagcgtaagtgggctgcaaagaaatttgctggcagcagcagttccactcggcctcgtcttgctccatctcctgcggttcgtcctatggcacctcagccacctcggcagatgtatgtgcctccacgtccgcaaactcagttagttcgtcaagttcctcgcgcagttcaagctgcgggagatgcatctcgtaatgccaatgtcacctgctacaattgcggcaagaaggggcattattctcctagctgtccttatccgaagactggaacatccggaccgtactcgcagggagcaccgcagcagcctcgtggtcctcctcaagttcagcctggacagcgtggagctcctgctgttcccaagccagctccaacttttggaaggggccggctcaaccatgtcactgcagaagaagcaaccgacgcacctggtgtcgtacttggtacatttcttgtgcactccattcccttaacagttctttttgattccggtgcaactcattcattcatgtcaaccttgaaagcaaaacaacttgacttgaaaacagaatttcttagcgatgctatgcgcatccaatctcctggatccaccatggtcaccaaacttctatgcaaaggtgtagaacttataatagacggggtaaagtttaaagctaacctcatattattagacaccttgggcctagatgtcattcttgggatggattggttaactaaacatgagggaaccattgattgtgctcatagaactgtaactcttcgtagcaccgatggtcaatttgttaggtttacctttgaacaaacctccacttcaaatcaaccctctatacaatctctctctataccggagttaaaatcagtacccatcgtgaatgaatattccgatgtgtttcctgacgaattaccagggatgcctccagatcgtgacattgaatttgtgatagatttaatccctgggacagcacctatagccaaaaggccatatcgaatgacttctgaaaatttgatggaattaaagaagaaactcaatgagcaattggctaaaggtttcattcgtcctagttcatctccttggggctgtccagtgttgtttgtaccaaagaaagatggaaccatgcgaatgtgcgtggattatcgacctctgaatgaagtcaccatcaaaaataaatatcctcttcctaggatcgatgatttatttgatcagttaaccggagctcgtgtcttctcaaaaattgatcttagattgggatattttcagcttaaaatc

SEQ ID NO: 33199 - DNA, 2919 bp, Oryza sativa
atcttatattgggatattttcagcttaaaatcagaccggaggacattcctaaaaccgcattcacaactcgctacgggttatttgaatacaccgtagtctcttttggattaaccaatgctcctgcttctttcatgaatatgatgaataaaatcttcatggaatatcttgataaatttgtggtggtattcattgatgatatactcatctactccaagagtgaagaggaacatgcgcaacatttacgtatggtactcgataaactccgtgagcatcaactttatgccaaattctcaaaatgtgaattttggttaaaagaagttgaatttcttggtcatgtactttctgaaggtggtattgctgtgaatccaagaaatgtacagaacgtacttaattggaagcaaccacaaaatgttcctgaaattagaagttttcttggactagctggttactaccgtcgtttcattgaaaatttctccaaaattgctagacccttgactcaacttcttaaaaaagaaaataaattcatatggtctgaggcatgtgaaacaagttttcatgaacttaaaagaaggctcacaacagccccagtgctagtgatgcctgatgttcttaaaccttttcatgtttactgcgatgcctcacatcatggtctcggttgtgtactgatgcaagaaggaaaagtagtggcttatgcttctcgtcagttacgaccacacgagatcaattatccaactcatgacttacagctagcagctgtggtgcatgctctaaagatttggcgccattatttggtcagtaatcggtgcgaaatctttaccgatcataagagtttgaaatatttctttacccaaccagatctgaacctaaggcaaagaagatggttagaactcattaaagattatgatctcggtattcattatcatcccggtaaagcaaatgtagtagctgatactttaagccggaagctacatcaccttgccgttattgagacaataaatcagccatcgttgtcctctgaatttcagaaattgaatttgggattggtagaggatggttatgttgctgcactagcattacaacctactctctattctcaaattaaagctgctcagtccattgatgaggaagtagctgaaattatgaaagaaatcaattcaaagccacaatctatatacactcttaattctgatggtatggttatgcttggcaaacgaatctttgttcccaataatcaacaccttcgagaaaccattcttgatgaagcacatcaaacacctttgtctatccatccgggttgcactaagatgtaccaggatattcgcactcaatattggtggcctagcctgaggcgtgacatagcagcatatgttgcaatttgcgacgtgtgccaacgtgtcaaagctgaacatcaacgacccgctgggctactccaacctttgcaagtacctgaatggaaatttgatgaagttggaatggattttattaccggtcttcctaaaacacccaatggacatgattctatatgggttattatggatcgactgactaaagtggctcacttcattccggtgcatgtgacttatggtggagccaagctagcagagttatatttgactcatattgtaaggcttcatggcgtaccaaaagtcatagtatccgatcgaggaacacaatttacatccagattttggaaaaatttacatgaacttctcggaaccaaattgttcctcagcaccgcctttcatccacaaacaggaggtcaagtggaaagaacaaaccaaatacttgaagacatgctccgagcttgtgtgcttgaacataacactaactgggagaaatgtctatcttttgctgaattctcctacaacaatagctttcaatcaagtatccaaatgtcaccatttgaagctctttatgggagaaaatgtaggactcctctttattggtccgaagtaggagaaagacaattctttggacctgctatcattaatgaagctgaaaagaatgtcactcttattcgggaccgattaaaagaagctcaaactcgtcaaaagagctactctgatcgtcgtcgacgagagctaagttttgatgttggtgaccatgtctatcttaaagtatcacccatgagaggtactcaacgattccaaattcatggcaagcttgctccacgatatattgggccataccaaataatatctaagcgtggacaagtagcctatcaattggaattgccatttcagttgtctaatatacatgatgtattccatgtttctcaacttaagaaatgtcttcgaactccgattgagcacacctcacttgaagacattaatctaaagccaaatctctcctatcaagaatacccaattcgtattctcgaagaaagtgaacggcgtacccgcaaaagctccatcaagatacttcgagtacaatggagcaatcatactgcggatgaagccacatgggaacgagaggaccgacttaaggccgaattccctagtttcttctagaatgacgaatctcggggtcgagattcttttgtaaggggggtaggctgtcacataccatgactttgggtgtttggaaaacatggaaatggtggaagaagtaaaataaataaaacttttgtttaaaacttatatgcttgcttgtttgtgcattttgtggtgtatgcatatgctttataggatcatgttcatatttaactaaaaccaatggatcaaagaaaaattcttggaacaactcaaaaatctgggaagaatttgtggtaacttcttgctgaccttagaaactaaatgcggattttaatttagcttatcaaactcattagatcaaccaaacaactatctagacacttaagcacaggattttgacagattatttggagcactctttgacactctgccaaaattggatctt

SEQ ID NO: 33200 - DNA, 1092 bp, Oryza sativa
agttagttaagcttgcatgcctgcaggtcgactatattaaatccccatttattttatgatctggattaaaatgataaaatgtgatatttgttaaataaaatgttggaaaatgtggattttaggtttgggccgcatgtggtacacatattgtgtttagttgtgtactgatagggggagagtgtgcccaaaccgacctaaggacttcactcagcgtcaattcatttcgtatacagtacaaccacatgtgctagtatgggatagcccaagcttagtaaattatttatgatttagccttacattctggtaggccggtgtgtatgagttagtcgataattctgaggaattagtcgttgattcagaggaacttcctatttaccccgacgtggtagtttaggtgactaagtctgtccaatacaacggtattgtgccacgtgggtgggttcccgttgcgtccgccaccacggcgttaagtttaaggcgtgggcccgccacttaacggttctaggtcatatatcgagtatggcttaggatggagtaacacgtatcgtgctggtgtaaggctaaatcatgaatcttggaagggctttgttgtgagtaataaatcgggtacttatgtatcgcgtgccatgcttttgcatgattattatttcgcatcatgtgggtaaagtgtacgtactctgcagagttaaaactaatcgattagccgtgctcatggtcaagagcggcgtgtgaatatgtcatgagtttagacatgtgttttattcttctaaagctgaatttgaacttcaaaatgtgatgtgatttgtggtttatatccttgctgccatggaaggcaataaggagctatgttatatgtgtttatcatctaatttggtgcccaattgctaagtgtatgcttgctgaaatttatttgaaaataaatctgaaatttgaaatgctctttgcaaactaaatttgctttatgctaaaattatcccatgttagctttactttgaatttgccatgcatgtagaggactaggcttgcttggtgcttgccagtacaatttattgtactgactcttgcttgcattgttgtattgttgcatgttta

SEQ ID NO: 33201 - DNA, 17095 bp, Oryza sativa
  unsure (1)..(17095): unsure at all n locations
nnnnnnnnnnnnnnnnnnnnnnnnnnnnnnnnnnnnnnnnnnnnnnnnnnnnnnnnnnnncgttggggaagtttctttcttccaggatggttcttactagggtctatcctagtcggttgcatgaaagatcttttgggtagaagatgcttccgcgaacctatctattcagccaatcggccatgtgtatctaagttataagttgtatgatcctaactaaaacttagaacttagaactccctatgttgagatatcatgtgcttggatgaaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacatagggtaactcccaaaatatggagtttttttttccacatcgccgcgtaaccatcttcgctctctataggctggctgccaggcccctttccaaacactactttaagatctttcaccatagcaaacactgttttaccgcggcgatgttttggcttcgtacggtggtccacgtatgttcaaagtgcttgcctttcttccataccgggtggttcgctgcaaggaatcgacgatgacccatgtacacaaccttcctacagtgcttaagatacgtactttctgtttcatccatatagtgagtgcaagccttgtaccccttgttggacttcccggataggttgctaagtgcaggccaatcattgatggttacgaacagcagcgctcgtaggttaaactcctcctgtttgtcctcgtcccacacggggacaccttccttcttccacaacagtttaagatcttcgaccagtgatcttaggtacacatcgatgttgttaccaggttgcttggggccttgaataataatcggcatcattatatacttcctcttcatgcatagccaaggggggaggttgtagatacacatcgtaacgggccaagtgctatggccactgctcatctctctaaaaggattcatgtcatccgtacttaaaccaaactgtatgttacgtgcgtcctttccaaagtctttaaattttctgtcgatgtttcgccactgcgaaccatcggcggggtgcctcagcatcccgtcctgttgacgctcttcagcgtgccaacgcatcattctagcattccccttgttcctgaacaaacgccttagccgtggtattatagggaaataccacatcacctcgcaggaattctcttcttcgttagttgcccgtcaacttctcctgtatcatctcgtctaatcttgtattgttgtgctttacaaacagggcatgcttctaggttctcgtactcctcaccgcgatataggatacaatcattcggacatgcgtgaatgttctaaacttctagtactagagggcagactatcttcttagcctcgtacgttgtctcggacaatttgtttccctccggaagaacgttcttgacgagtttcaataaatcaccaattgccttgtcactaacaccattttttgccttccattgcaagaactccagagtggtatccaactttttgtgcccctgctcgcaacctgggtacaacgacgttctgtggtcctctaacatcttgttcaatttatgggcccccttttcactttcgcagtcctccttggcgtcctgcaacatctgaccaagatcatccgcaacgttgttaccatcagcatccctttcctcctcgcccgtttgatttccttcaaatctagcgtactgagcaaagtccggaatattgtcgtcttccacttcatcttcttccattttaaccctttgctctccgtgggatgtctaacagttatagcttggcatgaactccgatttaaacaagtggaaatgaatagtcctggatgcagaatactcctgattcttacacttattgcatggacaacaaataaaacccttatgcctgttagcttcggccactctcaaaaaataatgcacgccatcaataaactctttggaccgccggtcagcgtacatccattgccgatctatctacatgaaatgaaaaaaaatcgtacacaaataattattcgtacaaaaatgacagtcatacaataatgataaaataattacaaactctttcaagagtcatacaataatgacatatcattattcatacaaaaattataaaatattccaccaaataattcttatttactatttctaaagttttaaactaatattaatatgttgtacttcttttaattttcattttagtttgttttctattatttaagattaactttcactatattttccttctcaactattttataaaaccttctttagcaaataaactaaatttatatatattctttcttccccatatacattttctctctcatcaacttacaacaaaattttggagacaaaaaagtgtgcaaaacatagctccaaatgtaatatgacaaaaaaaaacattggaggatgaagttgctaaccttttaggcacctccgatttgtatataatcaccaaaataaattcactataaattttggcatgacctcccctcttttttgaagaaattttgaagcttgctcgggctggaggaggaagaagacatatataaagggatgggactttagtcccagttagtgttagcaaccggggctaaagatcgccgggatctttactcccggttggtaacaccaaccgggactaaagttacaatctttagtcctggttggtgttaaaacccgggactaaagatactgggggggcctgacaagccttaacagcatttgaaccgagactaaagatgatctttagtcccggttggtgttaccaaccgggactaaagatcaaatatgcccgttaccctttttaaccgggactaaagatcatctttagtcccggtttttgttgcaaccgggattattatggaattcggccgaccgacgaatgatggtttctccaccagatacatacattgtttttagtttttaggtctaaaatataaaggtttcaattgattagataataagaaatatcacaagagctgatacatttacaattaggagctgaaacacaacaagtatttagagcaaccttcattatgggtggtgtgacctatgtgtggcttgagcccacatagcacattaaggccactctaaagagtagcatctattgctcatgccctaagcaacctccaatattcatatgcatattataaagtgaagaaaacatcaaaggtcacacactacctggacctaaccaataggtcaaaaaaacgccaacaaacccgtgcaatgctcagctcttgttcgtttcctgatcacatatttttctgaaaacaatgcatgacacaaaatgctcagagacaagaggaatagaggagatcaaaccatacatataacaccaaatgcaaggtataaaagcaaagcaattgaggggaaaaaaataaaaaaaattccagattccattgattgatcgacagcacaagcttgtatacagcttgtaagcccaatcagggagcatatcgtttctcactgtctgaagcaagttccactatctcttaccatcgtacacaaaagctttctgcaagtgtccctaaagacagcgacaaacatgtactgcatatgggcctccaaagtgcacaaccacacagcaaatggcttcagaaaaagctgggtgaaaaaaaaggattaggtacattaattgttgatttaacctgtgcatttgcacaggaatatttcttgtgtgccctggacctctggcccgttcccggtgcaaaagaaaaatatttttttccaaggaatttattctttttgtgtctctatgtgtcaagaaatgaccatgcatgtatctgcgcatcggctttaggctacaatggaagataatttcacaatggaagataatagaggaatggaccatagaagataatttctccatgcacatgttggtaaaaatgcttatacatgtttagcgaggaaaatttctaaaagaactactacttctgttgcataagcattttgtacacaataagtattgatcagatccatcagtctgcgtggaaattcaccactttcatctttgacaaattttgcagcctttatactttggctcatcaccttcaagttttacgtatgtattcctgcattgaaatctaaagttagtcacctatcacaagtttttgttattttctcaaggtcaaaactaatctgatcggcagcttatattacccatcatcaatgcatcatgaccaacattggtctaagtccaaccctagaacccaaaaaatcccttttcaacctaggacaagatatcggcaacgaccattggagcctcctttcctgctacacatcaagtgtaagcagaagtgtgggaataagagagtggaggtagaggaaagggctggctacctagctagcatagaggggacaacatcaaacaagaggaatctgcaatgccatatcgttgtcgctgttgtttggcctacgcctcttggtgtcgccgacaacgcgatcggggagctagacgagagccccctggggatgtggaaggtgacatggaatatccctgcccatttggttctgcagaagtagtggtagtggtgttggtggtggagctgatcagctgatggggtgggggcagtgatgtctcccaccatagctgtgaaaggtgagcactagtaccactgcagatgaatctgcagcttgcatgatctgctggcttgaattaagcttcttctcttcccttgcatggggcagttcctggtatagggaatcaatcatagccactctttctttttggccatggttccatggtgataggatgccctgtccatgcatgcttgcttgatccttggaactgcatactagctggttgcaggaggcacatttgcaacttttgtgagaggtggtggtgtatgatcatgatcactttcctagtttcctatgagaggggagcttctttggcaagttaacatccttgacacttggaagagaacttgccttctgtggatggttgtttcattagctggaagtgtgtctatgtacctgtatatgacataaatacctaactttgatcaggcacattgtcaccagcacacatggtctacattagagttacctattaaggtggtgggttgggcctgagtcacttgaaatgctctgcagaagatattcttcctccctccatcccaaaatttaagacacaactaacactaacgcaaaaaccaaaaaagaattattatcaccacctcatttgtcacctcaacaaatacaatgtatgcacccaatgtgatttaagatcttgaggatggaggatttaaaaataaaataaactcaagggagagagtggtgctagttaattacatgtatgtatgcatgctcgccttgaattatgaaacattgaaaaaaaaaatagtaacgccatatattttggaatggaagaagtgtaaatttaggctaatgtggtacattgtttttttctccaattgtttcatatgaaactactacaaaatttatatcaagagccttagatttatgctcaacaagatgaaatcccaagcattgttgtgggagttttttaatgataataggagaaataacatataagatagctagatgacataactttttatattttatataattctcatcttttatctactattaaaccaaaaaaatataaacaattaagatggtgtggtctataacaatctaaattatatatagattaatcacttaaaagcaaaattaagataatgtggctcaattaatgagagaaggaaaagaaatgagataatatagattaatcatctaaagagaaaacttaggtgatatgacatcataagagaagaaaaaggaggaagataatttgaaccgtagatcaatcactccaaaggttagaaataattgaggtgatgtggcttaatgagaaaggagagaaatgtcattaattacactaagtgggatttgggtggcgttgctatgtgttatgcttatttagaaattcaaagttgtaattgttattttttaaaaaattaaattaatgttaaataaaatattttatctaattatgatgtctatctctatcccatatttttcagaatacatgtggttctcgtaggaatctgcactaacaatcataattttcacaagcggttttaatttataaggcactctcggtagtatcgcaagaagatccatgtgaaaattaatcactattgacatggcatacttgtcggtattaaatacacaatcatgtgctaagagtgggtatccttctatttttctctaggatgaaaacgtgttatttgaggatgttgatgccaagatggatggatctgaattgtgatccagaaaagtgtcactgccccattccccaaatttcttaactacaaataatctgctagcaaagacctcgtatactgacaaattatgtgtcgggaaaagctttattgagagataggatctgttaggatgacttcatacttacaaagatctttgcagactcataaatcgacgtcgtggatggtaccacatgcctacctaattaagagttctctaacatataaaatcaagagcaattttacggtcctggagtagataccataaggtaccactttttctattgtaaatttggtacctaggtaatacgaggtatcatgctaaattttatactaaatttttggtacctcatagtacctcctcaataaccgtaaaattgcttataaactcaagtgctaaatgcagtccaacctctaaattaacccttctagctacttgaagaccgggatcgagactatgagtataggtggggcaaccgcgaaaaagtaaatgaataataaggtcatccctttttgcattgattgtgaaatttccatgtagtaaaaaaaatgtgattgatacaaattaaaccagtcaacctcagtcgatgttgaagttgaaacttgaactctcaccactactactagcccacatggttgagtcatcactccgtgactggacgtgcacccagcagaacatagtaagatctcattggcctgcatctgaacgtgcatctcacattagatgaaagagaaccattttcaaatcaaggatgtaattgtcaacaaatagaacgtttctgcatgatgaatatcaatgcacatcatggttactagtgacattaagaagatgtatagttgccttgccggcaaggtatatgcattgatcatttcagttttcgcaattcttgtctcggatgcagcaagttcacacgaactattagcaagaatatatgcttgttcctgtggattattttgccaatcctctcctgtccaaatttgatggacccgaatatatagacgcaatttgcatccatgttcactagcttctctttatatggcctaaaagtaaatgctacttgtcgcaagttttttagtgttcaaatataataattatattgtaactaaactgtaactacatcgtaacttcacaaaataaagatagcgcaatccctttaggtttcacaaaataatgaccaaaatcatagtttttttttgcgaatggtatatgaaattcacaattaactgtagtacgtagcccactagcccatttagggccttgtcgtaacaaagatcttttttatggaaacacactatgaacacctccgaaaaactggaccggtatatcttgagactgacgaaattatcatgggcgtcttgctgacaatgggtacgtcgcctaccactgaaagaataattaaccataaatacgagcacccgtgttaaatataggatttgaactcgggtggactggttccaccacaagaaacctaactagttgagctacgctcactttgcaaaagaagatttggtgcaatacctaagctttatctagagttctcaatcattcatatatatggttagacaatctctggtgtatatcgtcccggaacaaccaaaccgatgataaacatgcaagatgcacatcgcctagtgtttttttcttaagaaacaggcgcccacaacgcatacacactcatctctatgaaagcacacacgcacacctaaacccttatgagtacctctgaaggactgggccggcatatcttgagattgacgaagtcaccatgcgtgcctcgttgtcgacagatacgtcgtctattactgaaagaatagttagccgtaaatgcgagcacatgtattaaatttaggatttaaattcgggtgggctagtttctccacaaagaacctaaacagttgagctacactcacttcgtgatgcattgcctggttttggttggaactgatcagagggaatataaaatattgcctaaaattattaagggaacccagtggtggcatatatgcaaggataaggacatcacctgtgtgtcaaaaggacaagagaatggagttaaaaaaaagataacgaaggatagactattgcaattttttctcttcattattggccccaattaatttggatggtaaataaaaggtcgataattacgtgagaagttcgatggtaaattatgatcgatgaacaactgagatgacacgtggtttgaccataagcccaaagttattacaggttgctggctgggctaccttgatttatgataaaatttgctacatagcatataaaatttatgtaattggttgaaggacacgcaaaatcgtgtcactgctaagggacaccataaaattgatgtaattggttgctggacactggaggtatcattttaggcaaattttgctacatgacacttcttatgtgtggttttagccctaggacactgcccaaactcatttttggaggaaaacacttcataaacatggtaatttaccagtggacaccgtgccgattaaaataataatttccggttggataggagagggaaatcgcgtgaaatatcaaaagttcccttgggcccacttgtcagcactccatctatcttccacacttttctttctcccttcttcttcttcctcccgccgagcagggtgaccgggtcatcctgcgtgacgcgatccttgcggcgcgccgggtggtgaaggcgaggacgggacggtcgtcggcgaggtggcggatgccgcagcgagggagacggggtgcttggcgagggcggatgccgcggcgagggagacggggtgcgtggcgagggcgaagggagatggggtacacggcgagggcgcagggagatggggtgcacggcgaggtgggagcttgcgtccacggcgtccacggagaagaaccagatggtgttcaccgactgctcaaccacctccgccgctgccgactgccctccgcacgcagcagcccgcggcgagggcggagggagacggggtgcgcggacatggggggtggccacggaggagggggaggacggagccactccaggacgcggcggcaggcaaggtgggagcttgcgtcgccatggggtgcgcgctgctctcgctagctgcccgctaccgcggctcctgccacgcgctcgctcgccgccactagctaccgcctacgctgcgctcgctcgcacgctgctagctgccgcctgccgcgcgctcactcgccactgttgccactccacttggccgacgctgccactccgccggacgccgtcctcgctatctccgccgcgaccgacgccgtcccgtgcgcctttgagatagatgaggagagagaatatagagagagatgagaagagagaaaggagatagagctgacatgtgggcccaagggcattattgacatttcacgtgatttctctcccctccccaactggaaagtattattttaatcggtgcggtgtctactaacaaattaccacgtttatgtagtgtttgcccccaaaagtgagtttggacagtgtcctaggactaaaaccacacataacaagtgtcctgtagcaaaatttcccatcattttattatatttgatgcaaatggagagagagagagaaatcgtgcaaagtacaaatgtaccctgcacgctgttcttcttcatgcttcagctcgatacagagcaacaaaaggagtgggtttgggggtcggggtaggggacaaaatggcagcatcagcgaggccgatgatcacgtggccggctggttggagtcgttggggtcggggagaggaagaagctactccggtggcggatttggtggtggaggaggtgcagattcacccccaaccgccgatcgtttcactgaattaggtcggggaagggggggttgctccccatcccatccacattgtttcacccataaatcccccgtgaatcacggctattgtgcgaattaattggttgttgtttggccgccggcgaaccaaccggccgagctcctccacggctcctcctctcccccgacggcttataaacagcgcccaggaccacctctccccctttacctcgctgctcggatgccatgccctccccaccgccgtcgtgcgctctgtcccaagcaccgccgccgctaggcgtcaactgggacctccccgagcaccggcaagaccaccgccgtctttgtgtccccgtccacgcctccgttgtgcctggtgagcatcggagctccatgtccaccccatcctgagcctgccacgctttcctcctcgtcaccatctcgccgttgccgcctccctatctcagtgcgctccggcgcttgcgccagcctccctgcgcagcgcgccgctgcgtcgtggccaggtgaagaaagagcaggtaggagcaaacttgtctattttaaatttctctctccacgcttttttcaaatattataaaataatgcttccggtgtcttatatccaattacaccatttttgtggtgtcccttagcagagccacgattttacggtatccttcaaccaattacacaaattttggatgtcctcgggtaaattttgccttgatttattggctataataagtgtgccataatcgtggttttgagatccagatatttgtttgtttagaaggcgcaatatgtgatctcgaccaatgttaggttggagagtccaaaagaaatggttacttggaaacattgatagtgaacattcaggacttgtattttgttttgatgcctttgtaacctagtttaaatgtcaagaaagcgcataaacttttcttttcttctgaacaatatattgagtgccttttgttgtgtacaatgaaaacggattgttctagagtgttgccgtggagaaagggatgagatgatgtggtatgcatgatttgatgagttaggaggtagtgcatccctatctgtccaagcaaaatgctcagcaagcagccaaatgatgtgtttgtgacctcttcaaaagtttgtggatgcagtggcacaggaaaagtggaggctacgatcgagtgctctagtttctagttagcacggtccatcataataaactaatttggcgcacataatggaatgtttcacgtcgtgattgtcgtgtgtgatatatatatagcggcccgtgataggaaaatgtgtatatttgattagcaaatttatttccgtggtgaactaaattatcttacattatgattctattgaaaaagatgcttttctgtatgttacagtacagtgcataaattttacaccatactcctatatatgtattaaaggcattttggtaaagcttcaactcctatcttcttaattctaccttgggttttaaaaatgtacgacgctggtgacttttcaacctcttttttaagataactttttttagaacattaagaaaactgttagaacattattacagcagggcatgcaaagcagtagtcactagcctcaacagagagaaatatagtggtactaattaaagaaacttccctaaaatctaagagaaaattatcattaatttttaagataatcataacatgaataagtatctatgttactccatactgatatgtagcaatattcgttaaccagtacactatgaaataagctgcttatcccttctatacaagaaacgttgttcccatactgtgacatgtcacaaacactaagtaaacaaacaatttaatatttttcatattttcactaatttttaaatatatgaatagttatatggcatgtctaaaagtcaataatatcatgcatttagaaatagagggagtataacaaagagtttgaaggctagaataaactgatttaaggctctaatttaataaataaaatgtgaacaaaatctcatgtctagcaaaccctatttttccagcagctgcagctcacataatttttttggagctagctagagatgcccagcttgaagaggttggaggagtcttatcaataggtcataatgtagacgtacaaagctagctagaatttgaagctggcatgaaaacatattagaaaaaatagctatagtgttttcctgtaacacctatcttaaataatgtgtgtttgcatagttctttatgtgttacttgattgtgttacaagataatgttctgtagcagtgtggtgcctaaagtggacctggcccctggcagtgataacatgcatatattaatttctcaacagtttagcttttcaaggttgaaaacctctgagtgcaggtatgcagcgcacaactttattaccatgatttaaaacatcgatacaatgccatcaagtactaaagattgtgccatcaatgacttgaaaactaatgccataaaaataagctagttgttatattttctatctatttcataaaagaaaagcctcttacctctaaaaatcccaacatttgtatgcaatgggggcgggccttttctagagtttgagcaaaacctattatgattggccactggtatgctcgctagtgccggtgagtctgtccatatttcggtgtcggtcaattaagtttagttttacaacttcaatcattttgttttcgatctcgatcagtttggttcagttttttggtgtccatcaatttagtttagttttacggcctcaatcattttgttttcgatctcgattagtttggttcagtttttctgtgtcggtcatttttacccatctctatgcccgggcacctgtccatggcggtccacccattgtttgtaggggcacacatgcacatgtgcatatatggatggttctgcgttcttaaatccaagttctcaaccttcgcacgcttctcaatttgctaaacggtgtgtgttttgtaaaaattttctatagaaatttgctttaaaaaatcatattaatccatttcttaaagttttcttaagctaataattaattaatcacatactaatctattgctccgttttccgtgtcggtggtgagggttcccaacccttacctaaaaacacagcttaagttgtgtttggggtcgaacatacactctcaaaaaatcatgtaatttttaattgaattttggctagttagtttttatccaatgggttacatagtcaagccatttgaaaatttatatagatacagagttgtacatatgcatgttttcttaatgcataatatatagatggaccaccaaaattaaccgtttaatttacaagatatagcaacataaagtgttattttattatgagatacatcctatattaaccaattaatttctacattaaagtaaatcagccaaccattctgaccaacactaccctcaacacaccacctttttcctgcagttttcttacaaactcatcatgctgctttatttttcagctatagggaggtgaggtccttcctaagttcctagctagtgacggcaataatacacaatcctccgccgagttgtgggggcaacaagatcctgctgcctctctctctctcatggtcatggtctgtgcagctacattgccaccattccttaacactacagagctcatgatttgagccaataagcaataagtagagaatcttttgttgtataggacatctgggagctggagaggcatttgagggagggaggaggatatctcttgattgtcatcttcccccctctttcttcccttcttataaccttcctcaactcatggaggcctaaccctcctctcattcttcttcaacacaaacaacctctttctttccactctctctctctctctctctctctctctctctctctctctctctctctctatctatctatcttgacaaaggaagagtttccaagaaccctgaatcgatcatctggagaaagattgctaaactctcagatagctgcatgtatgagagcttccttatcaaggtgatttctctctctctctctccctcttgaggctctgattactgactctgatcatcatttgcatggatccatgcatgatgatttcttcagaaattcattaaactgtataagcatatatgctgagcatcaagctttatattgcagttcattctttcgatgccttgtgtcacaagggaatttctcagttcttccatcctaatttctagtgaatcatatatgttttttttaaaaaaaaattgttgtggtttgttttatttttattggagcctttattgtgcatgggcacaatccaaggcacatgctgctttcttttggtcattttgagatatataaaaaaaatgatcaaggggatttgtacttcacacccatactgcaaaaagtgcaatcatgtttacttatatcactcacatctagtaactacctcctttcttgtgtttgtgtttttttgcatatatttcctttttcattcatggaaaacgtttttctctttgtacttctttgctcatcaacaattagctataaatacattgaataccagttgtactaattttgcaaggcaccagctgcaaacattaaatccctgtgttgcatggtccttttccatcatgcaattctcttccagggcaccaacccccactcttcattgaatctggcacatgctgtgcatttcatgctagctgcacttgatgcttcagtccacatcccacttagctagtgagtttcattcagaattatgggaaaccgaataagcgcgtcgcagtctgaaaactcgcaactactattcacatatggatttttgttttaaaagaaacagagccagagaagaattttgtccatcaatatcatcaattatatatcaaactcaatatatataggtgctgatcatggcaagcctgcatttgaacactgaggccagcctacataaatggacagagggatgaggccaagttggcaacatcttgtgcagaaaaaggagaacagcaaaaggagaggaagagcaagtaacaaagtcatgcctatatgatggggccttgtgctgctgctgctgcttgaggtgagcactgttccatctgaaagcagcacagagcattagtgcaatcaccactgtttgtttgttatcctaccttaccttttattttttggaggcacacacacacacctctctctctatgattctctccctctctctgaaaactgaagagtatgtttatgctacaagctggagtttggtgcatgatgaggatacaagggacatgagttgcatggaggccccatatgtcttccttaatgccttgatgctttgggcattcaagaaaaatgctaggcacacaagcacaaaactagcagaaaaatccacttcttttggattattcctacactagaaaagtttaaaaagttatcttggatttacttatttattctccgctcttccttggaaaattttgattaccttatcctggatttcttcattgcttccttaaaaaagatgcctctaatgaggcaagatccaactctactacattttctttgtcactaatgtggccagcaccctgtctttgtattggatgatgagtgtgtgtgtggtttgggcacaagtcacaccaacacacaccatcaacaaaaaggacctagctatgctaagctagagtgatcctaatcaaatcaacaggacccctaaaattccacccaagtgcttgtgctatgtgtgaccctaactgtgaagtcatgcttgcatataacaccaaggaaatgcatacaaaaaacacaccaataatatgtacacttttttcttatcagggatactctctgaaggtgaaaggccatagagagaaagagagagagagagagagagctagtatggggctcacagaaagttagtagctatgaacagtgaacacacacactcacaaaattgaaggtgtggtcctgaaagctcctctcttcccttggaggtttatatatatatatatattagcaaggctgattgtgccttttctctaaagagaagagaagggccacatcttattagtccccctcacatttgccattagcttaagcttcagctttttagctggcagatcttaaggcttcagaatttctctttaattcatcaaggtatggatccacttgagcatcatacattgcatttgttttgcctggatggagcttttcttgagttttaaatgttttaccaatctatcattgtttcgatggcatgcttttgcccctggttttgatgtttcttagaatcaagctcctgcaatttcatcagcactttctggtttttttgtcaaatacttgcttgttctgttcgagcaatggttctgaagaataaccagccaacagcttgctagcttggtgactgggattattgctggaaatactagataaaagatcaaaacagtttatctagttctgttctgggattattgatcgaccaagttattggaaatttatgccatgttatgaaattcttgatgaaatacccaacttggtgattttgctctgttttgctggaaattagacagaaccagcaaggtttttgtcagtttcagtttcagtaaagaaaaatgtcactgtttatgttcacctcagatgtagttcattgaacctgcagcaatattcagttatattgtttcttaagatagtgatgagttcagtcaattaaccagagcatcctttgcaggatatcaagaagttcttcaccatgaagtacatgaagcttgggac

SEQ ID NO: 33202 - DNA, 18314 bp, Oryza sativa
  unsure (1)..(18314): unsure at all n locations
nnnnnnnnnnnnnnnnnnnnnnnnnnnnnnnnnnnnnnnnnnnnnnnnnnnnnnnntattttcgtttgtcgtttcaatgaatatttgtaactattttgactttgttgcactacaggtctgtactgtcagacgtacctgctgatctcatcatacatgtcaacaacacaaagtatcagctacataaggtgctggttttgttcattgatgcaaaattatctttattaccacttttgaaccatttcctatattcctcgcagtgctgatgaaatttcctatccttaacttttaatgatataagatatacatattgatcacagacttttcttctagaaaacagtatttgaattcaatagtcaatcaaaaataccttggccacctaatccaatctgaggagcatctcccctgaaaagattttgttccatactgaaagccaaagttgattgaaaagatactcttggccatcaactccatttgcacccttatcaaggtattcaaatctgatagccacaccacctttgcgaatcactgatttattaagcattgggcatacatatgaaacatagaatatgataggaggcgctgaatcagatccatctttctctgatagtttaacatgtcacatgttccccaatgctacattacattgtttaagcaatgtcacaggcctaatgatgatgtgaagttgtgaactaaggcaactttaccaagtcgcggctcgcaatgattagcacacatcaaagcctaatgatggcctcaaaccaactctatctttgtttagtcatcctttctgaaatgacgaaccgacattggtttaggttcataggcctgaagatctgctttgccaagattgtcatggtataagcatcaaatgaggcattaaaaattacttgctatgcccttttctgatccacgcctcaaaagcttcttctgaacttcacaaaatcccggttaggaaagttgcgggaatagaatgcaaagttctctttaagttcagtcccgtgaatgccactgatggaaatagtttaatggaaaagatctaaagtgaacaagtggtaaaattgaagttcttttaaataaaactgaagattaagctgttatttaagatttttgcagtttggactatgctcctccttcagatcctctcatgattcatgattttgaaaagattataggacaaatgtacaaaactggcttcctgatttatttttccatgaccaagcttctgattcaattatgtgcattttgacattaaagaaaacaaaactgggagaaactattttgcatggacacaagtgttacagcatttatgctttcataaaaaggatgttgcttttaggttggaaaatgaagacaatctgtgattaagttgctcggaatgcagagtaaatctgaattgttgtactttcttttctcaaaattacttgcagctaaaattctgttcccactctgaaaatgctgatacagaaggcactggttgccatccgtattatcaagtatgcaagcaattttttagagaagagaacaatcaaaagttaaagtgctcttgctaatttcatttcctatttgcatcaatttctggttaaaacctagaacaattccctgtaagcaatttcagtaccataacagaagttcagacttcagagtaaactgaagttaaaagcaaataatcatagtttaaggacataaatctggtagcaattagactatcaaagcctttatcatagcaaaactgcatctgtattgcctacagttcagactgaatattgttttgctgccaattcaaaatatacacatgtcccaaaaaatatcacaaacttacaacaaaggttttagcacataactagaggattccatttgaaggaaatgaagaacagaaatacaaacaaataggccagaaaattaaaatttggtgagtatttatcttttctgttttccaatgtccaacctgttgattgatttcaggtgtttttaccctgtagttccccctcctcctcaagtgcggcctcctgcagcgcctctgctccgatgacgacggcgtcgacggcgtcgatgcggcgccggtgccggtggcgctgcacgacatccccggcggcgaggaggcgttcgagctgtgcgccaagttctgctacggcatctccatcaacatcggcgcgggaaacttcgtggcggcggcgctggcggcgagattcctccggatgacggaggcggtggccaaggggaacctcgtcgccaagctcgactccttcttcgactcgtgcatcctccagggctggaaggaccccatcgccgccctcacggccgcgtggcggatctccggctggtccgagagccgcatcgtccagccctgcgtcgacgccatcgtcgagaagatcctcacgcccccctccaaggtagatgctttgtccttcgcgccaaattttgattttgaaagccatttgaagttttttttttcccgtttctttcttgattttggcgcggaaacggttgatgaccgcagattatagatgaatacaagtgaaatttacacaaattttgccaaaaattaaaattcatttggctttttaaacaccatgaaattttaaaataaaacgttgtcatacattttaaaacctaaaaccatgtaaccatcaagccggttttgtgcattgtagagaaagtagtgatgtggcaatggcgacaaattcactacaccaaccactttctagtaatatgtttctatattgtaccaatcacgctcatataaataaggatatagtataattatgattaggaaataaaacattagattcgatagttatgtacgctgcgcgctaaggtagaagtaaataaggatatagtataagtatgattaggaaataaaacattagattcgatagttatgtacgctgcgcgctaaggtagaagtaaataaggatatagtataagtatgattaggaaataaaacattagattcgatagttatgtacgctgcgcgctaagatagaagacaggaggaggatgattccacttttatatagtaataacagagaaaagtataaataacagtttattagatcgtttttaaatacaaatcgagcctgacctaattcgtagcagccgaacccagttttatttcttttgagatatgaaccgaatttagctcgtatttgacgaaatttctgtgaaaaattcataaatgagcgtaaatatttgtgcaggttacgtggtcgtacacctacacgaggcctgggtacgcaaagaaggcccaccagtcagtgcccaaggactggtggacggaggacgtgtcggagctggacatcgacgtcttccgctccctcctctccaccgtgtgcgccgcccgcctcctcccgccgccgttcatcggcgaggccctccacgtctacgcctgcaagcacctgcctgacccgctcaaccacgccgccgccgccgccaccgccaacggccagagctctgagctggagacggcggcggcgaagcagcgtcgcgtgctggagaccatgtcaccatgatccccggcgacgccggcgcggtcaccggccgcttcctgctccggctgctccgcgtggcgagctacgtcggcgcgtcgccgtcgacgcgcgcgcagctggtccggcaggccggggcgcagctcgacgaggcgagggcggtggacctgctcgtcccgatgccgtcgtcgtcggaccccccggcgtacgacgtcggcgccgcggaggccgtgctcgagcacttcctggcgctgttccagcggccggcgccgcccgacgagcggcggcggatgagcgccgccatggagaaggtggccaggacgttcgacgagtacctccgcgccgtcgcgctccacgccgacttccccgtcggcaagttcgtcgacctcgccgagtgcttgccggacatcgcccgcaacgaccacgacggcctctaccacgccattgacacctatctcaaggtcacagaatcaatcacaccgtcaaaataccagctaaattaattgatcattcgagctgataagatcaacaatggcgtatgcaggagcacccggagctgagcaaggcggacaagaagcggctatgccggatgatcgactgccggaagctgtcgccggacgtgcgggcgcaggcgatctccaacgaccggatgccgctgcgcaccatcgtgcagctgctcttcgtcgagcaggagagggccatgggcggcggcggcgcaagcggcagcaacagcgccgtcgcgcccgacgccatcgcaatgctcgccgcaagaaaggagaaggaggacgagccgccggcgccggccgctgaccacaagtcggacgtgcaccggccacgcggcgaccacggcgaacgcgcccgggcggacggcgcggcgatgacgaggtcgctctcggcgtccaccaccaagacggccggcgctgccgcgccgaggacggcggagagtagggggagcaggatgaggaacaagtaaatcaatggtggtcgcccatgaatggatgacattcttgtttcttctgatcccttgcttgaaatttgttgatacttgtgattcttgatttttttttcttttggtattctttttctattttcttcttcattttgatttcagtgcatcccatttttggtgggagatgtgagggccatattgttgaaagagggaagagaatgaggggtagattttgtaattaaatggatgggggataataagaggctataatcatacgacctagcatagctcaccaatcaagaaaaatgtccatcttcatcattcattccacatatgtatctactgttaccttcatccaaatattcccttgtgctctttggacttagaggataatatatctcttaatatgttttcaaaaaaaattaaagattgtgatataattattcagcaaatgaacttaagattatcatatttatattcatagtagataatgtttatagtgaaaaatcaaagattcaatacattggttcgtcccagattcaatacttcaaagagtggattttaaacttttgaggggacgtaagctcattatttatatgccactcaaaaaattatgaatatatcacttcacaaaaatgcaagttcattctaaccaacaaacacgaaaatgcttcgtatctggcgtctggtccgacgccaaatatcggacgactcgtccttatccaaaagttactctgtaactacctcctcctcctccccccccccaccacacacacacacacactcctatctctcttctctttttttttccccttgcggcagaggcaaggtgctagacgaggctggcgacgggctggtcagcatcctgctcgtggcggcgctattcatcctgctcgtcgcggacggtgcggcggcgttgttcctgctctaccggccgcaggcgccagccatcgccatgatggccgtgcagctcccctccttcgcctcatgcaacggcaccgtctctgactttgccgtcacctcctccgctgcttcctcctcccctgtgcagaccatcactgtccccgcctccggtccgtccccagcggcagtgctgcagccggcccgtccctggcggcggtgggcgcggtggcgctgcagcaagaacagccgcagcagcagcagcagcaggtggcggcaccgccggtgatggaggtggactcgccggtgaccggagatgaagaagatggaggtgggtttgtttagttggagtttaggatattgcatcctactgttttagcttgttacactctgttgcattaaggtgtttcattttgttttgatttgatgtagcaatctattgtatgtgtttgttgcactctattttattcgtgtgtttcatccttgttttatcggatgttgcacatgatgtacgatgttttagcttgttgcactctgttgtattaaggtgtttcattttgttttgatttgatgttacattgcaatatattgtatatgtttgttgcactctattgtattcgtgtgtttcatccttgttttatcggatgttgcacatgatgtacgatgtgttttcttggatgttgcagaattgagtcttgatgatgcaagtagtgttttttcactgtttcatctgattgaaacatttttttaccaattggtgaatcatttctcatcgagtaatgaagcatctgtaacattttctagtgaaacattatttaatgagtgatgaaatatctgaaacatttttttatatatgatgaaacattgtccgatgtatagcaattgcaagttagaatttaacttctacaagtgaaaaaaataactatagctatttcattgcaacatgtagaagttaaatataaccttttatgtttttgagtgattaatcacatattaatctatcttattgatttttttaattttttaaataagatttttttaattttttaataactatttaaataacatgcaaacaacgagggaacgttctcttcagagcagtttccacatattgaactagagttcagaaaaaaaaaaggtgtatatgagaagtgagcagggagctcagtcaaagaaagtacaacaaaatgtagcacttgaaaatgccatatatatttcacacttttcccccctaaggaagtaaggaacccattgtcattcatgaaaaaaccactatatcatgtcggcattcaacaatgtacagttactggttccgtcttttcataacaatgggcttaaaattcccccaaatcaaccccacctatgatacaacatatccagatcatctgagtgactcatcaaatctccttcacaacagtgaaaagaaaaatataccctcattttcctcgcaaaactggccttaatgtcaagagcaatgctttgcagtttccaaccataaaccccaaaacacgatctgctattataaactaatgtatccaacttcatatctaaaatacacttctcatttgttagtccctatgaatgcttccgatgttttctagaaataacatcacctcttaccgtacttcttgtttcaataattctggaagcaaagcagatgaaaccgatgattgccaatgcatagagcgccctataaggagccagagccattgagctaacaaatgaataatatccagctacaaggtagagaaagcttagtccaacatctcgccctctccttccaggtagcttgaaagatatacagctcacatttggtggtgatccgaaaagtccatgcagaatagtgccaacacaaagtactgaatccacaaaccatggaaaattttgacccattccgattctctgcagaaaaataatatgatgcgatttaaatcgacattcaataagctgcacagcataatttgctgagctgcgcatcctatgaatgatttaatagaatgtaggaagaaccaaaggacagatcaacaaaaaatatactagttcagagataaacagttggcagggtttgatgccgcgatgttagagtacattgatttcattgggatatcctgtagcagctataatctgaaaaactatacactactcaatttatagcccataaatccaatcaaagcctgatcttaactacaggtgaaaagttgcacttagttaacgagcaatacaaatcgacatcatatttctaaccacacaatcttatttttaggacatttatgccatatcaaggccttccagttcctgacaaaatgaaatgattctaaatgcattgcatttctattccacaaaagtcaaaaacacattattctaaaatattcttaaatagatgagacaaatttcaccctccgtagtttattaaattttgtttgcatggctgaagtgccatgggagcagtgtagttgcttttctatagtaatgagtcaaaatatcactggctcatcaataatgttagtcctggaaatggtagaccaatactgtctactgtctatcttgccaaaacacatggacacaataagaccgtttcaatctagatagcctactcatgcatataggcaaactgatttgagaaagactggataatagctctagctctagctccatcgagatgaccgacaaaattagtatgaggaagcatattttacatatctcactccacattggcagggcaaaagttaataaaaactacgagtaactagaaattttccaaatgatattcaggtgtgtaagaacaaacctgtagccaagcaacaagagaaggtgcaaacattagagtggcaagaaggtgcaagatcatgatcccatgccgacagtcaaatacttccaattggcagtcagtaaaacttttaacagatgttgggctatcatccatcggcagaagttgctcgaggccatcttgtttattttcgggcagaataatattatcacccatggatttatacaaatcctttttctgagtgatactgcgaaatgaagctgctaagaaactgacacaagatcaaaacattagtgtagtagttgaatgattgcaattatgtacaaaatagatgtacatgagcatccatttgtatattagagatactaccgagaaatgcaagaaattcctcctagaaaatgttcttgtaaacatgcaatttcaaaaggcacagggaaaacatatctatagaggattttagtaacaataacatgtgaaatatcagtaaaattaaattgtacctgcaaagggtggagtgtgcatggaaggcatgtgagagaagtaatacaccaagaccaattgctggatgaactaagcagacaagtggtattgtagcaaatgctacaattatacttggattgtttttaattatctgcacaatcttttccaagggcacatcagcatagtctgaatatgatacaagaaaactaaaccatgtatgaaggtcttgatataatctttactttcagaagcaatttacctttagcgactgaaatggtaatgagagagtgaggaagtggcgaacaatcattgattgagtaccatcctcccatgattgccagctgtagatcatacaaaataacaacagaaaaataatatttggtcagtttaaccacagattagtttcacaactatatacactttttttaatttgacactagagtatcacttatgaagaattaataaagcaaaacatggattccacaaaaatgtttctaaagttcgtttcatgaaaaccatcttttttaaagattacaaccatggaaaagaaaggataaattggttctaaataagcatgcgttccctcaatttcactacgaactacatgcaaaagtctagtttttgtccctcgattactgccttagtctaattttcgtccctcgactacaataccggacaactcatgtccctcatctctcaaaaccagttatttccatcccttgcctccttagaaccctggttttgtccacgtggaaatattactaagcattactgaggtggaatcatgctgaatcagccaggcccattaagctctgcaccaagcccccccccccctctctctctcccttctctatcatgctgtccctcccctgttctagttctccaaactccccattttcaatcccgcatctagtgagctcccaccatccatggcaagctcctcgagctcaaggtcccctcgtttgaaggctgcgggcttctagtgtccctcacctgcgggcttttgcttgctagttaatgattccatacagagagggatttggtgctctttggattgattatgatttcccttttcacccttgaaatttaagcctggtcattgcaataaaaatgctggcatctgcattgcttgtgttctgctgtttcttgctaatttgttgattgtgttcctcccgagcaaaaaagaaaaagaaaaaaaataaaataaagaaaataaactgaagaactaagcttttgttctgcctccacgtccctgacttggtcgtgggcgtcagccacacattatttgggtaagatatgggcatcgtagtggggatttgatgcttgagctagggatttggagatctgaccagtggttgctaggttggggcaggagcaagagcgggagggagagagaactagaaaaagagtaagagagtggtcagtactgattgagcatgatttaatcccaatcatttgagtagcatgtccatgtggccaaaaccaggttcaaatgagatgaaggatggatatggaccggttttgagagatgagggacataagtcgtccggttccgtagttgagaagaaaattagaccatggcaatggttgagggaccaaaactagaccatttcctaactacattctcaatttcctcaactagtcaagtcacaaacaatttgaaatggcacttcacaagaaacaaagaagacaaacatagtgaaatagggaattttaaacaggcaatgatgatagacccatcagaagactaaatcctacttgaaatcatgcacatttcccaattggaccatacaatgcccctaattataaggcacactacaattcatttactttaacagaattaaagggcatgtactgaaaatattgcaatatttgcacacatgatttcagcaatggacttaatagtgtcaaaatacgcatcccacgacaatagacttttaggaaattattgtggaatggagaagtagaacctactcctttgcccaacaatcctaggaaattaaaatgttcatctttgtgttgttcataaatgttcttgtagttaattgaaaaggaaaatagtacaccaataagacaataatactaacagcaatactaatttaggacacatgaatcagcacactccacaacagtagtgtcaaaaggatgatgcggaggactgctatattgttacccgacaacaatcatcaaaataaaggtaatgtatttaagttagaagcaaggaactccaatgatcatcaaatgaaccatctccatcacaaagataaatagaattttaagattcctaggtatttcacagtaccagtcaaatcgtcagtgactgcatcctacacaaaaaaacattactcaataaaaaagggtacttagtgtactaaccgcctcttgatgaagacatgaagaatagcagcgacataaagaatcaattttgaacttagtatcaataaaattgtgaagccattagcaactatgtagcacatcatggtaactagcaggaaggttccaagtggaggattttgctctctggtgaaaacaagaaaggcaagaaaaagaagaactggtatgaagcaaaggaacatgaatgctctaggcagcctcagattagactctatagctgacaaaacagacggcacagaagaatcatgttcccatgctgatgattgccgcatcaggccgaaaaacattacagcaatcatgaaaccaagaatctgcaaaatgtaaaaaatgaaacagttcgataagttatctggccaagcaattcatgtaaataagcaggcatccgggtgaccatgacatcctctgaatatgaatcaaattcagcaatagggacagtgccataattatgcatatatgcgcaaaaagattacctgtgatgagtacagcaaaaagaatctgcttgctgcagcactaagtgaaacacgaagactcacttcatatgagcaatgtggatcagcctacaataataggaagccacctaatgtagtaagtacacaagttgagaaagtattctttagttaacagcagatagaaataatttgatggatagctcagtgacacttgaaaaatggataatgtgcaaatggacaccctaaactttttgaattccgaattttggagagaagattttgtatgtcagtagtatgctcacggctggtggacttagtggcattgccaaaaatacaggcctagtagctggcaacactcaatggttcagacgtgcagcactgcaagcatgaaacatgaaggctggtagcttagcaactaggggactagacagtagagattgataaccagagtgagactgctcagcaactcaagcagaacaacttgttagcacatgtgggagcaggagcagcatatgcttctgggaggtggcaatggcaggtggtacatccatgcatggcaggtaataaagtcacaataagctgagattaaagcagtatgcaaaaatcttacaaaaaaatttaagctggcataataaatggctgatcccttgcatgctaaaaactttaaggtgttccatgatttatgttttgcagtctccctaatcactactgagctttacattcatgtcaaaaactcaatatcgcagctgataaacttaccaggacaagcacagtagatctttcagtcccttgatgtgaatcccaaagggcaggtgaagaatcaaccactagagtctcagagtaaatatttggaataatgtgcagacctgatacagggtcccaagccaaagcaacaggtgggaagcaccgcagtttacaaagttctacaatgcataccaacataccaaaaattataatctattaacagcgctgcatggttcctcaaactgtacgaattactagtagtctggtacaagaagtatgcaaattgatgtatggtaaagaccatatatcaggagtagaatgtacactgttattagttgttactaccaccaccatattaccatcaaaaggaaaacagtacaggcagtgttgctatcaagaatttcggtatatgcagagttaaagagaagaaacagctcactatttttctcagcttccaattggtcgccagtagcttttactccacatccagcagttctcaaagataatataactggtagaagaccaaggctcacagaaaacgacaagtttaaagccagtgggtggtcctccttcaaaaatatttcctaagataaaaaaaaattaagtttcaacacatccatatcatacagttacaaacatcattatccatattttggtaagcaagaattaattacttcaggaatatagctggagccaataattcgggcagcagaaagtgcactcgtcccttcctctggattaaagaactgtcctactgccatagatgccgctggaggtggtctacctgaaattgtctggatacagaagatcagaataacatcgacttttaacaattcagcagggaaggtaaacatttagaatatatttctattgataaaagtttatatccatgaaacaggacaaaatacttaacatccacaagatggatatcaatagagtttgcaaccgaatcgcagaaatgggcattaatgcattgatgtgacagtgttccaatgtactggtcacgtgcacagacagacagactagtcatgacaattatatatcaaagttagagaagacaatgaatccataactttccaaataatcatctttgattttattttttttatggcagtatggcttgtcatcgcagccagcaaaccttcaatgcgaatgtgaacaagtatgtggccaattcccatgcaaacacaaaatcctatatcctctttcaacattaaaggcctttttttcatattaaattgcacatttcttcttggtacttccatagccaacagatgaaagggacaacgtagatgactgaacaaaaaataaccaaaataatactacttttcactactcccaacattacataaatatgcccctctaatttcaaaatttgttaataacttcatattcgcctattctgttacaacagatggatcgacaacatgcaatacacatacatgttatcacacagaagaactttcacccttctaacatacatgaatatcgatagttttgacaaaacaattgtaattttttaaaatttattctaataagattgaattctatttgcgtgtgtagagaagtagaaagggatatgttacacaggaaacatggaaaaagatgtcttataggtgaaagctgcatatccagttagaaagatgttacatagggaacctttcaaaaatcatattgtgctaaactaaatgatgccaccaaaaagtacacagggagtcaatgattgatatgcaccatgaaaattaatcctaataatgaacagaaaatattatggtatttccaaaagcttatctaagtcacgcgcaagatgttcgccaacaaagcaacaaaccaatttgtcatatctaggatgaacatgaaacaggagttcctgaaattgttatcatttaaagtggactattgtataaataaggcctgactgcaactgatctcaccagatacatttctgagaaattaactgatgctgggcagggggggttttagtatcacaatagtacagcaatagccttatctttgttcacacttttatgtagccctgaactttttattattattattatcaaaagcaactagttttattataatagattatgatggaaggaattcaagatactgtcacctaaaggttgatgcgcatgaagaagcacaagaacacaataggggtttgtgcaaaaaattacaagaaaacaggaatggtacaagggaataccggtcgaggtgccactgagatagtcatgaagcggaaaccactcatttcttctggactaagcagaagaaatgcagtaggaggtggttgctcggtttgactcccaggttcaacctgttcaaaagcatagcatgtaattatcacaaccatgatggcaatgtgcaagatagcaatgaagcagagcaaatcaactgtagtaatggagttaagttatgctatgactcgtgttatactagcatcgtcaaaagctaaagaacaagaaaattaaaaaaaatcctcatgcaacagtttctggattaaatctacataaacatacaagtggcactgcgagcaccgataagacgaagggaaggaggaactgtaaagtgtgaacaacacaagagaattactgccatttgctatcatattgtcctaacataatttagggaaataagacagaaattgcagttaatagtttaagaagacaaaggtgttgggccatttattttaagcagaagaaacagagaaactagtgaacatgaatcagagagtaagaatgccagcaagcaggaaaacaagtggttcagaattataaatacctgttttggtgcaggtcctgcaggtatttggaccatctttgatgtaacttccactatctttttgctggcaggtactccattttgttcagatgaatgatccttttctggccacaaatgaatcctcaccccagaacatggagaaagattacttacaaaaacaaagtgccctttgccatttgatcccttgaacaagaaaaaataaagcagtcaggcagctgctccatctatacttctaataggatcaatataaacagaactatatataggcttccctaattaactcacaacaacatgcagcaaaataaaccactggttacaccagtaagccagtttcacctaccagttttttaatatctaaccatcttctcttgccatccattgctaaaacagtaactgaatttaactgaatatgcaggtccttttcaaggccatcacttgtccattgaagagatggagggcaagaaagtgaatccttttgctgcaagtctatgataaacatactatgttacattgagataacaagaaacacatgagtttttgacgccattaaatttgataatgccctacaactacctacatgggctaatgttatattaggttgaatcatgtacaaagattaaagaaacatactattctaatcatctatagttgttgaaggatatagaaactattagaaatgagtcaatcaatattggaccttggctatttaccatgcattactatgtactaagaagatctcttagattatggttctaatccagtgcttccattgattttttgaagaaaaaaatcgtttcatttagcctgtctgtactgctattatctgaggggtatgcaattgcttatttgttaagttgtgaagagaaaattagtttactaaattgtaaagagaacttggagaattgctaatttaatatgccatgttaataaatttgaattatctcaaaagcagagcagaattttgcaggtagaaaaattatttcacgagaaatgaaatatatgctttttcaatatattgaaaaggtggcaaggatattttttaaaaaaaaatcatattctattacttggaaacaaataattttaccaatgtttcccatacacaggtaagcttaccaactacaaaaaaggtgacacatctaacataatatatcattttctaagcaatcaatttgccattgtgcaaaggatgcaagaaacaaagaatgaaagaacgagccgtaccactagcttccttgttaccacttgcaatcagatttggaggcttaacacctgaaacaggagccacccaactcaaagactgcggaactgcactttggagcatttttgcaaatacaaaaagtcttttttgtgaactcaaaaatggctgtccattcaaaggatctaccatactaagaagtgtgtgtgcaacctgaacaaagttaaaatcaacataagtaaactgttgaaacatactgcacaacacaaagaataatttggcatgaatacacagttttgacctgtacaactaactgattgcaccagaggatagactgatgttccatggataaccaaacattcttcatgcttgagctccctaccataaaaccatgagtagaaggtacaattccatccagcaaagctaactttgacctaacctgaataagaatgaatggaaacttgaggttcaattggcctttaaggaacgaccatacctaatgttttgaagtaatcgctcaatattggaagtcaaggatccaaggatccaaaaactcgggcaacaatcattgagatattgaatcaaccatcataaatcaaatgaaattccattatctttaagtgctgtaggaaattccaaaatagaaaaatgaatggaacttcatctggaatacaatcattttaaaatggaatgaaataactttatacctccagagtggtagctaattgcaatactttaagagatacatgtcatctgttcttttagagatgtagcagctacatgacaaattacaggggactgaataaattttataatcttgatccagtatatgacacatggtctactttttttctaatggtctagtattttttttcctttccctctagctccgattggaatttccatcccagtgtgtggatggcatattggcaaacaaacagtcatagatgcaaattttcagagcatgcacatgaccagatctgcataggatttgtcatgtgaaatgaaaatttattatcaacagaaaagatacctgataatcatggatgcctccagctacagagacaacaacaacatttgagagttttgcactgctggtgcgtgataaccctgtcttgtatccatttctccattcttcattgacatgcaaaaaaaactgacccagagatggctgcagagcaatgggagggtacctggacaggcaatcattctacaaggtgaacaacatgcgaaacatctaatcaattgcaagaaaagagatgcagctacccaagtacccaacacatgcgcgcgtgcacccacccacccacacatgcacccacctgcgcacgcacgacaagcacacacacaaaccacgcacgcacgcgtgtacacacacacacacacagaggagagataggcagagagagagatagtactgatgtggactggagagtgtcagtatggtttccacagccgatttccttaagcctggatggacaagagctgctcgagccacaaaaccacccatggaatgtccaactaaaattacactggatggcaagttgtcagaggattgagcacgaccctttgatcgtgctaaatgagattctttgtattgatcaaggatctacaaagcataaccaagatacagattaacccgattcaaacaaatcatgatcaggtgtattcagtgaacctatatgaatacattaagcatttgtatgtatgggaagttgggaactaaacaggcttttgataatagcagcttttatatccaactgagcagaaaactttctttcttggtgggatgatagcaggagttcaaataaacacagttatgaacgaagggtcaattacagcctatgctaagttgttaccctgtgaatggcgtaaacaacatattcagtatgctcctcaagtatgcgtccatccattgcagagtgttctccttcaaggtcaacagcaaaccaatccaacatacggccatatcttgatgggattgaaaaaccctccagttcatttactgaaaatgcagtagatgcttcccgataaaaggtaggctcaagtggaccattttggtatgctcgaaaggattcagcagccagagatcggacctagatgcacaattacgatatgagaagcaatcatcatgtcatcagtaacactagtactcattcacaacaaa

SEQ ID NO: 33203 - DNA, 714 bp, Oryza sativa
  unsure (1)..(714): unsure at all n locations
nnnnnnnnnnnnnnnnnnnnnnnnnnnnnnnnnnnnnnnnnnnnnnnnnnnnnnnttacaactcaagcaattggttcactattgcaaacatatatttttgtttgcacaacaatacttcagtttgctggtaatgatatacatagactaactgagtagtgactacttttggtcattatttattgtatgaagtggaaaaccattgctctgagtatggtgaccttaaatttgtccatgctgttataaactgtgcaggggattgtagttcctttttcagaatatttgcgatggtaataataccacatggcaatactttccgatgatttattcaggagatcgggtgagatacatcggttctctacaagcctacaatcaacaggaattatccttgggggacaaaggtcggtgcatgtattaagcttggttttctaatgttatttgttgaattcttaaattcatgtacctcaatatgtgaagcagttctcatctctgtgttcacttaaaagttaaaagtacattttgtggtatgatagtaccaagggtgaggaattttgagagacaaattactactgtcatgccaatctggaaaacatttgcatcgcagtaagttatgtctggcatagacataagcttacttttaaaatattcaactgatgtcactgtttggaacgcatgagtctcttaagaataatcgaagaatttgtacacaccagacag

SEQ ID NO: 33204 - DNA, 1234 bp, Oryza sativa
agtcgaggggccgaagcagaactgccatgctgcaaactgaagcagaatcgtttgcagcgaggtggagcgcatcgaggaggacacgctgccgactctatcggactagatctgcataacgaagaagagtagatcaggcgatagggctagatctggggataccagcaatggaaatcttgtgaatttatctctagcttgttccaatctctgcatttgaatgactaattagagcgattttctagctattctatgccagtgtgactcgatttgtgtgtgtcgcaatgttggctgtttctgaaaagaagtctcggtctttgcctctgatgatgacatctggttggccatgaggcgtggtgtggttgagagtgtggaccgcaatggcaagccacgttcacatctcagacgcctccgtgtccattgcagtggtgggtggtgttgtggagcaaggggctcgacctcacacaatcgcaaaggatgcagagagtgcaaaggtaatacatgcggtgggtgcagagcaacatatgtagacctcggtggcatggcaggcagcggagcggtctcctctttccacctagactttgatgatcagcgcttcctattccacgacgagaaaggcagcaagaaaatgatatcaacgaccggaaaggggtgggacgagaagatggtgctcttgattggcacatgagccttggcggcggtgacctttggactagggtggtggcgtgtcaagtggacaacacgacgtggagtaagctagcaaccgaaggttgacagaaatcgttacagcaatggcgcggttcaaattttaaaaaatgttagtgatacatggcagtactccctccgtcccacaaaatcacgaatcctggagggggaggtttgtcccaaaaaaaccgatctgtgcacagaaaaagagattgtgggccatagtagatgggaaacgagccagccacctctctctctcctatcgttttgaccacagaaaccttatctcctcggcttttctcgtctcgttctctcctccctaaatcgcatcgctctctcttcccccaaatcacgcccagatgcgacctcctgcctccacgccttcctccccgcaaatccctcccctctccacgccgctcccctcacgccctccctgccttcctccccgcacatccctcctgctcaacgcggcggcggtggtcggcgggggaggcgacgagcggacgccggtgttcaagcgtacatgcggcctcgg

SEQ ID NO: 33205 - DNA, 1003 bp, Oryza sativa
ttcattgatggtagcaatcaaaagtaatgaagtcgcatagccatggaggcgaagaaaccagtcggcagcagacaagttagccaacagtgaagatgaaggcgtctagcaacatcgacaaaattgagcagccatggtggcgaaataatcagtcggtgacagatgaggcagccggtgaagaagatgaagatgcccattagtggcgacataataagccatccgtgaaggcgaagataccagtcggtggtgacgaaagcaagccgacggtgaagatatagacacgtatcaaaggcaatgacgaaatccatcaatcatgaagatgaagaaaatagttgacgacgacaaacgcaactgacatgatgaagatgacgatgtcggtgatctagccaatagcagtgtagcaaccaatgataatgacaaagacgctcatcagcatttgcatagtaggtcaaccgtgaaggtgaaataataagtcggcgaaaacataatcatccattagcaacagcggagatgtcagggccgatgaagcagaggtgctggtgatgatgtcagtgacaataatccatcaaattaatgttatagctgttgtagatgcttcacttggaggagagttgatgttgttgtccaactcgtccaaaccgaaatatttgaagttgttgaagtagaatgtctgctccgaatcaaagatgaagataatgactcctggagttgactcgttggttgattaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcattcgcataccgagatgtcgaggcttacacagacgttatggttggtgaagtagcataac

SEQ ID NO: 33206 - DNA, 3959 bp, Oryza sativa
  unsure (1)..(3959): unsure at all n locations
tatagcttcttgtcgtcgagtagtcattgcttgattgaagatatgtgttgaagatgtccaagtagaaatcctgaatattggagagcctcttgttgtagtaaaataacatggcatcgcataccgagatgtcgaggctcacaaagacgtcatggttggtgaagtagcaaaacttgcgaagtagcagcaatagagtttgccagtgccgaagataataaagatgaagtcgctctaccgtgatgacaaagttgcattgccgtgatgaagtgaacacgagtcggcggcaacagaagcaaactggtagtgaagacgcgcagttgtgaagataaaagcaccagtcggcgacggcataaccagtcggcgacggaagacgatgatgttcatcagtagtggtagctgtctaaaccagacgtagaggtgagggcactagtcagcagcagacgtagacagcttgcgttgaagatgatgatgcctattagcggtgacggtgatgtagccagctgtgaagaagatagcatcagttggcgtcataacaggccagccgtgcaggcagtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccagccgtgtaggcggaaacaccagtcggcggcggacgagacggccggtcggtgaagacgtagacgcccaacaacggtggtgtgaccaaacaaccgtataggcgaagacaccagtcggcgacgatgacggcaagccggtggtgatgttctgactgatccattcctggagcgtaagagataagcttaaagccatgaatcccttttgtgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaataaagtttcacggatcagaatttactactcaggtacttttgcaattattaagagcagaaaataaatttatctcatctctatgcttttgatttattccgaataatacttagcaccttgcgttactcggtccatccaacgagcccccgggtgataggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagaccccgactcactactcaatggaagaccaattggtgtagtgaggcagaggaaaaggaaaaatatcatataaagaataaaataaatgatgacttagctttgtaatattccccttggtgatggcagaggtggccaatgtgggaacaaagtcgtccaacaataacaatgaagacaccagtcggcggcgacgaaggcggtcgacggtgaaagcgaagatgcccactaatggcggcataataggccagccgtgtaggcggagataccaatcggcggcggcgaagacaagccggctgcgaagtcgtagacgcccagcaacggcagcataataggccaggctatgtaggcggagacaccagtcggcggcggcaaaggcgagccgtcggtgaaagcgtggacgcccatgaacggtggtgtgaccaaccaaccgtataggcgaggacaccagttggcggcgacggaggcaggccggtggtgaagtcgtatacgcccaacagcggcggcttaatagaccagccgtgcaggcgaaaacaccagtcggcggcgacgaaggccagctggtcggtgaagacgtgaacgcccatgaacggtggtgtgaccaaccaaccgtataggcgaggacaccagtcggcggcgacggaagcaggccggtggtgaagttgtagacacccaacagcggcggcataataggccagccgtgcaggcgaaaacaccactcggcaagagtagtgccgcggcgttacatgcaaacagcagaaaataccaagagagattaatctgacatttagagatcaatctaataaacaacaataagttgaaaaggaaaaaacccggtgaagtcggagattaaaaggaaaaaactcgccgagattgatctcttcgactgactccgagacggagaaaattggtcgtcggtgttgcaccgtgtcgctagggctaatcaagcaatcggcactgagatggtgaggcctcccggcggcagtagaagcagccagaagaatcggccagccggccaacgacgattatatgtaagtaaaaacccaaatcgatttgattagtaatacaaagcatatatacaatgtatgctgtataaatttgggtatgcatgcatgcttctgtagatggatggtgatggcgcagtcgtgacatcgtggccggaaaattaattgagtgcacatgcaaacgaataaatatcgatccatccaagcccaggatatgtttgatttgtccggcacaaatgcatgtttgcatcggccaggtcattattggcgatgacccagatcgcgtgattcgaaaccggccaggaggacgcgagcgccaagccccagcagggacgagatgtatgtgcggtttggtcgagatcatggcgatgtacagtacggtggccaatcccgtcgatcgtcctggcagcggatagctttccccgacgtgcggcggatagccaaatcgtcgagacatgaaaacaagaaaaataccagggcatcaatctgtgattagatttcaatctaaagacgatagattagaacgacaaacccgatatcttcctgtagattgatttgatcagaagatggcgtcgacggcagaggatctcacgctacataggcgaagacgaagccggcgactcctgaaaattgattccatcgtactttgacggaaaactcgacgcacccctacctggcgtgccaactgtcgaaacacgaattcggcaataataaaacggggtagcgcacgaaacctaaaagtggattgatgtggagacaaaggatttagacaggttcaggccctctcaatgagaggtaataccctactcctgtttggggatttggatccgccgggtgtattatatatctgacgatcatatgtgctcctgcccctagagggcctcctgcccaccttatataggatgggggacaggattacaagatagaaaccttaaccaatacggtatcggtttcttaaatatattctacaatattatcaaatcaggcttttaggccgctccataatataaaaggaaacgtaatacgaaaaaaaaaggttttnccaatgatctgttacatattccatagatataagctatcccctaagactagtcggataaccatgccgtgtgggtatagggtacccataatctccacagtagcccctaagaccttcacagtcgaaaagataatcttctctcaaaccagattactccaaagccgagtgcttcaatcatctttgccatggtctcccaactacttttaccaaatctgaagactggtttgggggaagggggggctgaaaaataattaaatataaacttaggtgcatcgactagatgcacctaataggtgtagcccccgaccatggggttaattgaataaaccaagcataagtcagggaataaataatccaaccaactgagtggtttttgataattatagtcaaccaagtgacttgataccaatacatagcatatacggtgtgaatccccgaataa

SEQ ID NO: 33207 - DNA, 8715 bp, Oryza sativa
cctaaatctactttacaatcttatcaaactaggactttaggccgttccacaatatacagggaaacgtaatacccaagtcatgatccgttacatattatatagatataagttatcccctatagctagtcggataaccatgccgtgtgggtatggggtacccataatctcgacaataccaaaagtgttacttcatattatcatgattttcatgcttgtttattacgttgtggcttagatgaatgcgaagaagctacagaattgaggtttttacgtgggcataacaaagaaattcaggacatgcttgcttgtgaaaaatatagatctctttctcatttgttacaacttgcttgcaatgctgaaagtaaaatagaggaggatatgaaaaagaagcacgctatgtctttgcctcctattactaaccatttgcaggaagtgcataatcatgaaaatgaggaaagagacatgaaagagccgctaatcccattgttcacactcgaattcgatgcaccttcatcatctaaagagatcatcgaaggtaaactaaatggtgctgaaattaatcaaggtgagtgtgttgttaatgaactaaatttgtccacttttcatgctatagtagagcaacccttagtggaacaaactgttgagattcctttgtcacaagttgatttgtttgttgttccttgtgataaagaagagttgtgtgataatacttcacttatatcaacgcctatttctaatgttggttctttacgtgatgattttaagcatgttattcacattgctaatgaagtagaggaacgtgaattgacatcttttttaaatactttgggctatgttcactttgatgatttttatgagcttgataatttgaaggagaaattatttgctaactatgatttgccatgtccaaccaatgttatatttcacatctttggcgaatataataatcttggaatatattttttgcatagggtttacatctgctcggatttataacttcctgtacatgtggataaaatatgcaagttagagagaaatgttattgctaaccaaattgtctctagtttgccttgttttgataggaagaaacaggttgttgtaaatggactacgtaaagagcaccatatagaaaaaccgagaacggtttttcgtgaagaaggggaggatgatgtgaccatggctaccacggatggaaccattgctcatatcatagatgaacaagaagatatcgagatcaagtcctacaagtgctggaatccgattcggccacctgctacactgctgacttcaaacggctaccgaatctgcatacgacctccgtttttggcccacgagtacttgatggaaagctctcggagtcctctttccaacggatctggcctcatcaccagactccatctcgtttggccgcaaacacaaaaacaaggtgttgtgttacctgtcatgggcatttgggcttgtaacttcgtttgggacaccggcccaagtggggcccatgtggggtgtgccccaaccaggtggagcatgaccctagagtccacttgttcgtcctcacacctttataaatagttacgtacccctttacagtttcttgggttttgatagattaaagtttagccattgctacttgcttgcagcgcgcgtgtcggctagaccgtccgtctgcttgttcttcggaaccccaacttatcatttgtattaaattcctatttgcaatatcagattgcttttatcttgttattgcttgtttcttttatttgcttgcagaagtagggtttatctacaccggcaagatcaataacccatggagaggtgtatcgatcgctaaggcgcaacacaacgtctcgtacggttgcagtcggatcgtcaacgtttctcccaaatcatagttatcaccaactcaccgaaaagtcaggccaaacaacagccttgagtgtcacgagtggaactcagggttcatcatatattctcttgtaaaataaattatgtcatgttgtttgaccttaaaactctccggttttaaaatttttgatgtcttagacaagttttagatcaaacttttatatctttgagtatcgataactttataaatattcagtttaagggcactagaacaacatatatatttgtcttgcaaaatactataataaagtaaaatgtatttatttattgtatatattataatagaaatacatagtgaaacacatattttataaagggaaaatcctgaattacacccttgagatattgggtcaatatgaattaccccctcaaactggaaaaccatatatctttcaccctcaactattagccagataaattacccccggactcaaaccggactggttgtggtcctatgtggcagaccagtcagcgatctttttttaatcaatgagccccacctatcaatctctcaccctctttcttccccctcacctctctatctctctctactctctctctctctctctcttccccctcaatcacctcaaggacagcagcggcatgcaactcggcgcgtccatggtcgcaggcatgtgacttgcgacttgttgggggcggcgaaagggattcccgcagccaccggcactcaggtcagctcgaggccacggagctcgggaggccagcagttgccgacgcgcagctcgtcgagggctgctcgtagccaccggcgctcgggttggtggagagggctgcaaagcgagccgaggacggcggtaggcagagctcggggcgatggagagggcgcccatagccgccatctctgctgccgccagcgcgcgtctcgcctacgccacaggtgtgcgggactcctccgggctctgacgcgagagagagagagggggtgagagggacatagagatatctgacagatgggcccatcttatttttaataaaagaattgctgactggactgccacgtaggatcaatacgcttgcaaagctgctcgggggatttatttttatccagtattgatagttgagggtgaaaaatatcttattttcgggtctagcgcggtaattcgtacttaccaaatagttcaaggatgtaattcggacttccctttaaaaattgtatcatggtataaaacgttaagaattatggaacaacaggagttacagatttgtacgattaggacctgtttgggaagcttaaaattctaagaactagctagttgatattcagcttttgagaatatggaaaagctgggtttctcagcttctagcttctagttcattttctagattctacaactatacagcttttcaaaatctagaccaaaaactgaactgttttgggagcttctgattctgggagaagttgtagcaggtagagcctcccccaattagacgctttagattgtcccagtagtgtaggattctgattctggaagaagttgtagcaggtagagcctcccccaattggacgctttagattgtcccagtagtctaggattcctagatctagctactggtatgtatggatcaaagcaaaatttgtttgttcatttttgctccgtaatgcgtggaccaatatttcctaagaaaatcacatgagcgactttaatttgtgatcacaaaatccttttaacgtacgtttgcattttagatttgaaccaaaaacttatcttagatgtgtagacgtcattaattgctgattacctgatcattttcgtatgctgaactagatgatactccgccgcgttgctgcggaacattgtaatagttaaataaactggtatagtaattatgagaaactgtaacaacttacatatgaaaagaaaagaaattattgtgccttaggagtactatgtttgtgatgattttcttatgtaaatccaacaaaaatggcaataaataagaggtggtatggttaggaccttccagatgtggtagtccaactgttgtgttagggacaggcagaacatgatggccctataagtttagtttagatagtaattagaaggagaaaccgaagaacctgttggtaggttgtttacgtttcatgagttaaaaatgagaagattaggaagattagcattggagttctgcttctgcaggctaaaaattttatgggagagaatgttgtttcgatgataaatatttggaatcaaacagcaactgaagtagtacatatggttcttttcttaacacttattggaagcatgaacgaaaataagtgtaaaagccggaaaatattgtcacctttgtgaatagtgtgcaattgtgcatccatgtgtaaatatgcaaaaaatgcatcttgaaaattgaacagttgctcagacctagtcaaatagcacacagacagaaaataaaaagctattaatttgtcatgtagcacaagtttgatagatgcacataaatacatattacgatagaaaaaaattgttgtgctgaatcatactatattttgcatcaaatattagtagcaacgtaggagtatacagactaaaacttataatcctgaggctttatgttgcaaaggaactattggtaaatatcccccaccctagaatgatgcatgaaaactgatttagggagagataacattgctcacatcatctgttaccttaatggcttaacgtggttccgtaggctacatcattggacaactcattcaaaagtcgtttgctgaagatcacctgatggctgatgctacctgtctacctcaaatgcagtatatgtgtaggcattttatcaatcagaggcacatattggttggagaaatttacctcggaacagattcactcgtttctgcagcagcgggagcaacggacggagagaaactcctcaattttgatcgatatatccagggactgaagatactccaggaaacaagaacacaaattgcctgtggcatccgtcactcagatcagagtcgacccaatagaaatacttacggcaagaaaagaacctcctgatttaagaaggctatagctgccgcattagatgcaggcattttcttggagtgaagacatggggcgacagtttgaagagagggaaacgaactggatgaaataattgatttggattggattgcatttacgagagacaatgtgggtggctgatggttgaatgccaggggatcgcggggctaggtgcatgggcgtatcgattgggcggggaaggcgaaccggccgacgctaggagggggagacgaagcggagcccatgcggcacggaggcggacaacatgctggcgccggtacgggggagcgcgttgagtgagatggagagaatgcaacggcgatgcacgcgatggggataggcgagcgccatgcgggagatggataggatgtggcggcgatagagatgtggtgggggcggcggagcaagatgcggaagagggtgccgatgcgggtgtgcgactaagcgagagagatgcgcggtggccggtggggtggcgatgtgatgcgggagagggagccgatgtgggtgcacgagagagatgcgatgggggtggcgatgcgcgagcactatgcgggagaaggaaccgacgcggatgcgggcgtgtggacggatcagcagagcgattagattggatcgaacggctaggaaaaaaagatgacgtggaagcacaggaaccagagaattactaatagtggggatgatttgtagaggtgtataggattactgtaccgtatcatttggaatagacagctcaatgtacagattaatcgtcatcactgggatttcactcgtatatgaaaatcagcataagttactccctcagttttttaatagatgacgatgttcacttctgaacacatttgaccattcgtcttattcaaaaattttatgcaaatatataagatataaatcatgcttaaaataaaacaactcacaacaaaataaattataattacgtaaatttttgaataagacaaatagtcaaacgtgtgataaaaatcaatggcatcatctattaaaaaacggagatagtatttatatactatagacacccatttgcattatcgatagcacccacacgttgtataacatatgtaccctggtggaataattagccgtaaaatacaagcacccatagtctaggatttgaactcgagtggtgatctggttccaccacaagaaaacctaaccagtttgtaaaatcaagagttataggtgtatatatttttaaagacactttaaatgttgcctaaaatatttttaatgtagagacactttagagatatttttattcatattttctcaaatttatcttgtaaatgcatgtttttttcaacactttaaaatttgactaatatgtaaaggcatattctcgaggtatttcaattcctgtagaggtactttttggaattttaatcgaccctaagtaactagatatgacataagagtggtatgattagagcaagaggcatcgagttcaaggatcaccaattgtatggaaagagatagtattttttttccttggtttgctatggttgtggctttttttaatgtcttagaaaatacctttaatgtattttttattgactattgcatctagaaaaaaaataaaaaaaacacgagtgatggagggcaatggaatggtaaaaatctaaacattctatataaaagagtaaattgcgctagcaagcaagttcaacaacatgcaaattactctttttggtataatgacttgggtagtccgtatggacctgtccaaaacaatctgtggagattatgggtaccctaacccatacggcatggttatccgactagttttaggggatagcttatatctatggaatatgtaacagatcataacttgggtattacgtttacttttatattatggagcggcctaaagtcttgatttgataatattgtaccgataccgtattggttaaggtttctatcttgtaatcctgctccccatcctatataaggtgggcaggaggccctctagggggcatgagacacaactagatcgtcagatctatactacacccggcggattcaaatccccaaacaggagtagggtattagggcctgaacctgtctaaatcctttgtctccgcatccatccacttctaggtctcgtgcgctacccccttttattattgccgaattcatgtttcgacagatgacgcgccaggtaggggtgcgtcgagtttccgtcggtaaagtgcgatggaatcaatcatcaacatgaccggatcgtacacgcgcgtcatccaccgtcgcagtgggctgcatcaccgccgcaaggaggacggagggcgcgtctcatcagagcgttgagcgcctgccagatcgagatatcgcgccgatcggtcgtgtgctgtttggacttccggatcggcgagcagctacacgtgacctgcagcaaccagccgccggcacatgatctccgtcgacgtcgcttggtctaattcaatccggccgaccacctcgatcaatctacatccatgcagctgtatagtccacgcgtcagatcgatccgcatgtgcatcacatgacgagggccaagcagggagcaagaatatggcatatgcatctaatcttctttctgctaattagattgattattaaatcagattgattgatggtctttttcttctttgctctttcttctggtgtatgcatgttgccggcgaccaaggtgttcaattaggcatggcataattaagccgtcgcaacgcatggcgaagccgtccactctctgagcgaattcgagtcgtgggctggacaggcatgcacgaaagttcacatgacaagatcgctggagatgtacaggatgtgtcgattcaaccgccatgcatggattaattaatccagccatacatgcattcaatcgctgagatttatacatttaatttgctgatattaatcagatttatttgatttgtttccatgtgaatcgcggagcttcaccaatggacgtcctgtggctaccacgggtcacacatgggaacagccggcctatggcttgtcaggagagaacacatgcagaacatgccgagctatggatcgcttgattagtcctagcgacacagtgcaagaccgacaaccaattttctccgtctcggagtcagtttgatcgaggagatcaatctcatttctgctgtctacatgtaataccgcggcactattgctaccgactggtgtcctcgcttatacggttggttggtcacactaccgtttatgagcgtccacgacttcaccgaccggctggacttcgccgccgccgactggtgtttccgcctgcacggctggcctattatgccaccgttgttgggcgtctacgacttcaccgccggcctgcctccgtcgccgccgactggtgtcctttcctatacggttggttggtcacaccaccgttcatgggcgtccacgactgcaccgaccggttggacttcgccaccgccgactggtggttccgcctgcacggctggcctattatgccaccgttgttgggcgtctacgacttcatcaccggcctgcctccgtcgccaccgactggtgtccttgcctatacgcctattatgccgccgttgttgggcgtctacgacttcaccgccggcctgcctccatcactgccgactagtgttttcgcctatacggttgacggactccgccgccgttgatgggcctcgtcatctacaccaccggcttccgactggtgtttccactgttattgatggacaactttgttcccacattggtcacctctgccatcatctaggggaatattacaaagctaagtcat

SEQ ID NO: 33208 - DNA, 11364 bp, Oryza sativa
atggacaactttgttcccacattggtcacctctgccatcatctaggggaatattacaaagctaagtcatcatttatttcattctttatatgatattttccttttcctttgcctcactacatcaactgattcaccgttgactagtgagtcgggggctacagatgttatcatattttttcaacaattttcataatatttatcttgattgcttgcgaaataatccgagtaacaataaagtgcctatcgagttatggagttctatcttcctatgcttttcgtttggtttgtcaatggatagttgcctttgggccgattcctagcacctgggggctcggtggatggaccgagtaacgcaaggtgctaagtattattcggaataaatcaaaagcacagagataagataaatttattttctgctcttaacaattgcaaaagtactcgagtagtaaattctgattcgtgaaactttgttccattaatgacgagctcatgtcactcatatgcatgtttgggaagtgcctaggccgactcccgatgcttgggggctatgactagtcggacagagtgtttaaacgtacggagtcatctgctcggggaaatcaaaattgacaagaggagaaatatatatttataaatattttaaaatacttgaatctttctcaagtactgtatttacatcagatactactcatcctatatgtttgttctgcaggatccagatccagatatgcataaaagggattaatggctttaagcttatctcttacgctctaggaatggatcagtcagaacatcaccaccggcttgctttcgcagccgccgactggtgtcaccgcctgcacggctggcctattatgccaccgttgttgggcgtcaacgtcttcaccgaccggccgcctcgtccacctccgactggtgtttccgcctgcacggctggcctattatgccaccgttgttgggcgtctacgccttcaccgaccggccgcctcgtccgccgccgactggtgtttccgcctgcacggctggcctattatgccgccgttgttgggcgtctacgtcttcaccgaccggccgcctcgtccgccgccgactggtgtttccgcttgcacggctggcctattatgccgccgttgttgggcgtctacgtcttcaccgaccggccgcctcgtccgccgctgactggtgtttccgccttgatagctggcttattatgctattactgatggacacctttgttttcaccgtctggtttttgccatcgccgactggtgtttctatcttcacgactatgcgtcttcgccaccggtttgcttccgctgcctccgactcgtgttcacttcatcacggcaatgcaactttttcatcatggtggagcgacttcatctttattatcttcggcaccggcaaactctattgctgctacttcgcaagttttgctacttcaccaaccacgacgtctttgtgaacctcgatatcttggcatgcgatgccgtgttattttactacaacaagtggctctccaatattcaggatttcttcttagacatcttcaacacatatcttcaatcaagcaatgactattcgacgacaagaagctacagttcttgactctatgttcagttgtttcccaactaatcaaagagtcgggggctacacaaatacaaggcttaaaatttgacaaattttatgtcaagctgaagaaatcaattaatcaaccaacgagtcaactccaggagtcattatcttcatctttgcttcggagcagacattctacttcaacaacttcaaatatttcggtttagacgagttggacaacagtatcaactctcctccaagtgaagcatctacaacagctataacattaatttgatggattattgtcactgacatcatcaccagcacctctgcttcatcggccctgacatctccgctgttgctaatggatgactatgtcttcgccgacttattatttcaccttcacggttgacctactacgcaaacgctgataagcgtctttgtcattattatcggctgctacaccgctattgactggatcgccgacatcgtcatcttcatcaacatcctgtcaagcctcttaagcatagcctacactgctgccgttgatgggcaacttcgtcatcatagccggctatctctgttgctgttaatcatcattaccgtcggatgcgtttgccgccgccgactattttcttcatcttcatgattggtggatttcgccatcactgttgatgcgcctctacatcttcatcacttttgattggtatcactatcttcactaccaccaatatttttgccacctctggtgggcaatattatttctatattggtcgtcttgtctctatgccaactacgtcagctaccatcaatggacaattgtgactacgtgcttaggggcttactagctcaaacacaagtatcataccttcaagttggattttgttttgatattattttctatgctcgaagactggaccaatcattactccccgtaagggttatcaaccgtatatttgcaccagtcaggattcaatttttgtatctattttggagtatcccataagggataatcactcagatcagaagctattcatatgagctacacttggtctatattacccggaagatttattactcgggagtatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttgttcaactttttaggagttggtacaatgcatcttaaaaggtgtcaaacagtaaagctttatatagctatcccgctgacttttttatataagtcaaggtgctgtttgggtttttaagcaattgattggatacaacatcattgctttttaccacgtaagtgtgcatttttattaaccaatattatagcttaggctgattatatatatcttggtcatttttcaggcggttggtaaatcctttatgagtttatttactcggatgttataccacatatgccatatatttccaggtgtggtgaaactatgtatcttttagggacttaagcacatctgttaaagcagtgtgcgcatggtgtatgcccaatactttggaaatttctttattcacaacatcaagctcttctttatagctgttttgctatgtgaattttcaaatatgttgtcaactttaggttgcacgcatcatattctgcaaagcagtcagtatatcacctggatcatattattcggggattcacaccgtatatgctatgtattggtatcaagtcacttggttgactataattatcaaaaaccactcagttggttggattatttattccctgacttatgcttggtttattcaattaaccccatggtcgggggctacacctattaggtgcatctagtcgatgcacctaagtttatatttaattatttttcagccctccacagtcttcagatttggtaaaagtagttgggagaccatggcaaagatgattgaagcactcggctttggagtaatctggtttgagagaagattatcttttcgactgtgaaggtcttaggggctactgtggagattatgggtaccctatacccacacggcatggttatccgactagtcttaggggatagcttatatctatggaatatgtaacagatcatgacttgggtattacgtttccttttatattatggagcggcctaaagtcctgatttgataatattgtagaatatatttaggaaaccgataccgtattggttaagatttctatcttgtaatcctgccccccatcctatataaggtgggcaggaggccctctagggggcatgagacacaactagatcgtcagatctatactacacccggcggattcaaatccccaaacaggagtagggtattacctctcatcgagagggcctgaacctgtctaaatcctttgtctccgcatccatccacttctaggtctcgtgcactaccccttttattattgctgaattcatgtttggacacaatccatacaagctaaaagttaatctaacgtgcctcaccctgacaacacctacatacattagcatttgttttgcaaaagaaaacacaaaaaataacaccagactctgagagtgctcaaggatgcatttttctagtaagttgcctaaaaacgatttgcaacataattattactccctccgttttataataaatgacgccattgacttttgaatacatgtttgatcattcgtcttattcaaaaattttacgcaaatatataagagataaatcatacttaaagtaatttaagtgataaaataacttaaaaaaataaattataattacataatttttctgaatgagatgaatggttaaatatgtgacaaaaagtcaacgacgttatcaattaaaacacaaaatctaaaccgagaagcctctcggtttaatcagctccaataaataaagaaactcatttgttctttccattggtattgggactcgggctcacaactatagtgacaatacaaatcaatcggtttttatctctattattataaaaattgaagatgtttttgctggtactttcatagatcattcgtgtttgagtcggttttaagcttcattcgcatttagaaatatatacccgcttttgactccgtttctaagttggtccgcttttgaaaatacaaaaacagtcatatagaaatctctttaaaaaaactcacatactcctaactgcagctcataattttctaagaaaatatatattcaagtgaattcccacagtgaatttcacttttaactaatatgtataaaaataacaaaattaaaatatgttttccagtcaacttaaaagaataaactgatttttttaatttttaattattcgtattttatttgttttcattggtttctataatgattccaagaaatccgatgatatcgcttgtgcggttattttggtctctgattaggccatacatgacgttttggattcgtattaagattttacgcttcgttacatgtagatgtaaatgtatgtttgcattcgatcacccagcgaatcaaagtaggattaactgtataataactaaaaatttaataaaaaataatattaataatggttagagttatatcatattataaaaataatttaggaatatcttcgcttgtagaaaaatatctttatgtattcatttatcatccatcatcagtccgaatgcggatcataaggatttctttttatcttggggtggattttgatatatgagaatctgaacaaattttaaatgaggaaagactggtcaaaaaagtaatttgaaaggtaaaaaagttggattcactttcaaatttctgaattgagtttgagaaaatttttggaaaatgtcaaagtacagatctaatgtttatcaaaattttagtttatcctgttgcaacgcacggacactttttccgagttatacaaaacgtaaagaactaattatggaattggaagggaggggataaggctaagctaatccttggggactttgcggtgaggatcgaatacaagctaggccagcacgcgtacacgcgcgccgccgaccgcggacgatggccacgcatcaccatggcgctaatccaccaccacctcgccgttccagtggctcccgctcctcctcctcggggtctcggtccggccaccgccgcccggcggctgacccttcaccgccgccgccgtaggagtggcgccgccgccggcaggatgacagtcacagcttcgtcgatggtggagccggcaagtggggaggagacggcggcgcgttcggcggcggacgtggtgagggcgttctacgacggcgtgaaccggcgggacctggcggcggtggagccgctcatcgcggaggggtgcgtctacgaggacctcgtcttccccaaccccttcgtcggccgcgccgagatactcggcttcttcgccggattcatgggctccgtcagctccgacctccgcttcgtcatcgacgacatctccgccggcgacgactcccgcgccgtcggcgtcacctggcacctcggtacacacatatctctacgtctagcgaattgagccattgataagatttgaggggatgaatggattcatctctccagtttttcttgctttcaaattcaatgcaaatggttattaaatatctttttaaaaaatatatacatattttacagtatagagagatatgccatctaacacttcaccaaaatttaatttcaaattcgagaaacacaatagtgagaaacaaaagaacagtaccactatcactagtgttcatctgttgaatttatttattttcataccttaatatatgagttaagttttgacctaagattttgtgaaattgtatatataatccatctgttttttatatatggtgtcattgactttttaatatacatttgaccatttatattacttaaaaaatttatgtaattatagtttattttgttgtgatttgatttatcattaatgttgatttaagcatgacttaaatttacatattaaaaatcatttaagcatgatttaatttgtcatgtcgcttagtgttcaaacgattatcaaaaaggtcaacaacgtcgtatattaaaaaccggaaatagtacattatatgaatgttgttaatttttttttttagaaatttttatgactatttacatggtgtttagataaatgagaggatcctcgaaggtttcaaatagttttcacattgataatggctagaattaagatgatcgatggaggcaatgtgaatttgcgattgtgtgcagattggaaggggcggccattcccattcagcaggggatgcagcttctaccgcctccagctggacgagaagcagcagcagctgcagatcgtgtatgggcgagactgcgtggagccagcagtgaagccaggggaatccgcgctgctcatcatcagggccgtcacttggatcttcgaacgctttccacgccttgcaaacatgctgtaactaactggcctttaattttgtatggtaactagtatttattttctcgttatgtgcactgtactttagcttataaaagaaattgaaagattgaagaatttggtgaacaattggctcaactgtaaatctaacaaacagcctcatcttttcgcttatgctacttattagcgaaaatttaaattttcaaccttaaattttaaactgattttagggttttttcatcgaagtttattttttagcctttgcttttagattgctaagaacacgtatataaaagttttatttacaaattacttttgtttgcaaaataccgtttcgaataagcgaaacaatagaactaaaagttgagcactttgagctagctgaaaattttcgagctcaaatagtcattatgatgcgtgttcaaggaacacaacctaaatgattatacagcttcatttcgggctgttcagctaattagcttgtattgctcacatgttctttgagctagttctaattagccacggctttgcgcaaatggggaattctcggttaaatcggcttattcgctgctttgcgctggaaggacgaagtgtgtgattggaaagatcatctggaagtcccgggcccctgcgagatgtaaattcttcatgtataccgcgatgcggggcgcctgtttgacggctgataacttgcagcggcggggttggcacctagccccggtttgtcacctttgctcccaagatagagagacatgcgcacacatcttcctcagctgtcgttacacgcagcaggtgtgtgcgactgtgcgtggccgccttggtctgtcctccactacaccgtcggctgatctttcctcctggtggcgctccgcgcggaaatcaatttctaaacaagaccgtaagactttcgatgctggagttatcttggtgacctgaaggaacgcaatgctagaattttcgacaacaaggccattccggcggcgcacttatgtgcagcaatggaagatgaatggaccacttggggtgcagcagggctgctgtgtccactgcaagccggaagcaacctgatggcgagagagcaacattaagccggtggtggtagctcgctgctctgtagtacagacgtgctttagtgtctggcaggcagcatcctctgtagcctgaatctgcagcttgcacctttgtaatttgtttcttgtgacttttttcccctatcttaataaacttcgactggcttccgccagcccggcgaattagccactgcactaaatatcgacttcaatttgctttgcaacgccattggaggaaacaaaaagatctctggaaagctcagtgtccttagaagacacaagcaccattactctcatctaatttagcaacatatccttacaaatacaagcaaaatgtcagaggagcaatgttattcaattgggaattcgtcagctccaaagcatcaatcgaaatgcagtggacaagagaacacactctctgttaatacatttgtacaatacactctgttagcacaacaaataacagaacatcaatgggcgagaagacgagaacacaccgcagcttcaacaaatcacaaaatgtccccaactgtctggtcttaaaaaaaatgtagaagagaaagatcaagaactccagaacattatttttttcattagcttcagttttctctatcatgtatacgtaatttagttctatccctctgcaacaagcatacatcaggttgtatacgttgatccttctttctcccttccacatacgtaaatacacactatatttttgtatttcttgaatatttgttcaatatcttaaatatcagagcttgcttcatcttgatattttcagaaaaccccaaaattgtccgtcatcatttatatcttaatatcagtaagtaggaaaactagtaatctgggtcatagcagaacatacgataaaaccagtaagttaaggatttacagtggcaggcaacaaattaagcagaacatagaccaatatcgcaaacgaagcaatgctatacgccacaatcaaattgaataatactactagataatatacatatatatctaagagtactccctttcagcatagaaaccaaccactagttaagtcatattcagcaagtgcgacacatacagatatagagggataacagaccaattcaccttcactgtgatagctccaggctcaacaactatttgttgactggcaaatccatggcggtttgctttgaaggaacagtagtgaccaacatcatttttagagcctttttcacataccttgaacttcaaatgcatccaggtatccgacgctactacgaccacataccttcttaagccacaaggctcgccaaccatgccatcaaagagttgaatttcttgtcgtaccttatcaataagaacaaacacactcagagataaattgaaaccccctaggcacttttgatatggaaacttctattgttgcctccactgcctggtaaaggtacgctaaagtgatgtcaactgcgccacaattgccactaacgcgacttgtcattggtctcattgctggtgttgttatctggctgtactctaatgctccatcaatcagttctagatcatcctcttctcgatctcctttttttatcctcatgtcaaactcagaacaacagaacaagacatcgaaatgcctcgcttagggccaatcatttcaatgcaagaaccctgtgaaattattataaattatcatttagtatattttcatattaaatttccaatattttaaactaatagcttggtttttataagaatgcaagggatatcaaataaatgatggcgtaaactacaggctctaaaaattgacaacttggtgttttgctatgacacataagttggttacacatgaaattcgaagtgttaattttagtatgttttgtgtgttattgtgtcatagttctcacattagatttattatgtcatggttcttacattagatcacgttggcaaccaggtctgggtatggggggcttcggtcagggaaagctacaccagtcttcaacatcatcactctactaggcgtggaaactagacctagggggatgtacaccagaggcaatggcggcgacaaaattggggatgggcagaagtggcctaggcaggcgtagggtagtggcaccggggccagtgcagaagtaactaacatcaatgcagagtggtgacgcagagcccatgaggaggaggccgaggaaggctccaggcagtggtaacgaaccaggtacagaggtggcaaaggcaggtggagctgcccagggcgaggccttcctcgcatgtggtagtcagcaatcacctgtggccacatgcatggagtgaggagggctgatagccgtgtgaagagaggaaggccctttttctcttttccatgggcattttgtcaaagaaatgcttaacccctattgatatgatactgtgagtgctacttaattaacgttaacggtggagaggcatattgatctcgctggtggaaccagtggcatcacaacaattaggaaaaaagtggtgccaaaatgataagtaggaaaaacccctgtggcatataccttacacccaacatattaaatcagtcttgtgaaattcatcgtgcacagttaattggtcatagatttgtgcacagcatacaaaactcaaaaggtgcgatggcatgtgtcattaataaacatatgctaaggacatttcaggtgctcctaggataaactaaataaaagtcatcccagaaatacattttttatggaaaaatgtttagtaatatagagtatggtgacatctgccacttcacaaaatttgaaatgtaaacagaacttgtataaggagaaacaagaattgttacttggaaattttttagccttcatcatgcaaagttttgaatttttgtgcaccacactctatgttgctgtgatttgtttgataactttccatgataaatatttacatttttaaggggatgggagcacctgaaagatgctcattcacatagacaaacattcttgtataagatcctccaagggacatgtatttgaagaacccatccacataagatcttcagatgcattgggagagaagaaataaaaggatatttttataactcaaacatttttatcctcagatgcattagagaaaagaaaagaaacataattttattgtacagactcactgttgtactcttaaatgattatgggttgacgaaactctcatgcttgttttgtctagaaaacctactgtttacttaatacatcagtcaacag

SEQ ID NO: 33209 - DNA, 4588 bp, Oryza sativa
  unsure (1)..(4588): unsure at all n locations
nnnnnnnnnnnnnnnnnnnnnnnnnnnnnnnnnnnnnnnnnnnnnnnnnnnnnnnnnacaaagaagataacacaacattctatttattcacaaacttgcatcatataaaagagattaaatagctgtagtattccacctttcattccaatttttatgatttaaaggagatcgagtgattgtagtatgccaccacaacatatattttccgattcggtttattcatgagattaaattggacttgtgtagaattaaaagagtaactaaaataattgcatatgagtgtaggatgtgcacctgcttcacgatgatgggatcatccctgctacgattcacaacataattaagcattgaatcaagatgatctctcactgctatgtacccatatatctgtactgggccactatacatatgtattttagccaacttaattgagaaaatttgcatcatgcgagttgaaaaatgcacagtgcatgtatccctattaggttgacagtccataggttgtgaaagcatcatcggctccaagcaagcttcaccaaagacaactaaattaatacatttggcaaatgtttgttataaaaaatacagatacgctttttaatacatatttatgcaaaattacagaaaaccattgtctgatagaaaaaagttatatatggtttgcaatatgttcaacaaaacttgaactgatttgttctgaccagagttacttcatttcttaatagcccacacctcaagataatttctctggaacatccgtagtacatttatatttcaacacaaaagaacctcaattcttataaagagctagcataacaaaataggaaagagaattcaataacttactctcatgacgatcagcaatttgaaatacttggataaaaccagggcaaaacttgtatatagaaccatcacggtggctactgccttctaatattgttgcaggatgtacatcaacagtgggacagttatcgctgacaccttcagtaaaccaccacatatcttttgtttttttcgagaaaagcctcatgtgtgacctacacataccttttataatggaaaattgcttggccagggtatagttggaggtgcagaaagaatcattagcataagagaagtggcagtgccagtcgaacttactcttattcttctcattttttactccaatgatgcttggcatgaccttgcatccgtaggcaaatctatcaccaaagagcataggcaaaccttagcatctgactcatatatctggcgcaaatttattccaatactatacgttaggctgcactgttcacaagtactaatttaccatcgaatttatcacatagctacagattgttgacgttccatccttagcactgttatctcgatgaaactttgaatcagtagtcttgtgataaagttagcacaaaatctgtaatttaatagttttgttatgtggcttataagcatatggtttgtgattaatttgggttcatatctgtagcattacaacattatagcataatcctgtaattatacgatagttttgtcgaattaaatttgaaaatatactgttcatttttttctcagaaatatccgggatacaattttttttgacacaaatatattgtcattgttgagtgggactactaaaacgtcatgatatcgttgaaccgttgcgagatcgcgggacccaccacagtctcagagccatggcgtgagattgcgcggtcgcgcagagccaagtagccaaccagtgacatggcctcctgattagtgattaatcatcgtgattagcagttaataattactgattatgctaattaaagaaataacagtaattaattaattgctaatgtcgctaattaatctattaatcgcgcgagtgcgctagttagggatgtgaattcgcggtctcgcacactcgccacgcttccattatgcgacattggtatacttctgcaaatcccttctaaacgtgtatttatgtgaaaccaatgaaaaaaagttatagtttcaaaaaaaaactagttatatagtttctgagaaatttattattgaataagatgcgtaacataagtcgttactgctgaaattaaaatcgtactgttttctacattgggatcaaaattccgttcctcagttctgattctagtataattaaaaaaaataatcccaactaatatcagtttcaatttttttccccagttggggagtcgtctgaaattacaaaaacttcaaaaaccctattaagacatctcgaacaagattcaaaaccccccaaatccaaagttggtcccaatcaagatggagaaattcaccgcaaaagcgcatggctctcactgtaaacgggcgtaagcaaagcaagagaaggcaattcaggaaagaaaagaaactgaccgagaaagatgatgcagatgccgcctagagtggagcatctcgccgctcaacggctgcgaggcggagcagaggcagcgggagacgggagagttgggttgcagggtggaggagcaacgagagagtcgagtgacggagcgagagaggaggaggagtcgtatctactccgccgttcatcggggggcggcgcgatggctgtggaatgtggatggctccaccgattgggtcgtttcctcggccggtcgggccttgggtttagtcgtttagtttctcttctgatctgttctcttttttttcgttcgtttgttttaaatttgatctttttatatctaatttttatctgaacatttcttaaaccacgcaaaatcttagtgatatatacgatgatagttatatatcaagttaccagcgaacagtactgccactacaaaacatcaaataatacttatgttatcttttttttaattacacattacatcgcagacactcacaacacacgcacactcacccctatgaaagcacgcacgcaaaccctacccctataagagcaagtacaatagcaggctattagctagctacaaacatattttaatgagataaacgataagagagaagagcagcaggctatagatttgtagccagctgcagcacggactctaagacgcaatatacgtatgacagatgggatcatatattaatagtatagtaagtaactattgtatgaattggctattagattgactatagatgaattggagctaatagtgggctatactattaaacttgctctaagcattttcgaagactgggccggcaaatcctagagattgacgaagtcaccactggcatctcactatcgacgggtacgtcgcctaccactgaaagcacaatgccgataaatcctagaaaattcgctcatcttcgttaaatgataacgatactaagggctagttagaatctccaaccaggtttaagcttttcgatacataaaataaaacaagataaaccattagcacttaaataataagatgagtattaattattataaactttcaaattagttttatttgatttttttcttaaagaaacttatgtataaaaagtttttcaaaaaaaaacaccagtttaaaaacatactaatgaaaatggtaatgttgaagttcgaagtaaaaaaaaaggaacgcatcctatcaaaacatgctaactgaaaacgataaagttagagtttggagttgaagaaagatcacatcctacgatgttgagccaaggctcggacctcggagtagtaccccggctcaccgtatgcagcacaagaccactaatgcattctctccattcaaaatatgagattatatgcccttccacttctctgtaaatataaagagaaaattccctatctagcataaaaaagttgttctttcctctatagcacctaagcttaaaaagttccctatctagacacttctaaaatttcccttccctatgtagcacttctgttagtttttacacttgacggtgctaactagcaagagaaaagacgattttgcccttctttagttttcaggcttgcccttacatgagcgttggtattttagacatgatttctcttgatttaacgtaacactgcaaatataacatgccgatccactcttttgaaaaataataataattatcctcttgtggtttcacttgtcgttagttaacttaagtaattaataaccaacatcatgttcaggcaagtctaaaaactaaagaagggcaaaactgtcttttctcctgctagttaacaccatgaagtgtaaaaactaacgaaagtgctatatagggaagggaaattttagaagtgcctagatagggaactttttaagtttagatgttatcgagggaagagcaactttttttatgctagatagggaattttctcaaatataaatgattttaggattagaaggtaggtatagagtagtacaatatatttttttctggtttatttctcattcatcaacttttgtacttatttacttatatactccctccgtttcgaaatgtttgacgccgttgactttttagcatatgtttgaccgctcgtcttattcaaaaaatttaagtaattattaattcttttcctatcatttgattcattgttaaatatatttttatgtaggcatataattttacatatttcataaaaatttttgaataagacgaa

SEQ ID NO: 33210 - DNA, 749 bp, Oryza sativa
acggcgcgcatgggggaggaaaaggacgggcggctagggtttggacgggttggcgaaatccacaccgtccgttaaagatccaacgattccacgggtgtggaagggccgccaaagggggaacgtggacggccagatcgagcctatctcaagatcggacggtggacatagcaaggaccggcgcgtaattaatcaaaagcatggggtttattttgcaaaagacggttgaggtggcacgctaatcttcagccattcccacggcgtttaagtaaactaatattcttgtagaatagtggtagataccaatggtatctactgttatgattcatagacaacctctatgatatcccaataaagttacggtaatactcatgatagtaaaatgcagttaattaaacatgtgcatcggttttatttaggtccataaacttgaaaatcacatctttagacccccctgccccctaaaaaaatcttgtaagtatatcatccctgtccaagatcaaacatggcatatcacacaaataccaatatggtgtcaacttcaatcctacatttattaacaaatggggccactatccatatttcctttttttccttctcttcttccaattaacatagcaagccaacccctaagtgaggtcatagaactaaccgagatggagggacctgacaagggctgtaggaaccgacgagatggaaggacccagctagggggtgcagatctcaacgggaatagttgatgggctagaggt

SEQ ID NO: 33211 - DNA, 704 bp, Oryza sativa
  unsure (1)..(704): unsure at all n locations
catctcgtctatccttgnattgttgtgcttaccaaacagggcatgcttttaggttctcgtactcctcaccgcgatataggatacaatcattcggacatgcgtgaatgttctaaacttctagtactagagggcagactatcttcttagcctcgtacgttgtctcggacaatttgtttccctccggaagaacgttcttgacgagtttcaataaatcaccaattgccttgtcactaacaccattttttgccttccattgcaagaactccagagtggtatccaactttttgtgcccctgctcgcaacctgggtacaacgacgttctgtggtcctctaacatcttgttcaatttatgggcccccttttcactttcgcagtcctccttggcgtcctgcaacatctgaccaagatcatccgcaacgttgttaccatcagcatccctttcctcctcgcccgtttgatttccttcaaatctagcgtactgagcaaagtccggaatattgtcgtcttccacttcatcttcttccattttaaccctttgctctccgtgggatgtctaacagttatagcttggcatgaactccgatttaaacaagtggaaatgaatagtcctggatgcagaatactcctgattcttacacttattgcatggacaacaaataaaacccttatgcctgttagcttcggccactctcaaaaaataatgc

SEQ ID NO: 33212 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnnnnaaaaattcttggaacaactcaaataatctgggaacgaatttgtggtaacttcttgctgaccttagaaactaaatgcggattttaatttagcttatcaactcattagatcaaccaaacaactctctaaacacttaagcacaggattttgacagattctctggagcactctttgacactctgccaaaattggatcttgaactcctaggctgtaaaactcgatccaaactgtagttcaatcattgctttacaactttgcctttggtcactagctctaactctgcctggaactaattttaaactgaacccaaagatggaattccacctctgttccagacttggccaaaacctagatctcctctccttctctctcactagtcgctgccatgtgggccagggctgcatggcgggaccccattgtcagcctcacattcctctccacacgggcccactgcctgaactcgcatgccacgcgtgtgagcacgcgtcgagcacgggagagggcgagctcctcctgtccatctccgccggcgaccatacttaacccgaccggccgaccaactttctctccctctcgcccttgtctcgtttcgcggaagaaccgaggtaccccgcctcggattcgccgggaacggaggcgccatctccggcgccggcgagataagtcct

SEQ ID NO: 33213 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnntcagccgaggtacacaaactgacaatttaatatacaaatccatcataataataacgttacatacttacaaaagaaaagaaaaacagcagcggaattacggtctagcgaagctccggctacactcccacaggcagctcaactagggtataagtcaaccgtcttctccttatggatcctttttcttcaactgaggtttgattgattattgcaaggtgagtacatggaatacttcgcaaaccacacagcaaatatgcaagtgtacaaggataccaaaggatggcataatataggctcatttgcaaaagcagcatttagcaaacatttaagagtagtaaaacagtagagtaattaatcatcaatattaatcaacactgaacagcaccccaatgctgcacagccccaaccaaacctgaacaaccaaccccggtcgtacatatcaaacccccaaaccaggaatttgtcattccaaactaggagtcaaattaattgtcacattattatcattaatgagtagcgtgagactaatcacgaaaaacattgctcaacccgcctatgaccgcgggcatggctattcgaatagttttactctggccagaggtgtacaaatttacccacaagacacaactccacaatatgtcaccatatcaccatgtgcccatg

SEQ ID NO: 33214 - DNA, 10372 bp, Oryza sativa
  unsure (1)..(10372): unsure at all n locations
nnnnnnnnnnnnnnnnnnnnnnnnnnnnnnnnnnnnnnnnnnnnnnnnnnnnnnnttttcttcatcttcatgattgatggatttcgtcattgcctttgatacgtgtctatatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggctgctcaattttgtcgatgttgctagacgccttcatcttcactgttggctaacttgtctgctgccgactggtttcttcgcctccatggctatgcgacttcattacttttgattgctaccatcaatgaacaattgtgactatgacagaaggacaagctatatgctcaggggcttactagatcaaacacaagtatcataccttcaatttggagttgttccggatacatgcaacatgaattcatgatcatgggtctattttctatacttaaagactggactatttattattccccgtaagggttatcaaccgaatagttgtgccagtcgggattcaatttttatatctattttggagtatcccattagggataatcaatcagatcagaagctattcatatgagctacacttggtctatatcacccggaagatctattactcgggagcatgttacatgcgtcatcctttaaagggtgtcgaaggcatattttttggcctaggcctaatatgtctgcagcccatattttcaggtgtggcctgtcacgttcttttagggactcaagcactttttgcttaagccaaagtgcgcgtgatcaagtgcccaataccttaaaacccttttataccgcagttactcaactttttaggagttggtacaatgcatcttaaaaggtgtcaaacagtaaagctttatatagctgctccgctgacttttttatatagtcatgacgctatttgagtttatcaagcaattgattggatacaatatcattgctttttgccccgtaagtgtgcatttttattgaccaatattatggcttaggctgattattcattgtggtcattttctaggcggctggtaaatcctttatgagtttatttactcggattttacaccacatatgccatatatttccaattgtggtgaaaccatgtgtcttttagggacttaagcacatctgttaaagtagtgtgcgcgtggcgtatgcccaatacttcggaaatttctttattcgcagcattcaagcttctttatagctgtttttcaatgatgtagtcaactttaggttgctcgcatcaatttttacaaagcagtcggtatatcacttggatcatgttattcggggattcacaccgcatatgttatatattgatatcaagtcacttggtcgattacaattatcaaaaccactcggttggttggattatttattccttgactatatgcttagtttgttcagctaaccacatagtcgggggctacacctattaggtgcatctagtcgatgcacctgactttatttttcagccctccacagtcttcagatttgataaaagtactcgggagaccatggcgaagatgattgaagcactcggctttggagtaatctagttcgagagaagattatcttttcgactgtgaaggtctcaggggctactgtggagattatgggtaccccatacccacgcggcatggttatccgactagctataggggataacttatatctatagaatatgtaacggatcattacttgggtattacgtttccctgtatattatggaacggcctaaagtcctggtttgataagattgtaaagtagatttaggaaaccgataccgtattggttaaggtttctatcttgtaatcctatcccccatcctatataaggtgggcaggagaccctctagggggcaggagcacatatgatcgtcagatctataatacacccggcggatccaaatccccaaacaggagtagggtattacctctcattgagagggcctgaacctgtctaaatcctttgtctccacatccatccacttttaggtttcgtacgctaccccgttttattattgccgaattcatgtttcgacaggtatcttgttttaaacattgcagtttgatgagcagaatatcagcataatacatgggaacataaacatctctaaaatatcatttcaggtctttccaagattgtggtattttgttatgcctataaagatgttttccaatcatttgaagcatgtttaattaaaacactagaggcacacataacctttttgttctcagacaagacatgcttttgaaattctctattgatcttagttagaacatcatcgcgtacctcattagcatcatgttgatcactcgttatgtctcgacgaagatgtcgatgtcaagctatgttatctccaatgatcttgcatatccatgtcattgttagtagcaaacaagaaacatacacaagaatatgcacgctcctatcaactactaggtagtggcagctgaagtattacacacactcaagcttttcaccaagctcttacaagttcttaccaaagcaagcggaatggtgatgtacaccgcctcaaccaagcaccccaatggaggttggatgtatcgatgccttggcaaacacttgctgtatgactgcaattaaatctgtggagctctgggtaggcttaaatatgtagtaaaggaatagcaaatactcaaatcagagaatgcaaagttgaataattgttcaaagtcaagtaccatgctggtcctagggtataacgtactagaaacgcgagcctagacacaaacgataccacaggatagcactagaaacaacttaggcacactctgatatgtgaaagcaaactcaaagatagaactgatttttctcttttctttcttttttctatctttttttactttcttttctttttcttttcggtgcggcttttgttttctttctttttagcacctttctgcctttttttctttttttttattttttttcagcaaaaatcaactcaaggaccttaattcaagattacagggactcaaacgtaaatataaaaattacagggactgatatacaaaagtgaaaacccaaaattataactataaaaaatggaatgctcttgtcccataggttccgtttttgcaaacagatttccaatccgatactccaaaatttttcagcaagctgtgtcagggatgtcatggagtaggtttgaaaccgagagaggagagggagtcgtactctctagtcacggtggtggtgggtacagtaggtgggatggttcagcctagatggaaacagaataggtggaaatctggaaaccaataccaatcaaacaaaaactttccccttcctccttcgtgacgtatggaaaccgaatccaatctacaaaaatctctcaaccttctttcttgctagcacacacatgcacggcaaaaaaacagacgtagtatttgcaaacactagatgcaactcaacaacaaaatgaaccgacataaccttatgaaaactacaaaaatggaaccctggcggaaagacgattccgttttcgtaggtgccgatgacaaccatgacacggcggcgacgacgactgtggtataaaacgtgaccagaactcgaaactctaaacgaactagacgctaaggctagcgactacgactcgacgatgcaacagaatactcaacaaagcaaaaactgaaatggacaatgcaatggcacaaatatggctaggtacaggatacaatatttttttgtattgcaattttctggttataggttgatagaaactcaccgagcaacgaaagctctccgtgggttgttgatcttgctggtgcagatcaaccctatttctgcaagcaaatcaaagaaacaaacaagaacaagaaaaagcaatatgatattgtaaataggaatttaatacaaatgttaagttggggttctgaagaacaagcagacggacggtctagtcgacacgcgcgatgcaagcaagtagcaatggctaaactttaatctatcaaaacccaataaactctaaaggggtacctaactatttataaaggtgtgaggataaccaagtggactctagggtcgtgctccacctggttgggcgcaccccacatgggccccacttgggccggggtcccaaacgaagttacaagaccaaaggcccatgacaggtgacgcaacaccttatttttgtgtttgcggccaaacaagatggagtctggtgatgaggccggatccgttggaaagaggactccgagagttttcaatcaagtactcgtgggccaaaaacggaggtcgtatgcagatttggtagccgtttgaagtcagcagtgtagcaggtggccgaatcggattccagcacttgtaggatttgatctcgatatcttcttgttcatccatgatgtgagcaatggttgcatccgtggtagccatggtcacatcatcctcctcttcttcacggaaaaccgtcctatttgttatgtctgtttctatacaacagaagccatgatatcatgctcttaattcaagcctgaatttgttaggacacattattgacatataaccacataaataaatttgaagtcaatataatctttttgtctccccatttcaaggtccaacaaatgccgagattttactcatttgattgtggtctgcatactggactactggtagtatgcctgagtggttatgttgatgactgctaagagaataacaagtcaatatcttgctttgatgcctttttgtgcatttctgattaagctaaaaataactatttactcataataatggttatttttattgttacaacttacattacatgatgatatgttttataaattttgggtaaataggttgtgctaggaagatgtagtttctaaattttttggtgtaattatgtattccagtgatatattttgtggaaaacgtgcattgcatgattactagtttcaaataagttcaaacaatactatcaattatgatttttgacaccttacagtgatatgaaggacaaacgctcacaccgaccaataagaaaatgcacatttttaatttagaatattccactagtacataattcatttttccgtgtggtcaaaatccattttttcatgcggaggtagcacccgtctgcacccaagggtctgtgaaaatcaatattttcacgtgcgggcggcccaactgcacgggataatcgattatcccatgcagtcaaattataccacccgtacggaaaaaaaataaaattgaaaaaatcccgtcgtcgtcgccgtggtcgcgcagccgccgctccccgccgccgccactcgtggtcgacatcgtcctgatcgtcctctttggagattgaagatttttatgctacaagggaaattcgtcttaaagtggagatggttaaatatgtgatccgaattttaggcctactatatatttgggttagttttctaataggactttgcattataggattagtttcctattaggacttcgagtctttgcccataaggactcctatttttctcctatatatatatttatatattccttgtaagccgcatggggagggtgcgacagcctaatatatctcttgcatttgtatccaactcctctacactgatcatggtcggtcggcgtccgtggttttttcccgtaagggttttccatgtaaaattcgtttctccgttgtgcatctatttacataacacaaataaattgataaacacggtgaagcggtatatatgcagttgcatatctcctatagttgtaaaattatgatggcatcgttacaaaatagataaaccgtaaagatattttttgaaactcaacaatttatgatggcatgatcccattaaccctataaattaaagagtataggccaaaacaaaagtactccctctattccaaagtactcggacactcgcatcagaaaaaaactttagtaaagaaaataccaaagtagtcctcgaaataatattggtggatatgtatgtaaatgacattgaaatgttaaaacttctaaatttatggaacgagtctaagtaaatgaacttattttggaatggatggggtgtaacttatacatgttatgagcaatttattatgaaacaatcacatgttataaaatttatcgtctgtgttgttctcttcgaattctcacaacaacatacgcgccatgcgccatgaagtcacgatagataaaatgtcaatcatatctaccaaatagaataataaataccatcaacatctttgatgtaggacttgggattcattcccattagtgtgaaacaaatatatttacttcatctctaggtgatgatcattggccagtaaggttgaaggcgtggtgaggtagatctgtgatgtgtacatgcagtgcatgcagtgtctctctcaagctccattacatgttgacagttatgtataactcatccggaaaaaataataatatactccctccgtattttaatgtatgacgccattgactttttaacaaacatttgacctttcgtcttatttaaaaaatttatgtaattataatttattttattgtgacttgatttatcatcaaatattctttaagcatgacataagtatttttatatttgcataaaaattttgaataagacgagtggtcaaacgttggttaaaaagtcaacggcgtcatacaatattaaaatatggagggagtatatagtagtagctacgttgtaacaatcgcgcaagctattgtctcataaaaccaggaatctagtgttgatactataatttaatgaaacgagcaacacatgtccataaaaaaagtggtataaattgtgcaaatcatctgaacaggggacggacggccccagcttaatgtttctcccaatttctttttttttcttaatttcctagtactaagttttgtctgtctctactcatacaccatacagctataaatggatcatgtgccacacacaaaagcttcacacaacaagccagacagatcaatagtagcattcatagtaccacagctatctagctagctgatatcttgagttatcccaagtgatggccaaggctgaagttggccatagggtttgtgttacaggagcaggaggatttgttggttcttgggtagtgaaggagctccttcaccgtggctatgttgtgagaggaactgcaagagacccctgtgagactcttgtgtagctatatcatcacaaactttacatctacgctctaagtacaacctgtgttaaatatatattgtttgaaactattttaatttcaacaagatcattgccaagttatgctagttgattatatatggtttgacaattaattaattaattgctaccgtgtatctatatatgcctgataatttgcattttgttgttgtgaagctgctcagaagtacccccatttgcaaacacttgaaggagcagcagagaggctatctctgtgctacgctaatgtcatggactacaacagtctccgagttgcatttgatggatgtgatggggtctttcatgttgcatcaccagtatccaatgatccagtgagtggacaatatataggtgtcgttttttaaaaaaaccgacacaaaatataataggtgccggtttttatttagaaccaacacctataaatacttaaaggtgccggttttttacgattttaacccgcggaggtgaaaaaatgcctataggaggtgccgattttagcactatcggcacatataggggcaacaactatttgatgttttgtagtagtaaatttccttttcagcgtcatcttttataatcactctattccaaaatataaaaattttatgtgtttttcaagatatatctaattaagatagagggatgtctagatatattttgaaaaacacgcaaaaaaaaaaccatatattttcaaatggatggagtaatatttatgaaatcatatgaaatataaaaaatatgactatatgacagcattttttcatggcaaatatgcaaaaaatcattcgcatatattaagctgaaaatcaaacggtgtatattaagcttcaatttcgcaatatatcgaaaaccaaatatcttgaaacaagcattcattcgcatagaaagcttaaatttcaaagtatatatcacatggaaagcttaaatttcaagatttgatgaatgcttgtttcctagaatggtaaatatataaagagtggagtagaacgtacatctttcattaaaaaaaaaatctaatgctaactataaacctgaaaaggtgcttgtattgatttaattatgcttatgattgggtttctttataatacatgcttggagataagtttttattttatcttcccctttacctcctaaatgcatataaactgctcaaatacagatgacacacaatacatggtacatatacatatttttctgttgaagcaccggttaaataaattttgttagcatggaaattagtcaaccaactaattaataatatgaatcgacaactaaaatgcagcaatttgtacctgttgccgttgagggaaccaagaatgtgatcaacgctgcagcagacgtgggtgcaggtcgtgtggtcttcacgtcttcctacggtgctgtacacatggacccaaatagaagcctcgacacagttatggacgagagctgttggagcaaccttgacttctgcaaacgaaaaggggtaataaatttcgaaaacgcaaaatgccatacatatgtttattctacaactaattgttataaatgaatgccctattcctagaagtgttatagttttgttccaccaaataattctttcttcattacaatttcataccaccgagaaacctcctccattttttttactgaacactaattttgtgacgccatcatatcctcctcgtccatgccccggcaaatctttgtccatggctcaccgtacttgtctaacaggaacagtggacagcttagctggtaaggagcaaccaagaggcaagagcaagccatctgcctattctaagggtatgtttagttcataccaaaattagaagtttgattgaaattagaacgatgtgatggaaaagttgaaagtttgtgtgcgtataaaagttttgatgtgatggaaaatttagaagtttgaagaaaaagttgagagctaaaccaggcctaagtcggtctcatcacaagttatgtcagcattttctcaatatcaataattgatactcctttcatattttaatgtatgacgccgttgattttttgataaacgtttgacctttcgccttattcaaaaaatttatataattatcatttattttattgttacttgatttatcatcaaatgttctttaagcatgatataagtatttttatattcgcataaaaaatttgaataagacgaatggtcaaacattggttaaaaagtcaacgacatcatacattaaaatacggagggagtactaaaaatcttattaattagtgtcacatttttcgtttcaaaaaaaaatatacatgtctaacgagaacgttggatagctcatttggtagggagctactaagagcaagccattggtctagcctcaagtgcttctcaccacaagttatctcagtaatttcttctatatcaataattgatggtgaagctcttgttagtatcacacatatttttcgtgagtaaattccctgggtaccctttgaaaactcactcaatcccttttatacctttgaaatttaccggttcccttctatacccctgaaatttcaacttcatcccttccatgcccctgtcgttacattttccttcatttcaccgttaagtttggtggcaaatgtctttaatgcccttgatgatttagctttgaatataaacttgaaaaacaattgaaaattttgtttgagtactatgtgcatttcatgtgactaatgagactaaataattagttcagaaaattttgtcataaattttgaaaataaaaaatgtaataatttttttttgaaatctaataggataatagatttttttatcgggagcattattaaaaaaaaccatgagcattggtagtcctatctttctatgaatgctcctcatttttatgactttcaaaaaataaaaaaaatataattttttatttcattatcttaatttttttcataaataatgtaccgtagcaatcataactattaataatttcatttcatgtgacaagcttttatattttctataatgtaattcataaatttatatgctcattcaatgggtaaaatggtcatttctataaaaattagacggtcannnnnnnnnnnnnnnnnnnnnnnnnnnnnnnnnnnnnnnnnnnnnnnnnnnnnnnnnnnnn

SEQ ID NO: 33215 - DNA, 7565 bp, Oryza sativa
  unsure (1)..(7565): unsure at all n locations
nnnnnnnnnnnnnnnnnnnnnnnnnnnnnnnnnnnnnnnnnnnnnnnnnnnnnnnnttggatagctcatttggtagggagctactaagagcaagccattggtctagcctcaagtgcttctcaccacaagttatctcagtaatttcttctatatcaataattgatggtgaagctcttgttagtatcacacatatttttcgtgagtaaattccctgggtaccctttgaaaactcactcaatcccttttatacctttgaaatttaccggttcccttctatacccctgaaatttcaacttcatcccttccatgcccctgtcgttacattttccttcatttcaccgttaagtttggtggcaaatgtctttaatgcccttgatgatttagctttgaatataaacttgaaaaacaattgaaaattttgtttgagtactatgtgcatttcatgtgactaatgagactaaataattagttcagaaaattttgtcataaattttgaaaataaaaaatgtaataatttttttttgaaatctaataggataatagatttttttatcgggagcattattaaaaaaaaccatgagcattggtagtcctatctttctatgaatgctcctcatttttatgactttcaaaaaataaaaaaaatataattttttatttcattatcttaatttttttcataaataatgtaccgtagcaatcataactattaataatttcatttcatgtgacaagcttttatattttctataatgtaattcataaatttatatgctcattcaatgggtaaaatggtcatttctataaaaattagacggtcaactgacgggaggggtgtgagacggaacaaaatcaaattttaggggtatacaaggaagtaaacaagatttagaggaataaaaaggattagttaaattttcaggggtatacaatagattctctcatttatcatttcaaaaaagtacgtgtctagctaacatcctccacagggctcagtgcaccaattttccacgcacatctcgaggttgttcagattgtagctaaaacaaaccttaccaaattttgacattgccaaaattttaacaagtcggcaatattaccaaaattttagcctaatttcttatgtatttaccaaagtttgacttttttttgacaactttatgaaaaaatagtatggttgaaaatgcatatccgaacagccccctcgtctttgtcctccgcgtcgttgttcctcctgcgtgtgcagctcatccattgtggcttgcagctgggcttcaatgccagcaaccccactagcggctgattgtttttttgtttttgtttttcttctttaagaaagggaggacacaatgtcacaacctcccccatttccagtagagaaatggaagcattacagagtttaacttcctctagctctgtctcggttatcagaatggtgccatatccctccattttgacatcagagcagctaactcaaactagagaaacacaacatacataaagaaattggaaaaaagaagatagcgcgccatggctatttgttgggcatcaacatcatcccgtcacatcaaagtgtcgaaactagatttcggcaataataaaagggggtggctatcaagctggagaagtgaatgggtttggagaccaaggatttatacaggttcaggccttcttattcaagaagtaataccctactcctgtccggggatgaatccgccgagtatcttattgattgtatgatttggagaaaatcaacaacgcatatatgcccctagaggcacccggacccccttatatatgggaaggagtccgtgttacaaaagataatctatatccctaacggaatatgcagatacagataaaatacagtcgtaaccgactaagtctcaaggtatttccttgatgtgcaagttgagaaacaaacccaagatacaaataagatattctatctatattcggtatcctatattcagtccaaatatcatcgccgtgtagatataggatatccataatctccacagtagcccccgagacctttgcagtcaaccatcatagccttctcaaggataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttaagaataaaataatagcacaatcgtgcatcatacgacaaaagcatacacggcgcctaaagaggcattctcagccgactgctttttagccataattaaaaggaatccgagtggttaacactctaaaaggttcacgaatgaacacacttgacaggcatccgaataaaaagctctaaagattacccaccaaatattataaaaaattatggtaatgaataagtctaatagcctaggctatgactatttaccataatgaaaacaggcatataacataccaaggaaatgactatggtaaaaacaagtcattccaagttaacccagacagctttcgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaagtactgttcagcctaagcccattcgcacctccgacacccttaacaagaaatcccgagatccaagcgacacttcatcttccccgccggaactctcgccattttccccactccctgctacagtacagagctgcgccggcaaactagggttcaccattccactcgaatccaccttcaaaaagttcatcaaaatccttcccgtgatccaccgcctcaatccttcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatacacacgaggctgtggtcttctcccatttcttctatggcggcttcgctcttccgacctcaaaatttttccgcgggatattaagtttctatggaatcagcttgcatcacctaaacccaaattccatagttcacatcgccaatttcatccatgtttgtgaagccttcttgggaattaagccccacttcgctctgtttcgccgaatcttctttctcaagccccaaccaaacaagagtaagccatgtgtagtcggaggggccggattttagctgagggggactctgagccagaagtacttctctatgcccttcaagacctcaaacaaagggtggcatgcaaactggttttatattcagaatcctgagcctgctcttctcgagtactcttgtcttcctccggtgtaccaagatacctggaactctcttccgattggggatgaagaagcccaagccttggagctgatggatcgcatgctaaaactcaaagaacaaggcttacaaggagagcagattactcggcacttcatcaaatgccgattggcaccaattaaagaaagatcccgtacggcattcgagtttgacggcaagcatgatcctaatcgtgaagaaccagattctctggattttaaaatcatgaaggagagaatgtataaaatcttctcaaatgctattgtcgtcagctactcacatcagctgccagttgtgccatataacgcattcaatccgcctccgcaggtacgtatccgaaatcttcaacccatgaccaaaacataatcttgtcttcatgttgagttaactaaccgtggaggcatctcattcaggaatatgtattgatgaagtctgaccccccaatcactcagcgccggtctcctcgtcagcacaccgttcagggaggtggagggccgacaatcagatcagatccgcaacctcaaacctccaatccgactgggcagacaggttctcgcaagagaaagctggtgcttaatgacgacgaaggcgacgacggcaacaaatctggggacaaaggctcgcccaataaactcccaaagcataccactcccaggaaaaaactggctagtcgtccaaggccaaagatcagaacatcttccaggtataaacctctcggtaccatttcacttcgacatgcttctctcatggaaatagtactgaatattgaaagaacactttgcaggaaaccatccgacatagatccaactggaaaagatcctgatccgactgtgacagaaccaagttcatccaaggattctgagccaactgccgaaagccagccgactggcgcccatacttcaggtgataaggccaatccgagtgaccagccttcgactggaaaccagtcggcagcaactaaaactacaacaacccaagagcccccgactagaaaccattcggatgtaggtccagatcaagaaactcccgaagttgaagcgcagacgacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcggctgatgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaaccatcatgcagagaatccatcttcgcaatgaggccaagaccgcaactttagaaaagctggttcctcatttgggaactcttgaagcagttagggatcagctacacgaggccaaggagctcgccaaaaagacagagaaggaattaagggaccgaattgctcagctccaggattcaaacttcgagctgagtggttcatcaaaaggtaatctctagatctgccccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtattttgtagaccgcaaaatcaaatctcaagctcaatttgacgtcctggttggtaaaatcaagaggcttgaaggagcaagagatgaagtcgctaatgtcgctataccactcgtccaagctatgttcctcaataacagtggtccgagtgtactcggcgcaaccgaaatcttcgacaagcagagagttgctccggatgtatatttcaagaatatcaagaaagctggaagtatgagagctagcacggcattggcgatgaccaaatccttgtacccgaggattgaaattgacgccattgatggctttgcagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggactgattctgactgagcataaatgtagcaaacggaggcataacttgtacaatactggtgtatttatactgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagcccccgactgacaacttcaagaagaaaacttgatgttgacagtcaagatagggaagtacagtgataagcttaaagactcgaagtcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatggtagctgttccacccatttgccggcatagggttttagccggtcaaaaactcgcgctttaatcccttgaagtatcatgacattggctcgctccacctgtccattgctcatgggatgtgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatatatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggcttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgcttaatcaataagggagatcgcaattcg

SEQ ID NO: 33216 - DNA, 2101 bp, Oryza sativa
  unsure (1)..(2101): unsure at all n locations
tgattgaaattcggggcttgaatgatatgtccaaagacatcaactccaaagcccacttagcaatccgtccgtttgcttcacggttgtgcagtatatcaccgagtggaaatgatgtgaccaccgttaccgagtgaccttgaaagtagtgagatagcttcctggtagtaattagaataccatataatagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattgaaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgcacttttcagggtttaatttcatcctgaaagcgcggatgctcgcgaaggtttcttctagatccgagattaaatcatcattttgtttggtcttgacgactacatcatccacataggcttcaacgttgcggccgatctgcgttgagaagcatctctggatcatacgttgataagttactcctgcgttttttagtccgaacggcatggtgacatagcagtatgctccaaagggcgtgatgaatgaggtcttcaagcagtcggattccttcagtcggatctgatgataccccgagtaccaatccaaaaaactgagaagctcacagccggcggtcgagtcgactacctggtcaatgcgaggcaatccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgcaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgcttgccgtggctgcagccagtcggatatcctctcgggcagacgccatctcgcgggtttgggccatgtcgcaactctccttgtcgcatgtgacggcttgcttgatgtcgctccgtagggacaggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccaccgtcgatgagggttctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33217 - DNA, 1098 bp, Oryza sativa
  unsure (1)..(1098): unsure at all n locations
atattttttatgctgtcaaactcgactgcaaagatttggtttttcatgtcgccattgttctcgctgttgaggagtcccaggaattgtactggcaacgcggatgaaaaattcttgcttggtgctatgaagaatgtaaagccttggctagggtaggtagattggacaccaaatacaaaagatgtggaaaaggattgcaccaggccactggagaagttgcagaagggcagcggagttggatagaaagcatgcccattgagcctggtagagccattggttatgtcgaggaggccgttggcagtcaccatggctgcaccatcaagggtaatgttattgtgggcgaagccagagtagatgaatacgtattcaccatatgcacagctcactagatcaaggctaaagaacagtatctgtagaagtaataaagtgagcttcatgccagccttgactataaacccaggcctttgcccacaatatttgtagaagtaaaaaagagtgatcgaaaagtgaggaggtgatcttgggcagttgcctccttttaagcttacaccggagtttataacatccagagataaggcaatgtctagcaactccatggcttttacttttctcttgttttgtttttccccgctgccgtatctattcaagtatgtatccaattgtggacaaggttaatttgtaagttgactactttactttggtgaatactatcagtattcctgttaaaaaaatactatcagtattatcaccgatagaagtgatcttaattattgatttataagtttaactaacaatagagaaaaaaatattctactacccatagttgagatggtagtataaatagatatgatccatgtaattagaaaagatgagcggctattaatttctactagtagtagacaccgttgttaaacatttctctataagtttgttaccgatcgataccaatatatgtaattatgtttaatttttatttgtgtaataataaatacaagaaaaaatatccaaaatttccatggactaagtaatataatatatttataaatttcccgaagtgatnnnnnnnnnnnnnnnnnnnnnnnnnnnnnnnnnnnnnnnnnn

SEQ ID NO: 33218 - DNA, 724 bp, Oryza sativa
  unsure (1)..(724): unsure at all n locations
gtccagagcgcgacggtgttccattttgacgcggtcacgttccgggagattgcctgcacaaaatgaggtgtttttggtggtgttagagacggcattgagaggggattacagaacgcatattgaacgaaaatgggctcaccggattgcgacgaagtcgagaacttatctcgccggcgccggagatggcgcctccgttcccggcgaatccgaggcggggtacctcggttcttccgcgaaacgagacaagggcgagagggagagaaagttggtcggccggtcgggttaagtatggtcgccggcggagatggacagaaggagctcgccctctcccgtgctcgacgcgtgctcacacgcgtggcatgcgagttcaggcagtgggcccgtgtggagaggaatgtgaggctgacaatggggtcccgccatgcagccctggcccacatggcagcgactagtgagagagaaggagaggagatctaggttttggccaagtctggaacagaggtggaattccatctttgggttcagtttaaaattagttccaggcagagttagagctagtgaccaaaggcaaagttgtaaagcaatgattgaactacagtttggatcgagttttacagcctaggagttcaagatccaattttggcagagtgtcaaagagtgctccagagaatctgtcaaaatcctgtnnnnnnnnnnnnnnnnnnnnnnnnnnnnnnnnnnnnnn

SEQ ID NO: 33219 - DNA, 461 bp, Oryza sativa
cggtttggagagagagagagatcgagatcgagagagagtgagagagagagagaggcagcggcgactctcacccaagagatgcggcggcggtgtctacggtggaggcggcaaggaccgccaagcgacggcgagagacgacggcggcgtcggcgcggggttgccttaggcagtggcggcgaaggagaagccgagatcgatctcgatggaaaaacgtctaagtgttggtggagaagacgagggcacaccgggaatatatatacccctagatctttagtcccggttggtgagaacatccgggggtacagatcattactccctgttcgtaacaacaaccggggctaaagaaaaatagcactgaattttgaatttcattacatatgtgtttcaaaaatagtaaataatgcattacaattatttaaagccgaaaaattaatgacaaaaccttcgaaaaattattgtta

SEQ ID NO: 33220 - DNA, 683 bp, Oryza sativa
cggtcaaaagtgacaagtattcacaaaatgagggaatatttcccaatcaatttaattatatttccaagcttctaactattggtaacagatagtgaagagtcaactttggcaattattaaacttagatttcctttatcacctatatgacatgctaccttcgaggctctattctatcttttgttcaaattatataaaaatggcatagctttgatttaagatgaaccctaggagatgttcaactaagcagcatcaatgtactttaggtacctttggagttcttgcagttgtatcccagagatgcacagaaccatcatctcctgctgtcaccaatatatgcctactattacgtgaatagtcaaggactctcaaaacctgaccttgcagaaaaagtgcaagaaaactaaatcagaaggggaaaatttaagaattctcgagaacttaaaatccacaacagggcatgacagcatcaccatactacacagaaacacagaaagtaaaaagttattcacctgcccatttgggtcactaagttcagcagcacgtgctccagaagcaagattatggagaataagatcccccttcatgctgattgaagccaaatgttcatctttgcaattatacatcacacccgtaatggtgtcagtgtgaccacttaaccatttgatgcacctctttcgctgcaa

SEQ ID NO: 33221 - DNA, 26771 bp, Oryza sativa
  unsure (1)..(26771): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatttggcaggaaaacggtcagacaataacaagttcagtagtaaagttatttaggaagatgtcaaagcatgtcaagtgtgataagttggttcttttgagaaacgtaattcaaaggcaaaagttatcgacccttgcatcgaatagcagtagtatctagcacccggaggctaggaaagctaatatgatgcagttagtgacaagttgtcaaacatggtatgctggataagcgtgacatcatactccaaagcattcagtggcaagttagaagtaaatgataagcatgacattcttatgatgacaaacatggtatcctagtaatgacaagctagtgttgacgcatgacatgaagtggtaacttgtatgaggttgactccaaagatacgagttataagaagttatggaactgaagccccatcttccaatgccgcatcccagtcgaagtcagctagaggtacaaccagggaaaagtcaggtgaagagaagattccatctgcaacaggagatcgagccaagcagtccagagtggagaagttttgttaggcaagtttgttatagaagacggagcggaagaagtcagacaagaagaaaagaccgcccaacctatcttcttgctagcctcctcgaatctcggggacgagattcttgtaaggggggtggatttgtcacgtcctgataaattcatcccgaaattaaaaatcattcgctaaaaggaataatagaattaattaaaattcgaaaagaaattggcaaaccctaaaatacgtacaagaaaaattcaaatgtggcccggagaatttttgttaaattctccttggtctaaaaggagccctcaaattttacttgaattttcagagcaccggaaataattattaagcaacaaaaacaattatcaaagtttaataaaaagaaaaacctaaaaataattctcctcttcctcctttgggccaagcccagcccgaagtctctctctcctccctctctttctctccctctccttctctccctcctcttgggcccccttcccctcggcccagttccctcctccctctctctcccgggctgcctttcccccccctctcccctcccggcctgcccggcccaggccgtctccccctcctctcctcctgggccgcctctcggcccaagctgagccgccccccctcccgcgcacgtgcgctgaccgcgcgccgcgcgcgctgacgccgcccgaccgcgtggggcccacgcgtcaggccgccgtcgccttcttcctccagccgcccggccgtcctctttccctctcccgtgaaccctagcacccttcctccctcaaatccgcgcgaatcaagcatgggattcccaaattgattgaggggaattaatcccctttccctcctctctctttcccccttaatttccccttgaatggtgccttcaatccccgggaatggacgcgccaagtccggccaccaaccattgccgccggccgtggttcccgccgccgttcccgctcctcccgtggccggctccctcccccatcctataaaatgggatcctcatcccccgttctctcgttttagccccatcccgagcctccccgtggtccctagctccctccctaccgtcgccctctctctcccacgccgccggccgcctccagccgccggtgccgcctcgaccgtgcgccggccggccgcgccgtcgcctcctccagcgtcgccgccacctcctccaccccggcttgccctccgtttcgcgaggtgacccccggagctgccttcccgccgtcgccctcctcttttctccgcgccggccgcctccagccgcctctcccgcctcgcccgtgcgccgtccggccgcgccgtcttctccctcggcctcgcagccaccccctctccctcggtcagccctccgtttcgcggggaaaacaccggagacgcgttctcgccggcaaaacagtggcgttgccgccactgttccacctccggccgcctctgccgcgtccccggtgcgccggccgacgtcgccaccacctcccccggcaccggagtgccgtcctctctcccggccaggccacggcgtcgcccgaatttcgccggaacgccatcgtctccgcgccggcctctccttcctcctcgtcggctcgtcgccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggccccggtcatcgtcgtcgtcgtcctctcgtcgttcccggtcgtcgtggcgtttgtccctccgtcgagccgttctcgttcgtcctcgcttcgtcaaggtcgctgcagcccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttacacctgttttataattgcaaagcttaattataataatccgcaaatctccatataacagcattaaacttcggatgatcatatcctggtcatacgagctccgaatcgacccgttcaagtctcctaatgtttgttacaacctaaagaactgtgtgctttctttttatgtgttgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaacaaaaccccatctagtggacactctatttatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcaggattgggtcggtactcttgtctatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttctaattcttaaaatttgctcaacaactaaaatgtgcaatggttggcctgggttggcttgggacgagctgggacccagggtcgggttgccagttcggtctgaatcatcgtaggccttgggttagggcaggttcgtgagggttcacggccttgtttaataatactgtgtagctctaggatcgtctttataaatggctttgggcaactaagtgacttttaaatgccgtttattgcaaaacttaacccctaaattattatctccttgtacccccccttgcattaattatgcatctccggtgtggcttgctgagtactgtggttgcactcattcttgctcaatctttcccctcttcagtaagagaagctttggagaatatgtcttaggtggagtcctggcttataccccagttgagcgcctgtgaagattgagccgtaggcccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagttggtatggttgatggctccgattgctttgatgtttgaccaaatctcttcctacgagatgatcttggtcttttcgaatcactagtttggttatcaaatcgttgaccggctaatcctctcttgtatttagccataagcatctcaaaagtgagcttcggctttttggtcttttggaaactagatgactcatcatttgcaactttatgatctttggccttcgcattattgattctagtcttgggccgaggatccccaataataacatttttccttttctttttgttaacatcaataggactaatagggagaggattactatcaattccggtcttaggcatagatgtaactgaaatcgtttcacaagtgaccgatgaagtatcaatcggtctttgctccatcaagcttgcatctttgaaataatcttgaaacttatgctccatttgtgaccatgtagaaattgaattaggagcaagcaaactataccatgtagatgcaaagtttgacaaagaaaggggaaacaactttaacttaagcaaatcatcgctactggccttaccacattgatcaataaatcggccgatatgctccattgttgttctagcatcctcatctgtgaatttcgtgaagttgggcacctcaaatccttgcgggtatgggaccgaatctatgtgttcaggatacggcctttgatatgtatgcataactattttagattctatctcattactatcccgcaagacattatcatcatcttttccaacatccacatgaccgatttgtgaattggtcttaggtgacaatgctatttcactttcgcttgtaatacaatccaaactgtcatttagttcggctatatcttcgatgatgctattgtctaagctagcaacacaatccgaatcatcacttgaattggctattccatcattgtctaaactagtaacacaatccgaaccaacacttggttcggctataatggttgttgcattattatccaagctagcaagacaatctgaaccaacatttggttcggctataattgctatggcatcattgcataaatcattaacacaatccgaaccatcgcttggttcggctatacatgatattgcatttttatctaaactagcttgtaagctattgttatccactcggctttcctgagccagagcttcatgcaacacatgatcaacatcaagaaatatctggccattcaatttctctttaatagaatcaagcaatccatcatatgcaatgtcggccaaatctttgtcagttattttcaaattgaaatatcggtttttaacatctctaaacctttcaatataatcaacaacagattcattgtatttgtgcctaaccgatgttaaatcagacaacctaagctcagttttagcagtgcaaaaatgatcatgaaatttttgttctaattgagcccaagtataaatagaatttgccggtaaagaagtaaaccatgtaaaagcagtaccggacaaagataaagaaaacaagcgcaatttaaaagtatcactattagcctcaccacattgcgctaaaaattgacctacatgctcccatgtggtcctactatcctcaacactaaatttggtaaattcgggaactctataattacgaggatatggtacattatcataataatcaggatacggctttttgtaagatctagcacgattcctaatttcaatcccgaatctatccctaataatatcactaattatatcctccatattatcagacctatgttgatttggtggtggatttagtgtcctaataggttgtgtttgcggcgcaatatggttatattggccttgtctagtatcgggaggataccccctagcaacatcattataagcattaggaacatgtgggggaacttggggactatttgcagcagtagatacaggaggatcaaatgttttaaaatgatataaataactagcattagtcattggatctatagcctgtattgggacaattgcgccggtctgaccggcccagggcccggtctgaccggcgtcatgatgtgcagtcggaccggcctgagagccggtctgaccgccggggtaatacccggtcggaccggccgtctggctggtcggaccgacggctgtgtagcggtctgaccggccgtcaggcccggtcggacaggccgtgaacgccgttccgtcggttttactacccgtttgatctataggaggttgattagcagtggtataggctttatcctttaatgtgtaatcattcataagagggccgaatttaatccttaaaaacccatcaaatttatccttaaacattacatctaacttatttttaaaagcaatcgtagatgaatctattgtagatgctacttgttgttggatagattgtattacctcgtcattgcttaccaaatcgggagcgagcttaggaaggcccgggcttgatgatcacgccttgacgagtcctagtgcacgccctcatcaacgcctcctgtgtgatctccttgatgtactcctccatggacttgcggtcttctccttcgaaatcatccaatgtgaccgacatgatctcgttcccgctcatcatggttgatgaagaaattccttgattaaatccggccatatagctcatagccgaaatatttgaccgaatagattaatatatggtcttgatatgttactgtgtttagccaattttattaaaactagcctttgttgatttttctggacgtaacagtaacttcggtactgtaccaaaatataccaaagatcaaccgatcttagattagatcggctgctatgttttttttttttgggtacgtgagcagtaatagatcggctgtgatagcctgatccttttttttcttctcttcttttacacagcaaaccgaatagatttgatactcaaaatttctggccgtgcacagcaaaactctgccggccctgctactgcttctcctcggtcagggtacacgcgcatgcacctgtatacgacgttgctacgacttgatgaccctaagcactaagcggcagatgagacacgtcgatgcagatcgcagctgtagccgacaagcagatggcgtcgatggcggcgggctgctgcagatcagtactattgcaatcaatttcggccacacggccgaaagttgcctcaactcgatgaaacgatgacagtgtagattgatttcggctgtttagccgaaattcttaattttgacgaaacagttattactagattaaacaaaattcggccgtgatatggccgattagatcgttccccagcggagtcgccaaaaatcgtgttggcaactttttgtgacaagtcgacaagcacgatcgcagcacctaaaccccttgcggtgatcctagagtcgccaaccacctcgatctagctaaagggccaaatcaagatgggttttgttgaaaaacagctaaaccagctagcggagccgatttagagatcaaaatcagcctctaggccgatttagatcaatatgaggataactacccgtctcgtgggcaaaacggaaggttttcaggacaaacctacaaagaggtgttgcactctcgcagcggcggcggacggtttacggcgcaaaccgacaaagatggactaaactagggtaaaatagaaaacatagtaaaagaacgattcaagtagattgtattcgggggttttacaatgaaccggccttgtcccttatataggggttggtcttgccctctacaggcccttctccacgtccaactcgggatagaaactaaaggaaacacgaaacatgccttcccgagcaaggaaacccgagacccgacgaaaatagagtcggactcggaccctgacagtctgaccgcccacatacctgtggtcagaccggccctactagccgatcagaccgcccacatacctgtggtctgaccggccctagtgaaggaaacccggcactttccaaactttggcaatttttccctatttcgttcataggtgccaaatttggatgtaaacagcgcagtcgaaatctagtcgggccatgtctggagggacctctagcgcgtcccctgtgacggcatctaccgacatcattcccgcgatcgggagtcgggaggcgacgcccagcggccctgccagcgatcccgctggaggccgtggtctgccagaggctatcctcacctgggaggagctccaagctgagatggggcgtcttctcgaggccggtgctcgcggcattggccgcgaggtctcgtaagctagggcggagacggcggcggccaacgcgcgcgctgagcgcttggtgcgggaactggccgaagcccgtgaggacttcacgaagatgagggagctggtggccggcaacgagcgctagcgcaaagggctcgaggaccgcatgtcggaactcggggataacctctccgagatccgaggttcgttgcgggtcacctacaccggtctccaccaacttgccgaggagtgtggcatcaagtccacgattccggcgaaccccgacgagttttcgttgacctcttctcttgcggagctagcgacggcgatggggaaaattccctccaagcacgcggccaggatcgcggaggagtcgtctaacggtatctataccggggcgtgtcacatcctcgcttgcatgaagttgtcgcgtcctgagctcaacctgcgtgaggtcttggatcagggagcggcaagcgacgcgcggaaggaggtgatggaggaagtcagtgatctgggggaatctgtcctcccccactttgaagagtaggacctcttgtatttttctgactcgtaaattttaaactctggttacccttatgcgcatgattgccatctttgttcaccgttgatctcggaagtctatcttgtcgattgtagagatgccgatgatgaggatgtccagcagcgcgggcagcctgagtcgctggcaataattccggtactcgagtttgaaccgcacgcatcgcataacgtcgaggaccaaactcttgacgcggaggtcgaagtgacagcaactggcccgagtgagtgatcctgtcaaccttgatgctgttttgggggtttccgagttatcttagtagtcgttatgtttagcagatctcgaggattcccttgcgacccaagatcgtcgtatccaatattggaagacaaaatttgaagtggtggaactcgagagggcaatgctggccgtgaagaaagatcaagctgtggaaacgctccgaggccgcgaggtgtggttctcatcttacttgaagagttgttgcacctcgatggagagggtgtgtcgggatcttcgggtagcccgcggtgatcctgaaaaatcggcggccgggtacatctcgtggctcaacgaggcctgcgcccaactcgatggcattggtaagcgtatcgacgaggccttgaagcaagagtgttgtcgagcgagccgatatgccggaggacatgtgctggcttgcatacgagatcactgcccacgcatggatcttgaatttctccgcgaaggttttggtcgttctcggagggatccggcggagatagaccatctcgcgagatcgatgtcgccgttggccgagaagattttccaatcaatggactggcgttggccttcttggtaggattcgtaccctgcaacaagatatcttgggaaaagatgtaatgtgacaaaatatttatgtacaaattgtaaggaatattttgtgaataaagaaatctatctttaacaaatgtttcttactcagggtgtcgtgtgtaaggccgtgttctcagttaacgaccttagttagccgtttgagttgtacactctccctagcccccagccttgtcgtcggagggatgtcctcgggtggcaaggctcttggacccctggcctgtcttggttgaataagctctgatcctagcccccagccgtgaagttggaaagattggtttccgattacacggtttggttaatacgcacggcgagaactcttacacgaccagatcttacatggtctttcgtctctgaaggatctgacaaggccttatcggctctgggcatctccagccgaagatcccttgggttcctcggaggccttgtcgagacggtgtaaacggacataaggacaggtttcaacgctaggcgtcgtcagagtgaggagttgttgggtgaaaacactttggtcattatatgagaccaagaagtagtctttattgatactgtaagggtgcttacaggtacaatggtattgactcatacatagaatttacgtagttggtcaatgttccatgaatttgctaattcgcgaccgtcgccgtctgcgattttgtatgcgcctggccgcaaggcttgtgtgatcatgtagggtccttcccattttggtgagagtttgtttcgccctgcttaggtttgaactcgtcggaggacgtagtcaccgatcgaaagtatgcgtgctcggatgcgcttctcgtgataacggcggagggcctgttggtagcttgctgctcgcacggcaactcgctcacgatgctcctcgagaaggtttacatagatgtctcgctgttcatcctgcttcttgtcggaatgcttctgtactcgtgtactttgatgtcgtagctcaccggggagcatggcttcagagccgtacacgaggaagaagagtgtttccttattggacgttgtcggtgtagtgcgcacggcccatagtactgatgggagttcttcaacccattttttgtcatgtgacatgagtctgtcgtagacgcgggtttttatcccttctagtactatgtcgtttgccctttcgacttgtccattgctttgagggtgagagaccgaggcgaagcatattttgactcctaagccgatgcagtaatcttggaaatcggcgctgatgaattgggagccgttgtcggttatgatgcggtgcggtagtccgtatctgcaaaatatccctctgatgaacttgatggcgttgtcggccatgatttctccagtgggtgctgcttcgatccatttggtgaatttgtcgatcgctacaaataggaatttgtagccgccttgtcctcgtgggaatgggccaagtttttctagcccccagcacgagaacggccaaatcagagggattgtttgaagcgcttgtgcaggtagctttgtgtgtttgctgtggaattgacaggcttcacatcgctggaccatgtcgcatgcatctttgagggctgttggctagaaaaacccttgtcgaaaggctttcccgaccaatgtccgaccggcggcgtgggacccacatatgccttcgtgtatgtcgaggaggagttgtctgccgtcgtcggtagagacgcatttgagaagtatcctgtttggcgcttttttgtataagtcgttgccgatcatacagtagatttttgctttacgggttattttctcggcctctgtgtcgtcttcgggtaactcctcgctgctgatgaatttgattaatggggtgcgccagtcatccgttgtttcaatgtcagccacggcgcgttctgccgcgatgacctccgagctgatgtcgagggtgcttgggccaacttcgccgcttacttcttttaccgaaggttttgtcaggatgtcgagaaaggtgctgggctcgagcggttctcgtctggatgcgcgtcgggctaggtcgtctggctcgacgttgtccttgcgatagacgtgtcggacctcgatcccgtcgaacctcttctcgagcttcctgacttctgcaaggtacttggataactcggggttagagcatttatagtctttgtgcacctggtttgcgactagctcagagtcccctttgacgattagtcgcttggcgccaagtgcggctgcatctcgtatcccggcaagtagtccttcgtattctgcagtgttattcgttgctctgaagttaaggtggattgcgtgtttgaattgatctccggatggagatgttaagataaatccagcgcctgctccttggctattgagtgcaccatcgaacgccattgtccatgtctcattgtcgccttggttatctgacttgttatctggcatggtccaatcggccacgaaatcggcgagtacctgagatttaatggctgttcgcggcacgaagtggacatcaaattggcttagctcgactacccatttcgcgatgcggccgacaacgtctttgtttctgacaacttcgccaagagggaaggaggaaacaattgtgaccctgtgggcttggaagtagtggcgtagcttccttgatgtcataatgactatgtagagcagtttttgaatctgtgggtatcttgtctttgcgtcatggagagcttcgctgacgtaatagactggtcgctgtactttctctcgctcgacgacaatgacagtgctaacggagtgtggcgtagcggcaatataaaggaataattcttcattaggttggggagcaacgagtacaggggggtttgataggtagcgcttgagtgcaataaatgcctcttcggcttcctgtgtccatacaaatttgtcttgtttcttcaataaggcgaaaaaaggttgtcctcgttctaccatcctagcgacgaatctgcttaatgctgccatgcatccggttagcttctgtacctccttgagtcttgtgggcgacttcatgttctcgattgctttgatcttctcgggatttgcctctattcctctgccagaaacaaggaatccgagtagcttgcccgacggtactccgaacatgcacttctctggattgagcatgaggcgatatcgtcggaggttgtcgaacgtttcccggaggtcatcaatcaatgagtcgcttgtcttggttttgacaacgatgtcgtcgacgtacgcttcgacattgttgccaagctgattgctaagtgcgccctggaccgtgcgttggaaagtattcccaactgttatcaatccgaagggcatcttgacgtagcaaaataccccgaacagtgtgatgaacgttgttttttcctcgtcctccttcgccatgctaatttggtcgtagccagagtaagcgtcgaggaagcttaatagttcgcatccgggtgtcgaatccaccagttggtctattcgagggagaggaaagtgatccttggggcacgccttgttgaggtctgtgaagtcgacgcacattctccattttccattggctttccgcaccataactgggttgacgagccactctggatggaggacttctctgatgaagccagctttgagaagtttgtcgagctcttctcgtatggcttgttttcgatctggtgcaaatctccgcagtctttgttttactggcttggtatcgggtcgcaccattagtttgtgctcaatcacctccctggggacccccggcatgtcggacggttgccaagcgaacacgtcggcattgtcgcggaggaaggcgatgagcgcgagttcctatttctcgtctagtgtagccccgattttgacagtcttgtcggggttagcactagagagcggaacgatcttgatggcgccgtccggcttcggcgtcttgtttggcttgctcactttcttgggtggctcaaacatggcgggtggagtgggcgtttgctcgaccatgtcgaggcttcgcttgttgcactgcaccgccagctttgcgttcccttgaatagtgattgttcccttcggtcccggcatcttgagcacttgatatgcgtagtgggatgcggccatgaacttcgcaagtgcagttctcccgatgatggcgttgtaagctgtatcgaattcagcgacatcgaaggtgatctgctctgttcggaagttgttggcttggccaaaggtcacaggcagcgtaatcttgcccaaaggtctggatgatgattggggagtaattccatggaagggttgatcagttggtgtcagctcactttgtggaattcccattgcatccaaagtggtggcaaaaagaaggttgatcgagctgcccccgtcgatgagaactcgtgctaccttgatgttccgaatagtgggttcgaccacgatcggataccgtcccgggataaccgaggttttgggatggtctgcttccgagaactccatcttctgctcagaccacttcatcctgggtgcagccccctgccatgtcgaacaaacttcgcgttccactttcttgtattctcgcttggaggagtacgtcatggagccgccgaagatgtgtgaaacatggaggtcggagtctgggtacgcgaagtccgattcgtgaggaggtgactcctcgtttttctcgacaacgcgtactcgcttgcctttttcaaacgccatgtgcttctcgggcgactttttgaaaacaaggcaatcctccagagaatgtctatctgttttgtgtatggggcaccaagatttctttgtttcgcttccttgtgggtccgggtgcttgggagggttcgcgtattctgctgcgaggacttccgcttgagctttccttttcccgtttttgcgatttttcttcttgtttgactcagatgtgtctgcagctgatttcttctctcccccagtcttcggcttgtcgttcttgcgccttagtgcatcatccacgtgggcacacctttccacgatctcgaatagtcttcgagtagttgtgatgcgtcttgttgccaactcctgggtagtgtagcgatctctgacaccaaacttaaaggcgcgaattacataagcgtcggtgatctcggggatggtgttcctgcactcgttaaagcgccgaacgtattccctcaaagattcccctgagttatgtgttaacgcgtgaagatcgtcttcgatcgcatgacgcttgtatgttccttggaaattggcgacgaactgctgccacaggtctgaccacgaagaaattgagtaggggggagatacatcagccacgaacgtgcagaacccttcaacgcggttggtaaatagtttgccaacgcattgtcatctgctccagcggcataaatgtaacatcctgaaaatgtgtcattttctaatcctgcatcatgccgattcttatgtttttaataacctcctaaacttaggacagtataattagagggacctcctaaaactaactcgcacaaaacctctatagtatttaatctcttttgtgtttttcattttaaaatatatatttggttaaattgaggtatttcttgatttggtttaaaaccttcttttgacaaaaattcttttattcaaatttagtttgaaaacccctttctattttttatgaattatggtccaataaattctccactattatcctataacttaaaccaaatgattccaattggattcaattgtcgacccgtcctttgatcttaaacctatcctttgattccaaaccggcctattcttatttatcgccaaatatctaaattcttcattttgatctagccgctaatttaattcctgtggcttgatttctttctcggcacaagaatattattattacaaatattgtgaataattgctctcgtgctaagaaaataaattatatccttgtcacctaaatttccttttagcctcaaacaattccttgaaacctatgccatatatattagggttcaaatcctatccttttgcctccacctattttcctaccatattcccaaaaatattttgaggaatactattaatttccttttctatttgagtgcttccaaataaattccctcaaactccacctctaaatattgcactcaaataaattagaaaatctcttttgtgaattctctccgaattcaaattcttcgcaaaacctagttatccaaatcaaatatataaattagacttctttctttttgtcatcgggccgaaactccgttctttcttccttttggcccaatcctttttctttctattttcctccttcctcttgggcttccggcccagctaagccgagccggcccaagtcagcccacaacccagccgcctccctcctcctcccagtgcgcgtgttccacacgcgcacgccgccgcaaatgccgccgcaaacgtcgccgctaaggaatcaagccggcgccgtcttttcttccttcacgctagcatcaccgtgaccgagttgacgaccgcctccacaaccgcctttcatcgcctatataagaggaggaaccccctctgtttatccccgacatccgagcttgaagctctcctcttttctctctctagccatggccggccgtccaccgatctcccttaccggagcgttgtcggccaaatcctcgcgccactaaatccgccccgtcgaggtgattccattttgcccctttcccccttcccttttcttttgaatcaaaccaccaccgctactctatttactgccgcggccgagcttttgtcgccgccgttccagccactcacctcttcccctcttccttccacatacctccccgagttctcaatgttcgggaacacactttaccaccgccgtcgaggccgttccatcatcagtgcatcggcgccctattctctctctcccctctgttaccgggctggaaggaggagaagaaagaaagtgacgggaggaagaagaggaggagagagaaagaaaagaaaaagaatagaaaggctgacaggtgggccccatgaatagtaacctttcatattttctagatttaattcaaatcctattctttaaaagcccatatctcctaaaccgtagatccgattccagtgaaacttggacctaaattcatataaattcaaatgcttcattttgatgcctaattgctattttataattttatttgaatttattcaaatatcatttgaatttatatttgccttttgcaaatattttcttttaccccaaaatacccattagccactgaaaagctgccggttggaactttacgccttccacggggacgttcgtgtggtttactatcctcgacgttggactattggttgtaaagcccggcaaaaccaaacctaaggtcgaagtgctgctcctggcaccccacgcctcgatgcgtacagcggtcggagcttcactattccctcgacctccacagtacgtcgcgcagttagatctcgagctctgtgtaatcctagccgctccgccgccatccacggttgtcggagtaacacttccgcctcgctaaacttgcacaaacctcccatccctctagccgttatattgtctatcgacaccagctagagaagataccaaacctagtcgtcatgctttagcgacgactagagaacactcaaactctagccgatatttatcttacctcaatatcggcttaaacaattgaaaccatagttagcttattaaccagactccccgccagctataatctcaaccatttaccctccaactacctagaacatatacataaaatatagagcctggccgatatattgtcccactccacaatcggcttaaatatgactaaaccctaagtataatgctacccaaacctactatcagccaataccagtcacatatctgctcaacctgttcaattatccactatactccctatccaccaaccaatcagagcctgcacataaaatataggtgaccgtagccacttaattccctctccaccccaaccaccaactctttagaacccgcgtataaaatattagcctaataatccttataccctataaaggagataggttataccctaaaccctagccctctgtactgcttatctctttcttgctattttatggcttttattgaatttggttcttccttttctttagtagagtctgttatattttagatggcaacctgtggtatttcaaagatcggataatcaggttgcccatctcggatttatttgcgttggagcaaggcaagttattattcctctcctttgagcataactaccctatattctatatctctgttctatgcattagtcatacatgatttcaaatgcataacctgaacatagcaaaccagatatgctagattttgcttagccatgcctagttagattgcataaaatataataaacttagattgggacagtacggtagaaatggttgatttccgggtggctagtactgttccaaccgacataaaactgccaagtacatgtgaagaacatacgagtacgaccacaattctcgtatgggcatagacctagctgattaagttatctagcaaaggtggtacctctgtatagtggttcttcttaagtcctcgcgcaggaggcaaacttacgccgagcagggcgattatgatatttaccgaggcgcaggtaaatatcttgattatctcgcgagctgtgtgtgaattatgaaaacctgattgagatgacgggggtctctcaaccagttctctctgaaaaccccgggaacgccagaactcctcttgctgctgataacgttacgttcagagcgcatggggactagagttcatggaacaggtaccactgatgttagtaaccgaaaagctttgccatgacaaggctaatgtgtttggcacgtcatggattgcgggtaaagcgtacatctactgcagtatgaatattattaaaactattcaaatagccgtgctcgcggttatcgagcattgggactcacaatggcatcttggttagaaacataatttcaaactctattaaatactgttgcatatcaaacatttcaggatttctacttctttattctcagctttctgcaattaaacctagctctactcaaatattaccatttcatacatttattattgaatataatagcttgctgagtacgttgtactcacccttgcttcaacccccttttccagagtcattttggagttcttgccgaagccgggagttcaatcataagttagtctcattctaacttaattctcaaatatagattagatagatagtttaagtctatagcaaaacactagagttgagtcatcgtatagcttctactgtaatagttagccacaagtttgtaaataccctatcattttatgtaaaggaatctcctttaaaaccttgatcaaatgtatgcaatgaagatccagatcgttgaacctgtatcaatctactgatccaggtcttgatacagtctaaacatgtcggttttcgaatcattagttttgggacccgacaataaagcactgtcaagtagacttggaggaattcttctgggtcggtgctcccatcatacttttcaatagctccgggtcggaatctctcaggccatcggacatcacgtagggaacgaccgaaagccctgcacccagcgcttggagcggcgggttgtcggcggtcgcgtgaccttcgtggatcttggtctgacgatgaagaggactcggatgatgatgatgatgacgatgggtcgcttggttccggcgtacgattacgagggtgacgacctggatctcgggaatcttgtcttcgtctctcgctgttgtctcgacgccgatcttcttcatcttcgtcattacggcgacggccatgaccaatgctgtccggcccccgccggtcgcgatcgtcgtagtctcggtcctcgtttggacgacttcttcgatcatggtgtcgtgaggagacatgacgccgggagtggttcacgtcatcccgtgctcgccgtgcttctcgacgaccattgatttgatctcgaagatcgccagtaccacgaggtggaggggtagcttgtcgaggtgattctctccgttctagaatttcaccgttagcatcgccgacgggagatcggttttgttgggctgcggtggcggcttcttcgaacgcgttgctgaggttagtcaccgatgcccgtagttgttccgtccaacgctcgaggtcgtcgtttagaacaggatcgtaaggtgtttccctcagtatggcctaaacagccctgatgtgttgggctggggtagtcgattgattcgccgtctccgcgttggcttgtgctgacgtgccaacgccatcgatagccaacacctcccgcgccgcgtctgatatcgatgaccccaacgaatcgatctggggccggagtcgctccttgttccttgccgttatccctgacggggacgtatgacttaggagacggagttttcatagcgccgagtagaactttgcaactcgagaggtcgtgattctttgtcttatgaataggacaatagacgtcccgagttggagaagtacgttgaattccacgttctttgcaggcgcggatttcagcatggacgttgatgaatacccagcaatcttgaagagtatgtttcttggttttatggataggacaccaagacctggtagtttcggaagtcatctttgttggcccgtgattttcgtcggggggacaaggcttggccgcatcagaatccttcacgagtttgggtgtagtcggtaatccgttctctgtttcaacgggtggatttttcgacatgtaggcgtctcggttcgtagccactgcgttctcgttgccagttattgggggaccggttgagatcggcatagtggtgtaaaccgggtagacgatttcgccgacttgagtccataccagcattgttgaagtaggaagaacttcaccgaagctggtgttggcattgttgtcgacgaagcttgatggcatagtagtagaaccttgaataccaggcccccctacctggcgcgccactgtcgacgggggatacccgtagaccggatatagagggtattggggtacgctggtataaggatctacgtagtatgacatcgagcaattaaaagacaagaattatactggttcaggccccttgataggtaatagccctaatccagttgatatgggattatatggtggaaaacacagattacaaaggaaaagacggaactcaggggatttggcgagattgtagtcgagatgattcgactagctctcgtcgacttggctccttgcaggctccgacttcgtaggctgtgtgggttgtgttggctctgagattcgatgatctatgccctccccggggggtcccttttataccgtaggttgggtgctctccgagtaggactcgaacataccagacctggcacgatacgtaggtaacccaattcttgtccgaggaggtctctcttcgtccattgactttacgaagagtttccttagacgccaaaggatttatccgtgcacatgtgaataggccttgtcaatacgtgacgtatgtcgaggggtagagggtatgcctgacccgtaaccctgacaaaatcgaagttcgaacggataagttaagacctcgagaagttcaaattcagagaaaatctaatgacagaaagaaaaggaatattccaggaatatcctatggatattaattctttaaattgaattatttttaataagaaaattatagtggggcccactgattagtggctcaggttttggtggactcggtgtatgatgggtcggctggcgtggatgcctcgtggtgacacgtgtatagagatagatgacatggcaatgacgtgggtggatctagggctgatgtgccgagggaaggagttatggtaatctgactctaaagatttaagcaaggagatcaaatggctgtatgttcctcatgtttgatacccttggaatactctaagggaaagtgctaccgcggtattctgtgcgcctcagatttatctgtgatcgtatcacataccaataattgcattatagcggaattatagctagatattactgttatattcatataaatttagcctaaattaattcactttcactaaattatggatagttaaaaagagataatgaatatagatttcgacttgtcacgatgtgttaaaacatattagaaattcaatataataatactttaagagatattgtggccgggagatttgctaagaagcaaacggagactggagaccatactgaaggacgcacatttcgttgaggtgattttctcatggaactgaacccccatatacctgaaatgctatattctattttgggtttttttttccttatatataccatttacccaaaatacaatattctattttggggttttttccttactagcaatagtgtctgtgcgttgcaacgggaaaaacaccgtttgatagtgtgacaccttgaaaacctcgaatctgtaaaaatcttgatatattaatcaattcgacggcccgcaagctgagcagttgagcgcggcccacatatgcggggacggtccgatgcacttccgcagcccattgggcgcagcgtaatcaacggcggcgacagcccgacgctaggcgaatctgagccgtccgatctaatggacggctccaatcgtacccgcgctggatgaagcgccgatcggggagaggggcaaaaccctggctcccaaatccctctctcctgataccatttatctccggagacgagcgagcaaaacgatggcggtccggcaagctggtgcgcgcgtgcagcgacgaccgccgagcggctcctgcttcgccggctgggggccgcacccgagggcagcgcaaagccatgccacgacgtcggcggtccggttaggtggtcgtgcaaacggcgacgagcgctgagcggcttggacctcgtcggtggtaggggcgacaccaagccgacacttcccgtcttcggcaaaggacggtggaggggtgctccaggacagcgtgcgcaggaaacccgacacgactgcgaggaggtgaaggtgcggtggtgccgcttcccagaaagctccagtgagctcaggggcttcaagtctggtaagtaacccgaacccttagcttaattgatttggatttgactcttatggttcttacccgaaattagggttgttcgaatttagagaattttgtcgggaaatttcaatctattttattccctcttttcgagttaggggtgtttcaatatcgtttattctcttttaatttcgggaacttcaatctagtttatccctttgctcaattttgtttttttagcttgcgtttcatcgcgcaagcggggatggagggcgccgctcgtccccacggaaagattgaatcggactttcttttatttgttttaatgtttttttggtcctttttttcgttattacggacaacagaaacatttttaattttttaagcagtagagatagagaagatagagatatatagtaccgtgtcaaatataataggattcgatttttttaccgcgtcacgtataattcttttttttttggaatcggacatatttgttttttttattttttttttctcctttctttttacagcgtccacacggattcttttttttttggccggtcttttttttcacctgttttttttttcgcctgtttttttagaatcggacagattcctttttttttctttttgccctttttttttactgcggaatcggattcagttttcttttccctttttccgcccgtttttttattcttttttcgtccggttttttttgcccgttttgttttggatataggattgcatcggttatagtcggtttcgatggtagggattaatgtagggacaaacctacttttaaagcagattgcttttctcatattcaaccttttccacatgtggtaggtgttgtgtaattgtcttgagagatggacccctaattggttgctgcaattattgtctgtgcatgtactatttatcatatttatacaaaagatattgtacggcttgattcatactgctttcgtttttttaatagatgacgccgttgatttttttctcacatgtttgaccattcgtcttattaaaaaaaattatgcaaatatataagatataaatcacacttaaagtactataagtgataaaacaactcataacaaaataaattataattacgtaaattttttgaataagacgaatggtcaaacatgtgagaaaaaattaacggcgtcatctattaaaaaacggaggtagtatgattcaattttaacttatcgcacatcaatcttattactgtaattttacattatcatactcacgtattttcctcatcgtctcatatttataatgcagcccctcgcaacgaagtagacggtgttaataagcagtagcagcccaaggatgatatatgtaagattcttgtcttgtgttgtcacctcaataacctgaaacattgtaagggctcggtttgggaaaactggtagaaatgacgcttgacgggttgaggtagccttaggccccgtttagaccctcgggactaaacagttttaagtccgtgtcacatcggatgtttgaaaattaattataaatattaaacgtagactattaataaaacccatccataatcttggactaattcgcgagacgaatctattgagcctaattaatccataattagcctatgtgatgctatagtaaacattctctaattatagattaattaggcttaaaaaatttgtcacgcgaattagctttcatttatgtaattagttttgtaagtactctatatttaatactctaaattagtgtctaaatagagggactaaagttaagtccatggatccaaacaccaccttagttcccaattttttttccaaaaaacatcacatcaaatctttagacacatgcatggaacattaaatatagataaaataaaaaactaattgcacagttgggaggaaatcgcgaggcaaatcttttgagcctaattagtctatgattagccataagtgctacagtaacccacatgtgctaatgacggattaattaggctcaaaagattcgtctcgcgatttccaggcgagttatgaaattaattttttcattcgtgttcgaaaaccccttccgacatttggtcaaacgtccgatgtgacatccaaaaattttcatttcacaaactaaacatgcccttagctgatcacctgctggcttatggaccaaactgacccgaacacattttttaataaaatcataatttaattgtgtaggatagggaatctataagatatactcgatcagtctgaagtccctcactttaattactactccgtattttccttagcaagcataccattaattcaatataagatctatctttcttagagttatgcctatgtataaagagggaagctatatagcgcacgcgcgccaggaaaataagttgtgcacaggccttatccactaccaaccgattcccccctccctgcattcgcatggatgagacgtctagcgctgccgctattcctcctcttcgtcgtgagcgtgcacctccatctccaacctctccatcgagacatcatcaagcccagaatcggttcctctttctttcacactggtggagacaccatctttgatcggtcgcccaaaatccacaatagtcccggttcgaataaaaaccaggactaaagatgatttttagtcccggttaaaaactttttgacctaccaaccgggactaaagatcatttttagtcccggtttaaaaagttgtcgggtcgagttaggccccaactcatttttagtcccggttgggggctgcaggaa

SEQ ID NO: 33222 - DNA, 6203 bp, Oryza sativa
aacaaccgggactaaaaatggatctttagtcccggttgtttataccaaccgggatcaaaaatcaaccgaaccgtgcgccagtccaccgtcctctcctctctcattaattatcccttatcccttcgatcccaccgtcctctccatcccttcgctattagccctatccctctcagccttcctcctcctccatccattctcctctccccttcctcccccttctcctctcttcctcctcctcctccttccacgtgaggccgggctgcggcgatagggaggcgggcgcccgagcaggcggcgggcggccgggcaggcggcgggcaaggccggcgaggcccgcgaggcggcgggtggccaggcgggcgaggcccgcgcggcggcgagcagccgggcaggcgggcggcgaggcggcgctccccgggcgggcggcagagcccgaggtggcgggcagcggtgttcccagggcagcggcgctccccaggcggcgggtggcggtgctcccggggcggcggcgctccccaggcggcggcggagcccgaggcggccgggcgggaggccggtgaggcggcggacggccggcgcccgatctctgtgatgtagtttttttccctgatccgtgtgatatgtgcggtcgatctgtgcgatgtcgattttttttcgatctgtgtgatgtgtgatgtgtgaatgaatttgtggagatgttttttgaatgatttgcgatgtatttggagataaaaatgcagcttgatgtatttggggattttgtgaatgatctgtgatgtatttgggtttaaaaatgtagcttgatgtatttggggattttgggaaggatatgtggtgttaaaatgatttgtgaataatatgaatggtggtgctcgaaatcatgaaagcatgaaaaaaaaaagaaagaacattagtcccggttgttaactctaaccgggactaaatctttagtcccggtttttaacactaaccgggacaaaagatggatcttttgtcccggttatttcaaccgggactaaaaataggcatctttagtcccggattcgtagtcccgtttgtataaccgggactatagggggttgcgaaccggtattaaaaagggtttgtccaccagtgtcatctccctgccagctgcttcccctacctctcttcccccaccccttctcccgcccctccccctcctgatgggttcccctttatctctccttcagcatttgttcccctaccatttgttcccctaccccgattcctcatgttgttgagacatcagcgacttccaccacttctctatagatttatccaggttttgcgttgaattttttttggaatttgaagaaggttgattgaaagtttaggctttcactgcttcgatgaaagttctatgatttttgagatgaaagttttgtgattttgagatgaaagttcaagttttcaatcaaaaatattttcagatgaaagtttcagatttttaattaaaagttttgtgattttgggataaaagtttcaattaaaagtttcttttttgagatgaaagttttgggtttctaatttaaatttttataattttcagacaaaagtttcatttgagtcgtttttttcaattttgatatggaagttttagattttgagttaaaagctttttaaatttgtgataaaagttttagcattcttgtggtcaggtggcatcaaggaagaagaacaagctctcgcctctgaatcaatggggagtggggctgaaacatgcgcacgacagcgggcctcatgggcatgcttgtgcacctgcagcggagctgcgccaaagcgctaagcgctagcggtgtcttgacatatactctgtatgttgtcatcatccaaacacccccggtggtacttggatcatggactaaactgtccctgtcctatcggatgtttgaaaattaatttagagtaataaacatagactacatacaaaactaattacataaatgagagctaattcgcgagacaatttttttaagcctaattaatttataattagagaatgtttactgtagcatcacgcgggctaatcatggattaattatgctcaatagattcatcttgcgaattagtccagagttatgaaataggttttgtcagtagactatatttaatacttctaattagtatcaaacatccgatatgacgtgtactgaaaaatttttagccccatccaaacacccccgatatgcgtcactgtattgtgccagatagatgaatatatctgtttaaaaatttcagtcccttaacaactgacaaaaggacatttcaattaattatacaaaaggacatttcaactgttaagtgtgcatggatatgcgaagggacgaacagtagctagtactacactagagattttttttttaagtacagtaaaggtctagatctttgaaagacatacaccacaccataaatagagcacggtaccaagctaatgagtactgagcagtcgagctagtgcccagccttgcgttgaacatcacattacgtacgtttcagcaagcaggtgctcgatcgatcggccatggcaccgcccacggtgctcaactccggcgagcccgacgcccgacgccgcgagcggccgcacgtcgtcttcatcccgagcgccggcatgggccacctcctcccgttcttccgcttcatcggcgcgctgtcctcccacgacgtcgacatctccgtcgtcaccgtcctccccaccgtgtcggccgccgaggccgaccacttcgcccgcctcttccacgacttccccagcatccgccgcgtcgacttcaacctgctgccgctcgacgcctccgagttccccggcgccgacccgttcctgctccggtgggaggccctgcgccgctccatgcacctcctcgccccggccatcgccggcgtcgccccgcgcgccacggccgtcgtcaccgacgtcacgctggtgtcccacgtgaaccccatcgccaaggaccttcgcctccagtgccacgtgctgttcatctcatccgtgaccatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccacccgggactaaagatgatctttagttcccggttcaaatgctgtcagggtctgtcaggccctcccggtatctttagtcccggttgataacaccaacggggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgatagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaagggccctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgtttcctttcgagaggta

SEQ ID NO: 33223 - DNA, 1794 bp, Oryza sativa
  unsure (1)..(1794): unsure at all n locations
gggaccgtcttggtctatcgcgacattccagggatatgacatcaatgggtacacattctacacgagagcccaagacatgaagagcacgaaccaaaacagcgctgttctgtgtcgatgccatgggacacgatggaacaactgccacatattaccgtgccatcgaggacatatgggaacttgactatggtcctctcaaggttcctctgttccggtgccaatgggttaggttgactggtggaggcgtaatgattgatgacagtgggatgacaactgttgaccttaacaaggtgggatactcggacgaaccttttgtccttgccaatgatgtaacgcaagtctttttcgtgaaggacatgtctagcaaaggaaagaagggcagagggcctgatgagcctaagcgtcaagtggttctcncaggcaaaagaaaaatcgtcggagttgaggacaagactgacgaggattacgatcagttggatgggccaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactattgtatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaagtaattcccacgctaagtatatatgatgattacaatttttattaattttaaatcatgcagtatgtacatacatattttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagagaaaatcatatgcagtgctataatctttagtcccggttcttaaccctaaccgggtttaaaaagaatttcgaaatagcgggaaaagatatttactcccggttgttctcaacaaccgggactaaagatatctaatgtagggtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacg

SEQ ID NO: 33224 - DNA, 15187 bp, Oryza sativa
gacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcactgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgccaaggaggccatcaagctatcgaactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaaattccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtaaaatggagattcaaagggcccgacggcggagggttttcgatactggattcatcgaccctcggagagtaaacgtcgcattgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatatctatatacatatgcattaatttgcataacatatatatgtgtataaatacatatatattatgcatgtatatacatataatataatataatatatatatatatacatatatatatatgtatgcatatatatgtattgaaacatatatatgcatggtttatatatatatatatatatatatatatatatataaactatatatatatataaaccatgcagcaacagggccatgcaaaaaaaaatggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgatgatgtccctctgctcctacttccccatctacctcgacaacaaggatgcccaggccgacgtcggcgacgtcgacgtccccggtgttcgtcacctgcagaggtcctggctgccgcagccgctgctcgacctggacatgctcttcacgaagcagttcatcgagaacggccgcgaggtggtcaagaccgacggcgttctgatcaacacgttcgacgcgctggagccggtggcgctcgccgccctgcgggacggcaccgtcgtccgcgggttcccgccggtgttcgccgtcggcccgtacagctcgctcgcgagcgagaagaaggccgccgacgcagatcagagctcggcgctcgcctggctcgaccagcagccggcgcggtcagtggtgtacgtcgccttcggcaaccgttgcaccgtgagcaacgaccagctccgagagatcgcggcggggctggaggcgagcggctgccgattcctgtggatcctcaagaccacggtggtggaccgcgacgaggccgccgcgggcggcgtccgcgacgtgctcggcgacgggttcatggagcgcgtgaaggggcgcggcatggtgaccaaggaatgggtggaccaggaggcggtgctcgggcacccggcggtgggcctgttcctgagccacagcgggtggaactcggtgaccgaggcggcggcggccggcgtgccgctgctggcgtggccgcggggcggcgaccaccgcgtggcggcgacggtggtggcgagcagcggcgtcggggtgtggatggagcagtggagctgggacggggaggagtggttggtgagcggggaggagataggggggaaggtgaaggagatgatggccgacgacgccgtgcgggagagggcggccaaggtcggcgaggaggcggccaaggccgtcgcggagggcggcacgagccacacgagcatgctggagtttgttgcaaagctcaaggctgcttaattaattacaatgcatctaaagatagtacaagtactatagtactacaagctcgtagtacaaaataaaagcgtgcatgcatgcaggctgagtcgttgggtcttgatgagtgggtgcacgttcgtgtgtcgtgtctgtatactccgtgtcacgtgaagttggttgattctcactccctttgttcgaaaacaaatcaatctactacgacatataataaaccaacattggctgccatggatatatggatgaagttagagcttattatacctccgtcacagaatatatagacttttatttttacataatacaattattatattaagacagtagataaaatgaaataagaaaaaggttgtgattgaatgaaaagtgaagataggtaaaagaatttactaatggagggttgtgattagttgggaagagaatattggtagagaagttgtattttaggattgagagaatagattttgtgtcatgtgtactttttttttaagtttttctatatattttcaacaatttgttttctaaaaatttaacagatgtaacatgatgtaactacattgtaacttgcatataactataatttaacttccgcgtagttttgaaccgttagattttgttgcacaatgtgagaggatggaaaaaatcacagcgcacacatgtgaacacatgtgagaggatttactctcactttcatggaaatagcatgcaacaaagggactttttttttaaattgtgtaaaagtcacgtttgtaaatacatcatgattgtactacaatcacaaatgtataggcggtctcaattttttgggaaaaaacgaaccatttagcagtttagaaaatgtactaacagaaaacaagaaagttgtactccctccatccacaaaagttacacctattacttttgtcaccaagactaatgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaggatctaagcagcggaaaataaataaacggcgcagacggctctactccacaggcagcttgaccaaagctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccacaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtgaatcattagttatcccataaatgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagggtttattgcgtcagcgggctagggtttggtggaccgggcgcacgggcggcggttcacacgaacggacggccgagatcgaaccaatccaaaatggacggccgagatcgatcgggtccacggcggctcacggcggacgaccccgatgacgtcagcggtgacatcaccgacagcggcggcggctcggtggaggagacggctcgaacggcgcacgctcgccggcgaacggcggcgcgaggacgcaaacggagggcaccaagatgaagcgggcggcacggcgaactcaccggcgaccaaaacgacggcggaaggtcaacggacggcgacggcgacgaggaggaagcggcgaagctcttcggcttgacgacggcgacgaagctccgacgatctctggcgacggcgaaggggcggacgaggacggcgacgacttggcgagcacgacggtggtcttcccgagcgacggcgacggctgaaacgacggcggcgcacggctggagcgacggcggcgacggcaaagctagggcacacggcgctagggcttttccgacgacgagaggcgaaggcgaaggtggcgacgggtagaggagacaccgggggtccttttaaaggggctcagaggcggcggcgaaggcccatggcggcggcaacggcgaaggaaagctcggcttggagagagggaaaccgatccgaaacgaactcgattccacgaacttccaaaacgatttagccaaagattccaaaggagaaaaggtagaggagatcccggagattgtttcgcctcaaacaattcggccggagaaggaaaggaacggccggatttggaaaggaacggcggcggcggcgcgctagggtttcgggcggcggcggccgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaaacctaccccccttaaacagaatctcgtcctcgagattcggaagaactggcaaataggtgcggatgagctgacttcaattcatcttctcgttcccaagttgattcttcttccgagtgattactccattggagtttgcaaaaacggataactcgattcctggttcttctctcatttgtttccaagatacggattggtttctcaacataagtcaaatcctcttggacttctatctgttcaagattagcttcttcggtaggtactcttaaacacttcttcaattgcgacacatggaacacattatggactcctgccaaagattgaggtaattctaactgataagcaacctctcctcttctactgacaatcttataaggtcccacataacgcggtgccaattttcctttggtgtgaaaacgatgaactcctcgaagaggcgtgacacgaagatacacataatctccttcttcaaaactcaaatctctacggcgattgtcggcataactcttatgtcgagactgagccactcgcaatctttcttgaatgacctttaccttttcttctgcttcccttaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatgtacaattccgccaagcgacttccggaataggttgtctttaccggaataaaatgagccactttggtaagtctgtcgactatcacccaaatagagtcatggcctgatgacgttctgggtaaaccagtaataaaatccatacctatttcttcccatttccattcaggaatcttcaatggctgcaacaaaccggcgggtttctgatgttctgccttgactcgctgacaaacatcacatactgctacatattccgcgatttcacgcttcatacttgcccaccaaaatctttccttgagatcctggtacatcttagtactaccagggtgaatggagtataaagtatcatgagcttctttcagaactgcatcttttagatctttgttgtcggggacacaaattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttagaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcctcatgctcttctttggtccgagagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcatggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattgtgaactctatatcccttttaggcggcataccaggtaaatcatctgggaacacatcgggatactcccggactataggaatctcttccaaagttatttggttcagtcttgaccttaaagactcagatgacaatgcatgaacagttacaactcgaccatcatagctggtgagagttacttttttgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaaatgacgctgcggacgaacaacagacgaagaacctccctgtggcatgggctggggtcctaaagtaagacgcggcttctgattattcccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatgggcagggcacaagaagagaaaccggggaaactacttaggacagagaattactttaacttttattgatcttaactgagtttcattattacaaactaaagactcacacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcctgagttgctacccactcaatcttggaattgttgcgcttggattcttcttcttcatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcacgactttcatccatagcccacaacatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggaggtagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaccagttctacttttccaatatttttagagggcttctatggataaccatttggcataacctagggtcaacctggctctgataccaacttgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaggatctaagcagcggaaaataaataaacggcgcagacggctccactccacaggcagcttgaccaaagctacacctattcctccactccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaatgatgagaggtgtgagactaatcacgaaagacattgttagacccgcccataaccgcgggcacggctattcgaa

SEQ ID NO: 33225 - DNA, 17495 bp, Oryza sativa
tttaaaggggttcagaggcggcggcgaaggcccaatgcggcggcaacggggaaggaaagcttggcttgaaaagagggaaaccgattccgaaacgaattgatttccacgaacttccaaaacgatttagccaaagattccaaaggagaaaaggtagaggagatcccggagattgttttccctcaaacaattcggccggagaaggaaaggaacggccggatttggaaaggaacggcggcggcggcgcgctagggtttcgggcggcggcggacgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaatttcatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaactaaggagaaattaaatcatcttggatgttataaaatcaagtagtgaatgcaagcatgcaaccaacgagtatttagatgactcattgggttctaatcaaacatttaatttatctcatcatttaagtcatgaatgcataaagaccacaaataggaacaacttatttggaagaactcaaatgtgaaatatgtctaacttttatggatagagggagtaatttggagttagaggatagaaagtatgggtgtatctaccccggaccaaccaaaaaatttcctaacctaagacccatgtagaaaaatatagtaagaaagaactcatgtaatgtgaagcgcgaagttgaagtgtggtcgtctcgatgtcatgtcgtgttctttttttagcttcctcactatatcgtgttgtcatagcagtagtcatcatgccagatggcaactatgagtccgagacagggccagggaaacaaactagcacggcaaggatgcattgcgatgtcattgcaccagtcatcacgccagacgaaaactagaagtccgagatggaggcagcaaactggcacggcaaggatgggaggttatcaagtagtcaagccgacatgtcagcaaaccggaaagggcaaacgtcgtgacacggcgtccacgcctctgtggcagccagcagatagcaatgtcacaagggcgaccagggccatgccgtcaaatttgtaggccctgtacaagactctaagtgagacataaatcaagtaccaaatatagctaaaataatatatatactgcagagcaaatgcgatatatcatgaatagtatattttttaactcctgttttgtataattagaaactgtcaaactgaaaacggagaatgttcgttgttgttgctagcttgctgcctagcgccttgcttgttggttgcttgctaagttgctattcgctggttgaatgaaaatgtgaaattggatgagccggctagcagcctggtgctcggaggagacgagacgtcgaaactcgagatgaattgaataagttacagatatgaaaacgaaagagaatacaaaacgccgtggggcctcggggcttggggttgagaatacgaagcgccacgcacgcgaagtcgccgcgcggagatacgcgcggactcgaacagggttctggcgctctggcctcacacgaatacatgggccttcttcggttgggctaattttttgaggccctgtaaatttggaggccatgtacggtcgcacgggccacacgcccctgtgcacggccctgagagcgacgaacatcggtaaatttgacaacccaaacctcaaattatagatgcgccaccgatataaaggggcctagtcccaaactatatataaggcctatattttgttcatacagttattaatgatatgttttgaccattgacttattccatgttttgtttccaacgaatatgaaattagcatcgcataaaactattttaaaatatgaatctagtgatataacatgtataatatttagcataaatatgattagcatgattattatttaaaagtaaccgagtttgaattttcttaaaatgagaacgaaggggctacaaaacttgctgcatactccctccatcccataatataagggattattctcttttgggaaagattaaggatgaaaataaaagactacaatacccctactagatgtgattttagttgtggtgattggatagttggaggttaaaatagatagaaatttgaattagaattgatagatgtgacaagtaatatagcaaaattttttatattatggaactaatagaaaagataaaatatcttatattataaaacggagggagtatgctacatcacgtcatcactcctcatcactcagccgattgtgagcgagttccacgtagttggtctcgcccttctctaattaatcacaggtgcctctctgttttcctatctccaatcaatggctgtgtttagttcacgtcaaagttgaaagtttgattgaaaattggaacgatgtgattgaaaatttgtgtgtgtaggacagattgatgtgattgaaaaagttaaaagtttggaaaaaaaactttggaactaaacaaagccaatacatcatcatgccagtgacaaatcaaataggcacattaatgtcacgactcccaacctgctcattaaaccatctatctgtcccgactggtcatgtctcgattcgaaccaaaatgccagacatccatagttccacgttgcatcgcgcttacgctatgtatattgcatactctagggagtagggagtagttatacaacatatggtaatgtttttaaaaaacatttatgtataactataatataatcagattacaacattttgataatgttttttactataacatagtagttacaatttatatacaactcatatataacatagaaaaaacatgtatgcgacaagttgagtagtacgcattgagtttgtgtcgaggtttgcaataccgccggtcagggaaagatgcaatgtaattcatgggtattcaaaacgcgaattttagggaagaatctaatatcaaataatttgaagaagtgagacttcgaacccatatcatctagcccaccaccttatggagctagccgaaagacccctaagcgtttctctaattcattggtattcagctgaataaccatgaattctagacacaaatctaatacttattgcccataatgcatatgcacaaccataatctagctagatctatgatactatttatatctaacaatttaattccacccctttctagttgtccccagcccacaaaatcagtaagcccgttcctttctttgcaattaatgctgattgaattatcttcttcacatatcggctttcacagttaatgagcaattagttaagacatagttatctctctaagtttatatgcatctagtatatattagcaacagagcttagttgcagcttcacccacccaattgttttttttctatattttgctatgtaattgatgtccattttcatgtatgatgaagttatattcaacggccaatttcatatttgccactagttgaccaggtattgcgaacctgtcattaagggtgcgtttggttgcaaggatggggtgggatgggatggaacgaacccacttttggggttgtttggttgaggggtgagtgggatgggttggtccctggagaggaatattcctctcagatctaggaccaaccgatccgggaaattctggcggacgaactcgtcccagttgggacgagcgaacggcgtgacgacgccttgcttgtgcactcgccctgctcgagctcggggccggcctgcacgctcaccatactcgccatcaggagcagcggtagacaccggcgggctcggcgatgtcgacggcgaccgcgggcgagctcggcgacgatggtggccgtggtgggctcgacgacggcggcaaccacggggggctcggctcgacggccgcgggggctcggcgacggcgaccgcgggaggctcgacgacggcgaccgcggggggctcgacgacgacgaccacgaccgcggccacgggtgctcggcgacggcaaccacggggggctcggctaggcgaccgcggggggctcggcaatggcgactgcgggaggctcaacaacggcgaccgcgggggggctagatgacggcgaccacggggggctcgatgacggtggccacgggggctcggtgacggcgaccgctgggggctcggctcggtgaccgcggggggctggacgacggcgaccgcagggggctcagcgacggcgacggcggatccagtggtggggagggcggtggaggtggatccgcatcctctgcctgctcgccgccggcatgctccttcgcccacccaacacagtgatagcaaacggctgacggtgatagcaaacggcgcccatcccatttctacctcattccttcaaccaaacaaaagaattgggattgtcccatcctacaaaccaaacaagtaaatggaatcatcccaactaaatcaggaatggtttcatcccatcccacctagtcccaaaaccaaacacatgctaagaaaatgctattacatacttgccataaaaacggttggagcccaacatatctgccaccaaaaaggttggaatccaacatatctgccattagattctaaggcttgaaataacaccgttaggagttgagttctcatccaaatcaggacaaggatgtccctgcccacgaaattgcaggattaacgttctttggcatcaatatacaagaaaaatatcaacatgatagcaacaagaatacagtcaattatcaatgctgctagctgtcgctacctcccaagccacgtgctgttgctgtcgccaaaacctataaatgcgtctttagtactggttgataacatcaactcgtgctaaatatacttttagtactgataccttcagagttagttcataagaaaaacatctctattcaagttagatatgtggagtaggtgggatgataatgcgcgtgaaaactgaggtgagaaatcttgagtttgaacctcacattcccaatttttttttacttagtatgcatctttagtaccgattccttcaaccggtacttaaaaatcaagaactttcgtcttagtttacttgtctcatttactacaaccggtacgaaagaggatttagaaccggcactaaagatcatttttttactagtgtgtcgatctcacaaaaatcgatctccatgagttctctcattgccgtctctagatctaagttcattacaacctttttttaagttgatttactctttgatttgaaatggatcagagaatttgggaatttaggattgctgcaaggagaggggaggggatcggttcttgcttcgtatgcagtaagtcgggagagaggggcagggaggagataattttagtcaagggcaaatcagtcttattatgttgccttgtttcttcgcttagttttatgaagtaatttttgttcttttagttacactagtttaaatggtaatggcaaagagaagcacctcaaaccaacttcagtggcaaatttacaattcgtgttttttttaatgtttgtacagagttaggggtgaaagtagtgatatatttgtaattcttcctacattcaatttctagtagtttcttcatggtttgtgagttttcttccttcgttagtaaaaattgaaaataactttgctacataaagctagcaaacctatgctatacaatattcccaacttccgaaattcttgggtacttttcaatcatacttaaatcaataggttcaacacaaaaattcatcaactgaataaaaacagtttgatgccaattatttcaaatcaaagaaagttcaatccatacaagttgaagtaacagtgatgtataattgtgcattgcaccgtcaatgtatcggtcagtatcattatatctaaaaaagctactttagaattatgaatacccatcctacaaatcctagatctgtcactgccatcagtaaaccgcgcttaccatggaggctcgggaagggcaactagcataatgatttagcaaatttcacccgaatccaaatttgagaaaaaaatataaaactcatggaagcggtacttgaattgtataactagttaaaccctatatctatatccaagccctgaacgagtggttcgggtgcatagatatctaaatcgaacggctgaagatggtgacagccggatctgcagcgaattataaacaaacagttttaagtttccaaataaaattgtaaaggaataagttcgctttagttccctcatattaacatcgagtttgaattacattcttgaaccacaatatcatatataatgtgcacctcatctttcgaaactggtataaatatagtcccaaggtagtattgtagattgttttggctaatggggtgctaacatggcacctaaatcaaaacaaataataaaaaaccttatgagctccacataatagtgaaaacaacattttcttcctcctttactctcctctcttccccatctctatccaaatctccagtgtgcgaccaagagaaaggcgaccgacagggagaagggtgcatgacaaccaacagagaggagctgggtggcagcagccgtgtcaccaagctcgacccgcagggaggtccagggatctcctctctcgcctcaccgccacgggcctcctccgctcccgccgcccgtcctccgtggagtcaccatctactacatttttgtgaggaggcaggaggcatgcacagtgtcaccgtccttactctgtatccctgacgctgccatgacctaatcgaaccagccctggtcgaacctctcccatgtccacttggggtaccactcctggctctccatcgggtgctaggtctcgaggtcgcaccaccactcgaggatctcgaacaccaacatgctgaatagctgaagctgtacacgttgcacttatgtgtcactggcaacaatagctacagctctagcgccacgtagccccgcgtgccccgcacgccggtcatcgtcaggtgggtattgtcacggttgcagagcttggcaagccttgatgttagcaccctttgctccaattcaaatagcaaacatatatgcttcaacactcaaatatttggaggaacaaaagaagaaatgggggatacaagttgctagtaacacaggaaggaggaggaggaggaagaagagaagtagatcaacgagggatgcccaccggccgcccaggtcaccgccgccgccgtgagcctcagctcgccaaattgatcaatcgatgcccccatgttttctgttgctgctcatatatgctggtagtggtgcttgcttgggcctgggctggaacatgactaaccgagcccatggtgcagcctagtagaggccctgacaatcccctcttcttaaaatttggcttgtccccaagccaatgaaagaaacctcttggatcccatggtacctttagtcctttaggctgcaaaaactttgcttccagcagataactaattgttgatataaaagctgcattccttggtaaaatctgaatttgctctgtgataagataaaaaaaaatgcatgtttgatagattgcagaggctctgaaatcaccatcttagtctgaaagcttgcccaatggttgccactgaaatcttcatcttgtttcttgactaccaaacgatttctagcctccacatcccaaattaagttggcagctattgatttaatcacctggagcatggaaattgattcacatatagagagcttgagtgtgcgcctatatccttgtgcaactcttctatggtacagtagagctgcagcattaaggaactgaagcagaaccccgccagagtccaaatgcacctccaagttccatgtcagatcaaaccgaaccattatgtctgaacactgggacaagcttaatgacttgatatgctcttgcttagtgaaggaaagggcatttggaatagagtgaacttgtagcttggatagcaatgacctcaaagatccatcatgaattaatgcttttgggttaatacacatcttcccaggacttgcaccttcaaatatacattgcagctctttgttgctcaactgtctttccttcataatacgagcaagttctttagatataatacgagcaagttccatagattggctattcatatgatgcccctgcattgcaagaccatagacctctcttccctccatcccccatgccaaagaacttactagacttggtggaggccatggtttcaacccagccatctcctgtgttaaaatcacggttccaatgactaaaactccaatatcaaaaggctcccatgccaggaagcttactccagccggtggtggccatgggggcatcaatggtaaaccttccaaatataatttggatcctggccaatgcaaaggttgcaactcccatcgtctaatcactccacccaaccaagaaggtggccatgaatttctcttagcattccccattagcagcttcttgtctttgggacatttcatcgaacacccagtgggcagcaatggaataagatccatttcagccatcaaccatggcgagaagactttggatgatgcatcaggtactagaacgccctcgggcacacccatcatggtccgacacgtgaccctggtatggtctgcgccacccttgacatcaaggccaaccgtcgaacagctggcgggcatcaccttggtactatcaagggtgtcgatgtgggtgtcgtcggtggtgctgccagtagctaccatctccattgatgactccacagaagtggcacaagtaaccacaacagccacagtgagatcaggcttggtgtcggagctagaacatatcatcgaacacatagtgggcgtgaactcaggaaggtccttgatgacaatgaagggcatgtgatccttgccctcaccatcctcatgctccaggatgacagtcggagcagtcccctcgttgatgtagatggatctcgatattgtgctcgagctactatcattggggcattccatcaaacagttggtgtgcactggaaggggtggtgccattggtgttggagatgatgcacccttgaggatgacggtgattgccctgatggcagcaatcatttcctcggaaaccttgctcctacgaacctttatcttctccaacttttgaaatatctaattgatcttctcctcttgcatgcgcatggcctccatttgttcaaacttctccaatatccgatctagagctttgtctagccatttctcctttttgttcacggtagaattgatggggacaggcttagatatcctctgattttccttgggcatctcagattggctaggcattccatcgaacaggttgtgggtgtcggtgtcatgagcagcacccttgcccaaatctaacaaccacttgcatggggcgttgctgcagtactctcccatcaactccatgctagaaatcccatgaatcgacagctctgataccaaattgttagcaccctttgctccaattcaaatagcaaccatatatgcttcaacactcaaatatttggaggaacaaaagaagaaatgggggatacaagtttctagtaacacagaaaggaggaggaggaggaagaagagaagtagatcgacaagggatgcccaccggccgcccaggtcgccgtcgtcgccgtgagcctcagctcgccaaattgatcaatcgatgcccccatgttttctgttgctgctcatatatgctggtagtgctgcttgcttaggcctaggctggaacatgactaaccgagcccatggtgcagcccagtagaggcccgacacttgggcacgtagtacatcggcaatgagcagcaccttgcgcaacttgatgttgtaatgcatgatccagtgctggaactcctcgtgcaggtacctcactggccttgcacaccatgccaccgccgctgccatgctcgaacatgacgcagtcaagcgagccgttctcgaggtacttgtaaacaagtgccttggtggtggtgccttgatgtggtaatatagctgctcctcggtgcggcggtccagtgtgcggtgcagggtcttgacagccacctgtacaccgttggaaaacttgccgtagtacaccatgccgaagccgctgccaccaagctactacgctccgcgtagcccccggtgaacttgcgcagattctccggcgtgaaccaggcgggcttctcccggagtatgtcatccaggaagggttccacccagggtttaaactttcaatttcaggggaaatttcggtgatttcggtgaaattttcaggatttttggcacttttcagaccaaaatgttatgaaattttgacatattttgactaaatttgaataaatttgaccaagttaaacaaaaatttgataaaacccaaaaatttcggtcgatatattgatttgccggtggggtctgaaatttccaaaatttcgaaccaaaattgcaatcactgggtccaccgaccccatctcaacgcggacattgtgatgataatgaggcgctgtgaccgcggccatgctgttgtgcgccgctcgttcgtagcgacactgcccttctcccctctgattccgcacgctggagacttgaacagagatgaggaagagaggggacatgaggagagagagaggaggaagatgtttcactgacatgtgaggcccacaaggtttttcatcatttatttttgcttcccgtgctacgtcagtcaaaatagcctacaatactgccttggaactatatttgtaccagttttaaaagaaaagggacacgttatatctggcattgcggttgaagaatgtaattcaaactcaacgtgaattatcagggacctaagtgaacttattccaattgtaaaccagtttcatttttattttttctagatgggccttcacggctacttactcgccggttacttgcagcggcccatcatggcatcatggcccagagcagccaagcccagaagcagcccagagccgcagatgcagcaagtccctactccctagtcgccggctgctcgcggccattgacggcgattggcgaagtagtcgtcgtcgccggtggcggtggcggccggccgggtctctggcggacggcgcagcgacgtcatccggccgggtttgaccacgacgccgcgtctcgatcgagaaaacaacggaggtggggatgagggaatccgaccgggatccccgagcatattccgctcccggtccacgccccgcctgcaatcatctccatttcgttactagtttactaatactatacgtgtgtatttatacgcttgattcttttatttatttttctttgcctcacctgccatgatctgcatgatgtcatactggtataatattctgaatataccatacgtgttccagtgtcagaaattaagcttaatttgatttagctgttccctttgctggtaactaattagccgctgtgtgaatgattagtaggattcggatacagcgagcatgtataatgtatatgttgtctgaactttgctgtcacagtgcgttggtgtcttcctgaagagatcatatatacatatatgtatatgtatgttgattctgctgtgtgtgaatgatgtggcctactggcgtgttctgttccctgacaggttaaatctcatatccatatatatacatatactctctccgtttcaaaatgtttgacaccgttgactttttaaatacgtgtttgaccattcgtcttattcaaaaaatttaagtaattatttattctttttatatcatttgattcattgttaaatatactttcatgtacacatatagttttacatatttcacaacttttttttaataagacgaacagtcaaacatatgctaaaaagtcaacggtgtcgaatattttgaaaggagggagtatgtaataatgtaaatgtgcataaatacaagaagcatgtctttgtacagtcgctgttgcgtcgagttcaggaaaccgagctcagccccatccatccatctattcggttatctctctcaaaatttaaacacacccacctacatatatatacattagtagtactacattatattaactttgttactccctccgtccctagatatttgaccgctgtcggcttttttaaacatgtttgactgttcgtcttatttaaaaaacttaagtaattattaattcgtttcctatcatttgattcattgttaaatatagttttacatatttcacaaaagtttttgaataatatgaacggtcaaacatatttaaaaaagccaacggtgtcaaatatttagggacggagagagtatatccgaaaacaggatattttttcgcatatacgagaacgtggaattaattacaagcacatgaaataatcgtaccaaatgaatacaattattatagtacccgcgaaaaaaaaaaagtcaaatttgaaacgcgcacacaaacacatcctctacaccttcgccacagcatgcagtgtcatatcataattcatacataacccaacacctcctctcctcccctcccttcgtcttcatttgctgcgtcgccgtacgtcgtctcgctcgctcctccacatggccgaggagtctcgggaagaaggcggcggcggcggcgtcgtggaggacggcgacgaagccggtggacggccggggaaggacggcggcagcggcggcgccggcagggggagagatgggaacaatggcatcagcacgtgggagatcgaggagatggaggatgaggcagggccggcgtcgctggctcctcctgccgacggccgccgccgccgacgtgtacgtggcggtggggaagggcgggtcaagcatggaggcgctgtcgtgggcgctgcggcggctggcctcgccgcggagcttcgtctacctcgtgcacgtcttccccgtcgtcatcagcatccccaccggatgtaagcacacacccctctctgtccatactcttaatttgaccaacagctaattgaaacatgtttccatttatacatttgcctcaagaaaatctggcacatgtgtttctgagatggaactagtgattactacttaatttattggatcattaattagaaatacaaacttcctatacatgtatggtatatttgtctaaggcctagctcatacacttgttgactgtgattatgaagctgctttgatcgtcttcttgagctagctggattagaacaagggtgttttagtattgcatatggaaaattagagactattgatcaaagagtaaattaaaacggttaattcgaaggactgttcttgtgtttcagttggtaagatcacaattgggtcccagcaatctttggttggagattggcctgcagcattgttgaaatcaaggtcaagttcttggactagcttagggggtgatttgtctttgactgaatttttcaaagctggcattgtcacaagctgtagttccattctagctttgttggcatcctgccgtcctacgttaggcatattttgccccatcgcaaaccttgcagcaaaaaagctctagagctgatgttgactgcatggagaattggagatagaaacaataccacccatgtggtgtttggtttaggtgtccatgctaattctagagtgatcaactttccaaaaattctagaatgatcaccaaccaaggcatgtatgaataggaagagatatatatatcatgtccacaaaagtttcacgttaacagatgttacaaaaaattctaggaaaaaaattgaacatgtacttccaatagtattgcacgtatatataaagtatcaacttcaaattcattactccctccgttttataatattataagtcgcttagaatttttctttctaatacgaaatatatttaaaatataacaacattctaataaaaataagcatattatcaaaatatattcaatgttatatttaatgaaaatgatttggagttatatatattgctaaatttttctataaacttagtcaaacataaaaaggtttgactaaaaaatcaaagcgacttataatatgaaatagagagagtatattttagccataatagaaaaggaaaaatattatatatttaagagtataaatgtgtcagaaatttgtccttttttctctctctctaagtataatgaatttgaagttaggtgtgatactattggaagtgcatgtacatttttttttagaattttcggtgatatttattagttagtgtgcacgggacacttgtgtgtaccatgttcggatagacagaataaccctttttcagaacaagggtagtggaagcgagcctacaattctagttgattcagaggagttacacctagttccttctctatatgggtaattttaccatccataagaaaataccgggaggtaatatattttctagtataaaacccgttaccttcagctattagatattttagtatgaaatttagtacctatggctactttctcatcaaggaccgtaaaatttctctagataatgtaagggcttgttctttatgggtgatgtatagaattaagtgtatggaaattattcgagaatataaatgaatgaattaaatattaaaatattgaattgttggttttcaaaaagttttctaagaaatgcccataattaaagtttttacaaataaagtatggttttgaagcttacgaagtgtgccgtatcatctacaatctgtaagctggaaagaacacgacccttatgcgagaaagaactatatttgtttttgtcgatgcatctacagttaagggataatggcccatcagtggtatatttctaaaacccacgtttaatttttcgatttgacaaaaccaattataatttgctcggtcaggtacaaaagtacatcccatcacgaattttgcttcatgtgattccgcattaattttattctctgttctcaactccatatacgtggagtatattggatggcaaacagtagagtagactagtagttcgagtgttataggtctctgagatgccggcgtgagcagggcgagtactttgttacacttccactgaaatgtgaacagaccagtacagtgagattccgttctcgtagcttttttttttttctttgacactcgcacagcaattcatcgttgattgctgaatgatgcagacaggccattctttggcatggccagataggggagctgagaaggacgactgcctagagcttaggaaaacccagggctttctggtatatgcagagatatatactgttgtataactctcattttaggctagctgagcaatatagataactcaccatacagtaaaaaatgttaagagcaaatcatcagtacataactctgaagaaaccgttcggtttttctggagggatagggcgcgcaggatctatatttaaagtcttttcatttggacatcatagtcatggttgagtctaggatttatgtttccttctagcttgagtcgttgttaaatattaggctgcgtttaaatccaggggtgaaaagttttggcgtgtcacatcagatatacagacacacatttgaagtattaaacgtagactaataacaaaacaaattacagataaactgcgagatgaatttattaagcctaattattccatcattagcaaatatatttactatagcaccacattgtcaaatcatggacatctcgcaatttacatgcaatttatgtaattagttattttttcgcttatatttaatacttcatgcatgtctcaatacattcaatgtgatagggtgaaaaattctggcaggggatccaaacaggcccttatactactcccacacatgatgtctacaaccaaaaattggaatagtagctttcttgtcaagataatttgtatttttaaaattttcaattggttctgacgaaacaaatcatatattctgaagctctgctctcaccgtctgaatagacaaaatttctgattgtattttttttttctgaataatgactgtgcgcctgaacttttttaagtctaaacagattaagttgatgcatatcttctgatgaacttgacgtatgtctccttggatatctgaaatagtaggaatgatgcccaagagccaagcaagcccagagcaggtagaaacttacatgaaccaagagagatcaaagaggcgtgtgatgctacaaaaatatttagaccattgccgcaactttcaggtgaactggttacatcagatcttcacatttctgtgctcatacaacagcttgagatgtatctgcaaggcacatatagaaatccaattataattcctgtcatatcttcaggttaatgttgatgtgtacctcatcgagagcgatcatgttaccaatgcgatcctcgaacttattccggtctttcatgtacaacagctagttctgggggtttcaaaatccaaattgcggtaaggtttatataccttgcaagttccaattaacagaactaccaaaataatttgctggcatttcagaaatacattctgaatttgtctgaatgagcacaggaagttcaagagaggaaacacaatagcaggacaggttcagaagaacgcacctctatactgtgaagtcaagattgtctgtgatggcaaggaggttacaactgtgccaactgctgatccaacaccaccaatttcaccttctcctgtaaataacaagagtaattctatcagcccaacgccactatcacctgcaccagatcataacaatcgcgctgtggctgatgatgacaaaaaggagactaatcccaatgaaaggaataaaatcacaaaatatttgaaatgcttctcattttgatcttatacttttatggttgctgcttcagtcacttttgcagatatagaacactgcacgcatagcatcttcagacaacaaaagcttgtaaaaaaacactttcaccaatgttgtgatcttgaatttcttgattcatttgtacaggagatgatggttgttatatgggatatttccagcattttttctgcattgttgtatggtgaagagttgtgcttgattataatataatgtctagaaccacatgaaaaatgcagccaaaggacagaaaatctggcactctattatatcctcaatttttcatgtatagccagaagaccgaacaataaaacatgctaggcagacctccagttggcaacctggcaatcctgacatggagcacttatcattgatcatagattacagcatatgcatgtgacaatttattactccaaaaagaattgtcctagatgggttaatccaaaccttcatagcagacaggaatagggcataggaacacatggctatgtcaagttgtcagccaatcatgcattaacaaaataattgat

SEQ ID NO: 33226 - DNA, 3072 bp, Oryza sativa
  unsure (1)..(3072): unsure at all n locations
tgctgagtactaattactatgagaaatatagggtacacaaaactgagctagcactgcacaagccaaaaagtggcggcctttctttgactcacttgaagattaaccatttcagatctttgctgagaaatataaatctgaatgccaataagtttacttcaagaaaaacaggacatgttgacagaaacaaaaaaaatctacatactaatctgcaagacactacatgtgaaaaccctactcaagatgatgcaaacaaatggaaaaaaaaattattgagtcctaaaagaaatcgaattctagatagctatcactgcttttctgggcagcatcagaaggggcagcagcaggctccgatgttgaaacaggttgctttggaggcctctcaatctcaacaggcctgggaacctctggagggcttgcgcagcgtatcaatgcccagttcacaccctcaaaaaatggatgctgttttatctcagtggcaccacgcttacaacccaatctttgttggggctccttgacgagcaggcccctaattagatctcttgccgagaagctcacaaccgggtattcagggaagcgcagcggctggccaatgacgttgaacagtgttgcacggtttcctgaccctttgaaaggtgtttttccaaacagaagctcatacaagaatatgccaaaggtccaccagtcaacggcactaccatgaccctcgcctttgataatctcaggggccaagtactcatgtgtaccaacaaatgacattgagcgtgcatcactaggttccgctatgagctcaggccatgggctgacctgattgacaacttcaggctttggttttcgatccttctttgacttggagaaaaatcggggaccaaagcatgttgtgggagtggcacacgatggctgaatcatgcaggatggctccacacaagcaggttgaacacaataggcctggttgttcttcccaagtgcttctgcatcagggttagatgatctgatcagtgttgggctcactgcacagcgcagggagaggtcaaagtcagatagcatgatgtgtccatcctcacggacaaggacatttttccggcttcagatcacgatatatgataccaagcatgtgcaagtactccatagcaaggagtatttctgccacatagaatctgcgaccaagaagaaagtgcaatatcagtttactatgctatcttgcaaataagtgaattcaagaagtacatggaacaaaacaaatattccaaagatatgcataccacttttcatgctgttgcttagttcatgctatttgaggagttttagctcttgaatgtggatgtaagctgcagtttttattaattcttaaaaaaactacattgataaaatgaaatatcatggggtagaaattaattttgcatgtattgacttcacattgacaacttgcacaaaattatcatcacaatcagcttacatacttaatataatccatccaattacgcagttacactaacttaaagcaaaccataaccttttctgaattgtgtatccacgttttcgaaatttatcggaacagaaaaacaacaaatgaaaaagatagtgaaccctacaagagtaccaaggtattaatgtgtatcatgtgcattgagtaaatcatacgtacttgacagcttgttctggaaaatacttgccacgctgcctttgtcgaagagtatgcaggtctccaccagggcaaaactccataaccaggcatgagaacttatcagtctcnnnnccgatataacgttggaagaaaaggatgatccaggcactgcaagatttccttctcagtctgggctcgaagcaatttcttgcggcttgcaagtgatgccttgtccataaccttcatcgcaaaatagctcttcgttccactcagttctgaaaggtacacactgccgatatcaccacaacctagcttcttcaatagcttaaaatgactcacgccaaggattccatccctagtcctgatcatctggattgcctcccatcgtgaatcattccccttgtgaggcttggtgacgctactaatgctgctgcaagcgctttaatcactgacatcactgcttgtgcttggcctgcatctgctggtactgaaacctctttctccagtctaagatctcccaaccaacttggcacttccacttgcacttgttatcccatgctcctttcctaaagctgaagatgatttcaagcttccgttcgcaaatcccatcctccacaacacccttttcctcatttgcaagacgctttggaacaggttaccctcagcctttacttctgcaggatcattgctacccgtaagatcaatggactcattttgatgctgagttgatttctgctccttttgcaccacttcgggattcggtttgcttgattcagctgaccttcctggcaccaatgcacttcgtttactcggactggttgtctccaaagaagaatcattctgagaacacagtttcagtgactgtaagttgggagctgcagggggcgctcgaggcattgcctttgaagccattgctcccacaactgatacgtatatatatcagaccagattgcagaaagaactactgaccaatcaaagatttataagcttggtgttgacacttgccttcagaatctgcaaagggcagcaaaagaatttcaattgattagaacatgcctagatacaaaagaactgcccaaaaaaatacagaaatccaccaattcgatgaacaagagatcatcccccaacaatcccaaacaaaaaaaaaaacaaaataatcaagaacccaacctgcacacgcagatccatcaaccttcccacaggtccactacaacgagactcactcctcacaagtcacaaccgaagccacccactgattttatccatctaactcgctcaaaagaaaggcatcatcacaaaagctaatgtcgaaaacactgaacctgtccaaccgcccactaaccgcaatcatacaactctactgtctctacagatctatcgaccatcactccccccactttggaataaacaagtgctagggatcagcaaagatggcttgtcccatcaaaggc

SEQ ID NO: 33227 - DNA, 10142 bp, Oryza sativa
actaaaaagataaaaataataccatcattttgctcaataaaaacattcaattatggtcttcttttctcaatgcatgatatatgataagtatcagtatttatatggtatttttctaattctttcatattagtttttacatatatgttaatttagactaatattttttcccataattaaatggataaataaatcttttttctatatttatctaaaatattttaagtgtatgtaatttaatatgtaagatatggacttatagtataagatttatcttttttaaaaaaatgtggcaccatagtagatgggtagtttagtgaacaaccataagaaatacgccctccatcccataatataacacattcacctaaaatcttttattttatattatagtacggagggagtagagaatttgttgtatgccactgattttggccatattctatattatattaatgtatcaatgagtttgtcaagttctacaatatgccatcgtattttgtttaacttctataatataccatcgtcattcagttaggctccattagtgctattgtacaattttatcctaatgaccgaaataccccgtgatgaactttccaaatttggttaaaaattttctgaaatatcaaattataaatcttccaaagtttgagagcagcaagtcattgcaatggctgctgctgctgatattatacaaccaccagtcacatcaaaacgcaaactttctcgcagaaagccgagaggaaagcaagaataccaccaagaacggccaaaagcaagatgcctcctttcatccttttctgcaggaatgcagacgcagccatggaacctcgcgttcatcggacaaaacataaaaagaaagaaagggaaaaaggcaaatttgcagagaggctaagggggtgtatagatcaggcgcgtaaagttttggcgtgtcatatcgggtgttatatagggtgtcgtatagagtgttcggacgctaatagaaaaactaattatagaatccatcagtaaaccgcgagacgaatttattaagcataaataatccatcattagtaaatgtttattgtagcactacattgtcaaatcatgaaacaattaagcttaaaagattagtctcgtaaattagtcacaatttgtgcaattagttattttttaagtctatatttaatacttcatgcagttgttcaaccgtttgatatgataaggtgaaaaattataaggtggaatctaaacagagccaaaatcacatcccaagaaaaacagcagagaaataaacaacacgaaacaagaagagactgaggccctgattagttcccacgcaaaaacttttcaccctgtcacactgaatgtttggacacatacatagagtattaaatataggaaaaaaactaattacaaccgattgcgtgtaaattgcgagacgaatcttttaagcctaattgctccataatttgacaatatggtgctacagtatacaattgctaatgacggatcaattagggcttaataaattcgtctcgcagtttacaggtagaatctttaatttgttttgttagtagtctacgtttaacgcttcaaatgtatgttcgtatatccgacaagccaaaacttttcacccctaaaattaaacacgcctgaatctacaagagaagggatcgaaatggaaatactactcctacgctgctaccactacgactacgagagatcagtggatgagaaagaactgatcttttcactggcatttgatgtggattcgttctaagatcgcaatgattctgcctagtatatttggtggttgatgtggagggccttgatgtgatctcctcgcggatttgtccccccgaatgacatggccgccctgctccagtacaagaaactatccactttaaccttgggagcaaaaataagggcatgtttggttcgaaaatctaccaaaatattggtagtatcaaaccttgagcaaattttgacactaccaaatttttaatagtatagatttagctccactctattgatttggcaaaaattggctccaatccaaaatgctaacatgcattattcaaaactaccaaagaattagtaggggaagaattggcaccaaagaaaaatggccctaaatgggctagaacctggacccgagctgaactgctgaagcaagacacctctcagagcttttttaccgtagtgttcacaaccccggccgtataatttttttctcttaatatttatatatatatttttctcatactatattcaatgaaattagcacattgtgttgtcggttcgttaaaagaaatacctataatcaggtaaaattcatgacaataagtacttgttacatatatgtatatagtagttgcatatattatttgtttttactgaaccttctcttctttttatctcctttctttaacataaactagttgaatgctcttgtgttgcaatggcatttaaaaaggagaaccccgccgtacactctaaagcctaaaaactaaaattattcttattgtaaaatcttcagatcatattatttgtcatcatttttcctcacttcaaaagaaaattttcttgtttattgggttgaggttgagaaagtgataaaagtccacctatctcactatttggggagacttacatagtattggtagtgagtggtggcagatttaccattcaccaatatcattggtatttttaaaggagtataaatactattctagttctttctgataatagtaagcacttcatgcttttttatttctttttaaaatgatttcctttcactcgtaaggttggattagatcttaccgagaaaaaggggaagcattagaaaattttgagtaaatattgtaaaattgtagattatttctattaaattatcacaaaactacaaacttgacgatataacacataattacagatttagctataaacttatcacataattacatatttaagattgagtattagaaattgaaagactacatacttaaggcaccatattacaaaactaaaactacatagtagttcacattgaattgatatgaaactacagatttaagatagagtaatttcattatcttaaaaaaatcaagtaattgatactagtattttatgatgtaaacatctcataatagaatatcattccctattttgttggaataaaggccccaaaaatggtgggaaagccatgtgtgtaaattatgctgaccccacttaaaaatttccacgattatttgagacaaatcaagtagacgcctaattcaatggagtatatgaaacgtcatttttctagttggaacggtacggctcaaccaattagttggaacgatacaataatgtatatgacggttgtgcaacgtacacgactctccagtatcaatagttgtacagtcactgtaactgttttcagatgcaaatatttgtgagtatttgcagacgattcagggttagttgcagtgcttgtacattctatttgaagctttgggtaaaaagttaaaacttccggtatcaataaggcctctcacagtgcaagacacgcaataagggggcttagcctaaaaaagtgacctaaagacactcaagcctacagtgcaggtatcttcttttgagtgacctaacgagatgaagctactgttgaaggatacaaagtctacagtgggcataccctagcacatggggcactagcaggtgaaggaaatttaattcctcacctacccttctctttctctcagccgcgccgccccttcttctcctccctcccacgcctcttcgcctccttctcctcgacagcgccgcctcctccccgtcgacctcgctgcctcctccccgtcgaccgcaccgtctcacgcgcgcctcgccgcgcctcctccaccgcggcgacctcaagcagcggcggccaaggcaccctcccgcgtcgtctccgtccaccgccgccgtagcttatccgcggcggtgttggcggtggagctcggcatctctccggccgcggcgacctcgagcgggacggactccgtcggcggcggctggcctcgtctagttcgacgccaacggctgacctcgccacctcccgtgccggttcttggcgggcggtaggcggttcttggcggcggcggccggatctggagcaccggtgagctggtcctcctcgcctcccgtgctgctgtgcctcctcacctccatgtctcccgtgccggttcttggcgagcggcggcgagttcttggcggcgggttcttggcggcggcgaggaggaggggaggagtccccggcgagcggcggcgggttcttggcgagcggcggcgggttcttgccggcggcgggagcggcaagtcctccgccatcagcgtcgctccccacctcgccgtcgtcctcctcgtcgtcggaatcggagcaggcgggggtggtgttgcaggaggagtccgatctgttgaatcttgttgtgatgattttgctttcgttttcgttttcatcttgttgaatccgatctgttcttctcttccaatcttcaagattttattgcttatctatcaatccgatctgtggcgggagaaagaatgttgtggcgggaggggattttgggagggtgaatcaggaattttgctgccgcgtgaggggattttgggcgctaggccacgcgagcacgaggctgcgccgcccacagcgtgcgtgacccgccttttctcctcgctgcgcgccctcgttttggcgaggctttgcgtcgctaaggtaggggacgacgaacctagctaaggcgcggtccctccctccacggcggcaaaaaacctacgtggcatgactaagccactgtgaggggcctaaggccctgtttagatgggactaaaacttttaagtccctatcacatcggatgtttgaaaattaattataaatattaaacgtagactattaataaaacccatccataatcttggactaattcgcgagacggatctattgagcctaattaatccatgattagcctatgtgatgctacagtaaacattctctaattatggattaattagccttaaaaaatttgtcacgtgaattagtttttatttatgtaattagttttgtaagtagtctatatttaatactctaaattagtgtttaaatagagggactaaagttaagtctctggatccaaacaccacctaagtaaagcacagctaatgagccaaaagaagctctgtgtaaatactgccgggataaatttgtccggacatggtcaggatttagcaggctaaacgtaaaaaatttgctgtcttttctcgaatcttttgaaccctattttggccgtactcctatggatgaagtactccagcacagttctctctcattcaggagcattcatggcttctttatggcttggattctcatctctgatgcacggaagccaacgtacgtactagctgctcaaacgatgccaagattcaaacgagtccaaaaaaatctgaaaaatgcagagatcaaacttcgcctaaaaaattcaaaattcaaacgtgcagagttattgtatccataaatgtgggcaggtcagatagaagttccgtattcgctatcagtgcactccgatggcccatatcagcagccatcaatgcaggaataatgtccgacaccatatatgtaaaatttacaccatcattttaagatcagtacaagggacaaggaaggagaaagaagggacgaagtagccattttccgcatcgaaattttggttaaaaagaattttggagcactaatgtataaactgaaatacttactactttccaaaaaggcaaaaagaatagaattcagtaaaagcagagccaagttcttaaaaataatgaaaacatgtgtatataactaatacttcctccgtttcacactataacacttcctagtaggcactagcattgtctacgacattgtccacattcaaatagattcatagcatgaatgtagataacgctaggaagtcttacgtcgtgaaaccgaggaagtagtattttacggtggtccgtcggagtatttaccatatgtattattatcagtgtaacaatagagcatattgaaaaaaatatactaattaaccaatttcccatataaaaattaggaagcccacacaaaaatgagtcttaggcatgtgctcaagaccactggaagattcttttcttcttcctctgtcagtgcaggcctatgaagaattcctattgatggaagaagagctcagtcttttgcatttgtagccaggacaaggagatagctggagctttatttggaattcgggtacatacaattctaagagattttacaagctcaattttatgccccttcagcccccaagaccctatatttggctatggaagtcaaagtgtgttatgaaaattaaggtgtttgcttggcttcttttcagtgacatgctaaataccacggatatgcttgacagaaggcattgtgcaaaggagaatgctgatttaacttgtgtcctgtgtaatgggggtcaaagagaaaccgggcttcatctcttcttcacccgccctttcagtgttagatgttggcgacatctgggtatcacttggaatcagcacatggagttctttcaaatgattgttctatcaaggttgaactttgccagaatgggtttcttggaaattttttttattgcctcttggcacatctggaaacagagaaataggtttatctttcagaatgttgtgccctctttttcagtcatggagaagcctcttcaagaatgaaattcttctgcatatgtgcagaatgaaggagcctttagagcaattagttttttgattggttacaacctttataatccttttttggcccttgtaactttggttttctttgtacatatatagtttcttttttcaatgaaaatatactactagacaaagccctggtagtctttctagtaaaaaaaaatgagtctaaggctgagttcggaatttgctttgatggagattttctgcggcatacttaattcggtattaataattattataaacttgaaatatgggtttatttaatattttaaagaaacttataaaaattattaaaaatataccttaccagtttgaaaaacatgctcatggtaaagtggtaaaagagggagtagccaaaccaaaactcactaccgaactaagacttacacgagtgattgacgattgtaggtgtgtgttgatgcgaatgcccacctgcagtggaagatacaagaattatactccctccgtttcatattataagacgtttgacttttttcctagtcaaattttgttaagtttgacaaaatttatagaaaaatttaacatctaaaatataaaatgagtatgtttcagaaaactgcaacttttacgttatatgctactatagttgtcacctatatgtattgtagcaacatataacttttacattatatgctgctatagttgtcacctatatgtattgtaacagcatataacgtaaaatttacagttttatgataatttctcaagctattgttgcagcaaactgaaacatgccactaatgttgcagcaaattgatagttttgtcactaaaattacagttttatgaaatttactcatataaaattagtgtcatttaatttaacattgaatatattttcgtaatatgtttgttttgtgttaaaaatactattatgtttttctataaatttggtcaaccttaaagaaatttaactaagaaaaaaatcaaacgacttctaatatgaaacggagggagtagcacgaattattttccagggcataagcctgatttgaatctcctacattcttcgttttcaactgtgatttctacgacgcggaatcacgaaaagagcgtggtaacgaggcagtgcactcagggcatcaacggcctcagcgatcgccaaaacgacgacgaccgagtgcatcgccaaaaaatctacgacgacagagtgcatgggccgctagaaaaaggaaaaaagccttcctactcctcctctaatgccaccggcccaacacaaagcccaccttcgcacttacacgagtactgcgccaccgtgccccatgggccttgcgggttgggccgggaaaccacatggccatcacttctagcaagttgggcccttttaagctggaccaaactctggctgtttgggccgagcagaatcagtgaggcaaccatcattccaaatgtcacaaaacttgcaaatagttaactggaacgattttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttgtatttgatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactccctaactggaatgtgcgggggttgaattccgctgcgcggtgcaacacggtgcatgagctcgtgctggacacgaaatgcaacatggcatgttttcaggaaacgaaactccaaaacatggatgattcactcgccaggttctaggaggatacaaactggatcgcttcgacttcaaaccagctagagggacaaagggaggaatcctgctactttgggacagtgacacattaaatgtgcaaaacgtccgagacggtcgcttctctatctcagcagatgtcaaagtcatccaatcaaacactaccttcatgctaaccggagtatatgggcctacaaggcaccgtctaaaagatgccttccttcggcatataagaagactcaagccatactcgggagagagctggctgctcctgggagatttccacatgatttacagggctagagacaagagcaatgggaacattaaccttgcgcgtatgacccgcttccgcttagcccttgaccattgtgagctaaaagaaatccacttacagaacagaaagttcacttggagtaatgagaggcgacggccgatcatggtgaaactggaccgatgcttttgtaacgaggcttgggacctagctttcccccagcacatcctaaatgctctaccatcaggcccttctgaccactgtccgctactcctttccaatacttcagggccacggaaaccacgtcccttcaagttcgagaatttttagacaaggataccaggattcaaggacgttgttgcggcggcttggagcaagcagacgactcacacagaacccatgcatcggttaaatcataagctgcaaattaccggaaaaagtctgcgagagtggtccaggggaatctgcactgaggcgaaaatccaattccacatggcgcttgacgtcatacagcggctagactccgcacaggagcaaagagagctcacaacgctagagcactggctgagagcaggacttaaacgccgcctacttggtctggcaacgcttgaacgcgcaaggaagaggcaagcttcccgcgtaatgcacatcaaggagggagatgcaaatacaaaatttttccacctcaaagtcaatgctcgaagaagaaagaattacatccaaagacttcgcagtggaggtggctgggcggtgagccaccaagacaaagatgatgttatcttcgaacacttttctaggatgatgagtaggccagaaccgagaacatgcgatattaactggcaagccttgcatgccccaacgacggacctctcgcatctggacgatcctttcacggaacaggagattcatcgggcaatcaaggagatgccagctgacaaggcaccagggccagatggctacacggggaacttctttaaagtttgctgggacattatcaagggggacattatggcggtcttcgaatcgcttaataatctgagatgtgcgaacatgaacctcctgaactcagctaacatcgtcctgattccaaaaaaggaaggcgcggatgaggtgacggactacaggcccattagcctaatccacagtatagcaaagatcctctccaaaaccttggctttgcgactacgattacacatgcgaaccctc

SEQ ID NO: 33228 - DNA, 1134 bp, Oryza sativa
ttggaaggctgcgcaagacggacgtccaaccgatctttgataaaatagcaaaccgggtcaccggctggaggggaaaaaacatcaggccagcagggcgatcaactctagtcaagtcggtactgactgcgcagcctatctatttgctcactgccctcaagatctctaaggaagccttgggcgttctagatgcaaagagaagaaaattcctctgggtagggacgggggacattacaggagggaaatgcaaggtgaactggaaaaggacgtgcctcccaaccgcactaggaggactaggggttctgaacatggagatgtttacgagggccttgcgactgagatggctctggcatgaatggaaagaccccaccaagccgtgggtgggactagagacaccgtgtgatgaaacggacaaacttctcttcgctgcagctaccaaaataacaataggggatggaaacacgatctacttttgggagtccgcctggctggacgggcaaagaccaaaggacaacatgccgctcgtctatgctatttccaagaaaagaagcaaatcgctacgtgaaggcattgaaaatgacacctgcatcgatgacctggagctaaatgggaacactacttttacactggagctgatcagccagcttgtgtccctatggagcgcaacccaggacatcatgctaaaccaaaatgagtcggatcacatcgtctggaagctctcgaatcatggagaatactcggcctcttcggcatacaaggctcagtgtctaggaacagtcggcaccaacttcaatcccctaatttggaaatcttgggcccctgcaaaatgcaaattttatgcgtggcttgtgattcaaaatagagtttggacttccgatcgactagctacaagaggatggccgaatagcggagtgtgccccctatgccgtatgacgaacgagacggtatgccaccttttagcttcctgtagatacaccagaaggatctggagactgacggccaactgggtggcttatcagcaattgggagccatgccaaagcgtacacgaatggtgggaaatgctagccaacaaaagggaagtgcccaagaaagggctgcgatccttaatcctactcatagcctaggaaatctggaaa

SEQ ID NO: 33229 - DNA, 569 bp, Oryza sativa
  unsure (1)..(569): unsure at all n locations
agcatcagccatgccgagaagaagacgagaggcggatgcagaggacgcctctccattgcatctcatccggatgcacagcacgttctatcttctcgtctccaaggtagatcaggggcagtatcaggatgtatcgatttcttattgttcgataggaagatcgaatcagggccagtcctgacattttggaggcccttttgcagacttgacgctatgggccttggagttagcccttaaggagttatatctattttttttacttctaatacatacagtatactctataaagcacatataccatagagtgacacaaataaacatttttaacacggtaaataataaatcaagcagtttgcaagttgcgatagagcaatttaatctttaataaataatatcaatagtataattgacaactaaaaataccatagaaacaaattagtatgaacaccttaataggagaccacaaatatcccatgtcccttataaaaaagagccttttcgcgaccttatgagttatgtatagcacccgacaaatgtntctaggtaatattgtaacacctgaagcagtgaaa

SEQ ID NO: 33230 - DNA, 547 bp, Oryza sativa
  unsure (1)..(547): unsure at all n locations
gctctagccaaccgcctggaggtggcgcgctcgctcctcggcgagaacgactacaccatcacgcgctgcagatgcgggcccgtgtggcaaatcctccggcgcaaccttgtcgccgagatgctgcacccgtcgcgcgtccgcctggtggggaggccgagggaggatacaacagatcaacagcaactcgtgtttcctggtaacaactgcagagctgagcaggacacaagccgccgcaagatttcatcagtgataatcttcttttgaaaattaatcatcagtgataatcgagcagggcaggcgtatccttgagatccatcccctggaaatgcacatcctgcatgcacatcacaagcaagcaaaaataattcagtaatcacaaacctacacaaagcacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33231 - DNA, 1105 bp, Oryza sativa
tgctttccaaatcattggttggtgcagattttacatcttcagttgagtgtggtcacccaaatttccatgatctgtatcctgccgagaacttgacaagggtccttctcgatttccatctgataaccggttttcccgtggccatgaaagcatttctagaaaatggtcaaatctaggtctcaatgcattatcgatctcttttgttacaggggtggattgaaagaacataacaaggatcaaggcacatattaaaaccacaacaattatgaagatcacagacagtgatgttgcaacatccctgcaccttcctgcagcataagcaaaaatcagaccaaacagttcggctatgacacacacaaacaatgcctgagtccttatcccatgccggctcaattctgtgctcagaagtaatatgattgtgaccaaagatgccacaaaagaagttgcattggaacaggtgaaaatattgaagcggcgaaggttgtgcctgcgaagaacaaaagtagctggacggtagccatgactgttttcagcccaaaagccaccaggtggactcattccagcttggtatgtgatagtagcagcaaaagttgagagcatcaatatgaacttacgagcttcctcgatttcttccttatcattttggttgctcctttgcttcttggggagatgacaaatggttagaacttgcttcagcattctttgcagcttctgtacagtttgatgcataaatgtttgtacaccctcttttaaccattttggaaccacccttatgaatactagaatgtggattccaacatagaagaaaacagataaaactagcaccaatatataaacagaagactttagagctctgcaactccctgcagcataggcccccataaggctaaagaggtccaatatcatggtaacctgcatcgcacgaagccataaatgctgattggccacacccctacttagaagcaagatgattaagaccagagatgcagcaaaggctgttgcattgcagtaaaagaatgcttcatatcgctggaagaatttagatggaaggagaggatccccagcatgatggacagggctgtcgtccgtccaaaatccccctggtgga

SEQ ID NO: 33232 - DNA, 2706 bp, Oryza sativa
  unsure (1)..(2706): unsure at all n locations
gcattctatctgatgcacgacggctcctcagaaaagtgaaattggtttcaggattcgatggtagctcaatggtggtgaagaacaacaagaacagagatattgtgaacgatacaaaggagacaaagagagaagacctgctgaagtcaatgaccaaacaatgagaggcacaagagggttggcgcatgggactgcttgcttgaccccacggcaatagcaatgttttgttttctagcagcttgcccaagttactataaagaaattgagtgagacatgtaaacttgtaaatgactaataagttggaactaggggtggatatcgagccagctcggctcggctcggctcggtaaagctcgttaggataacgagccgagccggctcgttatcctaacgagctaaaaacccagctcggctcggctcgtttaaaagctcgagctagctcgttaagctcgcgagccaaaccatccaaaaactgcccctagccctcagcaacagccaacacagcaagcagccaagcatgcataatgatagtatgataaattgttacatgaaaatatcaaagcaacaaatcacattcacatattaagtaatctactcaaagtctgggattaaacacatttcccaagtccataaacgtccgcactccagtactccacagtcacaatgacacattctgagttactgacatagtgacatacatcatcagttcatcacatattgcaattaacttcaaaatagttcaacaaaagactgtaattaaacataggttcagtccagtacaataatccatgcttcaagttcaatagttcaatacttcaatacaccaatatttagcataagtgcatatctagtaaagctgcagcctgcaaggttcatcattttcatgatttcatccaacacagttgcacataaacacaaaacacaaatagcatggcaattggcagctccctttctcccatagtcccacactccctttctcccatagggtgtaggcttgtagcctgcaggtaaacaaattatagagtatgatataaatgggtgaaagtcataaacttattaaataaatataaattgtccctactagttgcttgccaccacacaattggggaagtccactatttcgatgtcatcatctccattttctccctatgaaaacagtccaaagtgaacattttatacaaaagacttgacaaaaataaagaataaaaaataatcattgcattacataccacagggataggtgcactattgtcattttgagaggctcttatccagcttgaagcacaaaccaaagcctgaactgtttctggcttcaaagaactccggtagtcatcaagaattcttcccccggtactaaaagtggactctgatgacacactgctagctggaacagccaagaacctctttgccatgttggacacaacaggaaacctatgggcatttaccttccaataattgagtaagttgaaagtgctatcttcgaggacacatttggttcatctagatagatgagtaactcagactttgaggattctttagcatttgactgcaaaaaggattgaaatccacttggaataattgaagccaatgaggtggtagtagagattgaggatgaggccgagtgaccattgtgtggactgttcccaccttggttgtggcgacatatccgctcatactttctgtagagtttttccatctcatcagttatggcagcaacctctgttacacaccttgtctcaccaaaaaattcactgaagcaccatctaatgtacctcattttgaacctagggtcaaggattgtagcaatgatcatgatattgtttgtgttctcccaatatttattgaatttttccaacattgcatcagccatagtcaccagcaatacatcattagggtcaggttcataaagtctagactgctgccctaaccttgcagcttctaacagtgcagtttgtgcttgtgctctagaagctaatattgcaatcttaactttagctatgtatggatagaaaacattggcagtggggtaggttgaccctgaaaatgcagtggttgcaccagacattgttcccaagattggctgaattttctcaaacaaatcccattcagattgtaaaggtagccattcatatttggtgtctgattcagcataataatcaaaaccatttctatactcaatgcatgtctctagcatccgataggtcgaactccaccttgttttaacatcaatagacaaccctctaccaactttaattgaataagtgttgcacacacccacaaacttatacatacgggctggagacttcttaaagtacttcacagtgttcctaacattggttatcaaagattgaatttgttgcaggccatcattaacaaccaaattaactatgtgggcagcacaacgaacatggaaataatctggatcaaactgagcattctttctagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33233 - DNA, 210 bp, Oryza sativa
ccatctggtactacttacggattttcctccacaactaagatgcctatgctgatatttgcgactttaacttcaccagtgtgatgcacctgccgacgtcctggatgtcgaagtcgctggtgtacctgaacttgctatgcactaactacctcatccagaactgccgctaggcgttctatacacaaagcattctattcaaaacgttcgacacgc

SEQ ID NO: 33234 - DNA, 1960 bp, Oryza sativa
gttaaccgttgagggtcaacaacaaatggtgtttttagttaagggtgaaaagtgaacttcaagaagatttcaaggaccaaattacacttaacccaattcctgagataaaaccaacgagatgtttccccaaacctattcatgcaaaactgtccaattcattttcatgtgaacagccacctgtattataacgaacgaaaagaaaattcgcatgtttcaagcattattcatctcctcatgaaaccaatcagttacatacaactaaacatgatcaaaattctaatcatattcaaccaaggagaagaataaaaaaggctgctgcgtctggaatcttatctccctaaatgaaaaatgttgaatattttgttcagcaacaaagaacatcatatcctgtagtcctgaacaaaaaccaaagacatgattttcatctaaaatacaaagacatcacaacagtggcaaaaaggagttttttttttcaacaacctgcaagacgttcgcacatcatagcattaagaagtaaaagaatggggcagacaattgagaacatgtgcgactactgccccctagccaaacttgggaaacaactaaaacgaaatgacaagcacactgaactattcaaaatgacttaagagaacttatatgtgatacaagacacagtctacctccacctattactgtccttttgatttcttgaaccaaatgatcaaggaatttgaaaacattgttccaacaatctgctcagctccttgttattttgttactccttgttattctccagcacagaggccacctacctttcctttctttcagccattttgcgataccactcaataaaataattacaatcataaggtatagcaccaccccgcatactaccaagaagacaaatattgatgttctgacctttctgcagcttccagctgcataagctgtcatcagagccaacaggtctagtatcatgatcaagaacaatgcttggagtggaaccttattctttctcacagatttactcagcagaagcatgattacagcaatagatgccatgaaagagatggaattagaaacatagaacaccatatagcgtctggagtgtatgtcttaaggagcgggttgccagcattgtagccatcacgactgtcatatgaccagatacccccgggtgggttcagaccagcttggtaagcaatggatgcagcaagaattgcaagcagcatcaagtacttatgcctcttttctttcttttcactgataaggggatctgacttgtcactttcattttttgactgacctggacttgctagtgacttttgagaatcagcaagcccaaaaaacttctgtaaccatctccgtgacctggctggcggttctagtgcatcatttgttgatgacagtacaagaacttgaattaaaagacagatgagaactgcagcagttatgataatgagataacctattgattttactttcctgaagcttcatgcagaataagcaatcaggagaccaagcaaacccgctatcaagcagacacgcagtgcgtaggacttgattccatgctcgcacgattccctattgacaagtagtatgataaaagccacagatgacacaaattagagagcatttgaatagtagaaaacatcataacgctttggatggctatcttgaagaactggattgccaggtttgccactcccatcaggccaaatgccacctggagggttcaggccagcttgatatgtgacagttgctgttagaatagcaagaatgaatagcaaattacgcttccgctccaagtccttctcatgagcatcttttgcatcattatctacatgatgttcttgtagtacatcctgtcgccgcttaaacaattgtttccactgttcaggaactgcatactttgaagccaaaacatgaagaaaagtatatgcaactactacaaaaaatatcaccactgatatgtaaatgg

SEQ ID NO: 33235 - DNA, 6235 bp, Oryza sativa
acaattaattaggcttttggtcaatccattttgtaaattctggcacacctgcaattcattctcaggtatagcatctggattgaaaattattttttaaaaaaatttaaagagagatggagagagatgtttcaggcagcggatgctccttgtttttgtgatgggagaatctctggcgcaggcataattccaacggcataaacaagttggcaggagggaaatatatatcaggagaatatatattttttttcttcctcctttgcatttggatggtgcacattgtgtcaacttgagaggaaaagtgatggcctgacaaaaagatactatatgctcttcatttgcttccttttctcagacagaaagcttttgcaaatttgcatggtgggaggtcaagacatattccctattttattttatttttgtggcggaattcctcggtacatgcttgaaaatgaaagggcatgcaaaaaggaataaattaaagggtacgcatgcatcccctggccggccagataagcatttagagctttttcaaatgaaaatcattttcattagatttttatttcatggcttctagatgtactctttgcatctgatacttacttaggtctacggttcaaaatttaccttcttgttccgtatgtgttttcccaagctttaatttcgttttggcctaacacgtaaagtggtggaaacgtaaaggaccgttttaacatcttaatcacaaggtttggccgtgattatgataataacccagctatatctatctacgcagtctaacactagtatattagctttgtagcctgtgatggctcatgcgacaatgaacggtagtctaaccactacagtatgtatagtttttatatacgatccatgcatgtgacgtacatacctttagtatatcatttgaccttcagttcatctcaagccatccgttcgataacaaaagcttttactccatgatgcgcctctatctttttcccctcgagtagtgaaagagagagatttttctattgagtttttctttatctcgttatcctgctaaaaagatcaagctagcttgtgatgtgatgacaagtcagttcacaacaacttgttaataatgctttatcttgagggaaaaaaatatgggggcatagtatcaaacataagagtaaccattttttttctattacatgaaagatcagctcacactcgattgcttgcacgcgcttccttaatatcagggaattactaagattttattttcacgaaaccctaaaagtatctcacgtcaaataaaaaaatactggagtaataggttacacaccgtaaaagtgggagccatcgcatcgacgaatattatagagcaatacataaaccaactcttacatagaagtgaacgtccatggaagaaacaaaggagaaataacacaaaccttaaattctagctgctatcctcccagaaaagtccattgggaccagggtttttcaaagtgtaccaccaaaccgttataattaatatgattatttttagaaaatatagttaaattttttttctaatatttttcccacatgcttggcccaagttgtctaacatatgggcaacatggcaatataacattgactaaaccattccgtgccaaaatccagatgtcaacagttttctcagttttcgtggaaaccacttgaaaaccatttactcccaataaaatattgtcaaatgttataaaaaatttaaaatctagtttctttagaacttgaccaaaaagcctggcaatttgtattcttgagcttgtccaaatagtccagctttcatgaaaaccaaccagtttttatcggttttgttaaccctagctagtatgtactcgatcttaacaaacgaagcatggataaatttaataaatctcacaacttttctttattgaagtagaccgatttgtacgtgtgaatgccaggtttaaatcatagagcgtcaaattgttaccggagctagcctaacttgtcaacaaatagaaattttacggtactgaaaaaagtacatgtagatatcaaaattttacattgctgatgcctcaagatacctagtagctaaagacacaagttttacactacaaattaaaatatgatacctggtacctcttagtatattttctagaatggtaaaactacctgtcaaccaaatatctctgttgtgcatcctcctagctcacatcttgcgacaaattgataagcaatttgcattgaggggacttcctctcgaaggaaaaaaaaaacacctctctctgcttcgagaactcctgatcatcgattgcacatttacgctagaacacgtcttttgccggttctgtaatccttaccctgcagcgaagcatgtacacacgtttaattctacttatcagcatatcacgaatcaatctgatcacacaagagcaagtgtacaagacaatgtctacattaagctaaacgtgcaggggcaacaagtaacagccggttagtcaagtactacacttactttattagctaggtttctgctctaatttgccgaagataacacgtcagtaaaactggctctccgcgcatggatccgagccgatttgccaatcaatttcggttcggtccaaataattttacaggtccgatacgtcgtgtgctagtttggggattttcttgatttctcatcgactggttcgacattgatcgatcagcaagcagcgtagtctcgatcacgagagatcgatcgagcgttggatcatgcacgtaactacaccacgtatcgaccgaccggctggccgatcgatataagccctgcaatattggtttcgtagctatccgaattatatttcaactattcaactagcgtaatgcacgtgccttgcaacgggttctaaataacattcaccgacgatatacattaaaatcttaaaccatatgttacaacgggacataaatgacgaaggaaatataatcatagaaataagcatgaaactataaataactttggccggaaggataattcaatatagtgctaaagtcctcattttttcatttagctataaataattcaatatgaaggaaaattgtaagtttcaacaattttttagtggatcaaatagtaaaactaatagtgtaaatgaaaaaacaattgaaaattagctagatattttttaaaaaaaagaaaacttattttagcccataaataaaattagatccattagttctggacgggtacccatttcttcaacatatattaaaatttttcaattcaccaaacgacgacaaggctggtggctagatgtgccatatgatgtgactcatccatagatgacgacggttggcaacgaagaaaaccagaacaacgaaaatgtggccaacaacgatgtggacccaatagagagagaaacggcaaaagctagctctagtggtgaacacgaccgggtgagtgcgtccaaacacgttcccggatgagggggttccgttttacttgaacacgctacggttggcaatgatgaaaaccaaaacaacaggaacgcggacgacaacgacgtggtctcggcagagaaatggtaacgacgagctctggtggtgaacacggaccggtgagtgtgtcaaaacccgttccctgatgaggggggtccattttccttgaacatgctgcgtttggcaacaaagaaaactagaacaacaagagcaccgagcacggatggcaatgacatggctctgactgagagacaaacaacaacatgttctgatggtgaaaacggtcaggtgattgtgtcaaaacgcattccccaatgagtgggttccatttttcttaatgcgcaggaggaacgaaagacggagaaaaatcaactaacactattcatcgtcttccctaacggtgaagccgacgtgcttcacgaggatgcaccggggagaagggaggagagtcagggataagagtggcgttggaaggagagggctgctagagaggaggtaggggaggaaaggggcactgggagggaaggcgcaagggagaaggccacgggagggggagggagcgcgggatcggatcggatcggacacgtactcatgacatatggaaatattttacggacaaactaatttcttttgttggaagcatattttatttttttaagtaagtaaagataaagataaagatgagaaattaagtctcaaagtctagttttaaagactttataaaattaaattaaagattataataaacaaagttgcaccgttctatcatgagtttgtgatgggcccagattacaaagaggtatattttttaattatgtacgaactacggtagtatttataaaaatagaagcaaggttgtgtatcaaattcaattatatatttaataatgtctatcactgcagaaaattatgctggaaaattcagtgtatactataaacatcttataagattatattgaactcttgtgttcaaaaatcaatcttcagcactatagcctatacccttcgtcttaaaataaatcaactcctggttacaaagctggatatagtgttatttagattggtagattccttttgagacgaaggtagtatagtttagatgaaaaaaagatagtatgacatggtatattctatactctgctcctatcgattgactaagagaattactactagaattttcttcttgcacagaggatgtacttctgtgttattgcctattgggggctggcgcatctagcatacctacctacctaaaaatgatgcaacaaaaagttttcttgagggtacctattgcaaagtaaatgcagccaattgtgcaactgcagtgccacggccggagaagcactctcgctaaattgcagtatgtagaacaaaagggggtgaaaatgtgtatatcatgacaaagctagcattgtgctgagaggaaagggtgaactgctgaagcgatataggaggaggcaggccgggtagggccacggatggggatgatcggtaggggaatggcgtagtgcaaaactgcaaagggtgaatggccaaaattttgtgggggttgctgctgctgatagtgggcaagtactaactttttgttaattttcgtcgtccagctactgctcaatgcctctgctgtttgccatctgagaagtagacagctgagtcgtcaataatggcaggatatcaatcccttcatcatttgattaatgtagtgctccctcctgtaaaaagaaagaaatactaccttttgtgattcatatagctgtactattttcttgggtaaatatgaataatgttttggatgttgcatatagtgaaacctaattaattagctaggttttgtgatgtatatatgtaatcaaacatgtacttagccgttgatatgtaccatgagtatgtagattattgtacatatatataaatgattgtacggttgcacaacctggttgataaaaaaccaaaaataatatttttattatcgaaaatataaaaatatttttgagaaaattggtgaaggagagtgctaataaaaaaaatatttagagttagtgtattagtctggtcaatttggtattatcaaaatgataaagtttttaaaaatataaaaaattgtcttatcctatacttcctccgtcccaaaaaaaaaggaatctagtactagatgtgacatattctagtacaatgaatctagacagaggtatgtctgaattcgtagtacttgtatgtgtcacatcggtactaggttggtttttttatagtacggtgggaatacaaggttatctttatgtttgatagcttgcttcacgggagcaggctaaactataaaattggtagtactagctaagagtcttttgctccgtattgaatggcatagtacatctagaattaattgccaatctttgtgatttttgttagctgaattaattcagctggccactttttagtgaaggagctagggattgatttgtcccacgtccactggtggagaaatgatctttgctgggtcgacccaaaaccacaataatcccggttccaaaaagaaccgggactaaaaatgatctttagtcccggttgaaaacctcagagccattctatgatctttagtcccggttgttatcaaccgggactaaaaatcatctttagtcccggttcatcccctgtcaaattaatgtcaggggccgaggatctttagtccaccggaactaaagatcaccactttagttccggttggtgttcccaaccgggactaaaaatcaaatgatcaaagatcaccactttaattccggttg

SEQ ID NO: 33236 - DNA, 16823 bp, Oryza sativa
  unsure (1)..(16823): unsure at all n locations
cttcctcatccccgaaccatcccctctacctcctccccttcctcatcccctcccctctcctccacctcctctccccttcctcaaaccaggactactgggggattacgaaccgggagtaaaaatcacttcttcaccggtggtcgtttggagatgaaagtgagtttgtttctttcgttttccgcacgcacgcttcccgaactactaaacgatgtgttttttttaaaaaaaatatgaaatttgttttagaaaatcatattaatctatttctgaagtttaaaataattaatacttaattaatcatatactaatagctcacctcattttgcgtattttctctatttctttaaaacagaactttgtggtcgtatccttgttgccaacgtctagctatgtgtaacattttcattgtaaagaaaatgttaaaatggtttaagtaaattagtctcagaaatattttttatgatactaaaattttgctaggttatgtaagaaggagaatataagaaataaaggcttctttggaacaaaggaaaaaaatggaggaatcatgaaggattgaaataaatgaccttcaaaaaaatcctttggaattcctatagaatagctcatttcatataaattttagaggaaagttagccagagacaagatttcatgttttctcttattgtatctcaaaattcatatgttttttctgtagtgctactgaataacacttttttttacaaattcatgaggattcacttcctgtagggtttaataagccataatatctgacctattgatgcgttaatgacaggacattgacattacttcatgtgtttcaaaggaggcctagatcggtcgtgtcaatgtcgtgtttgtgtgaaagcgtcaaattaattacgtagtattcacttatctgtgagactgtgacccgagtgagtatattgttacaaacacccatttgtcttcctccttcctgtatgatatataaagcaaacagttaatttgatgactcgtattccccagcaatttttttagaataatgtggacctttaatttttcactatggtcggaaaacataaataatgaacatagtatcactaaagcgttgacaccatgacatgatcctataaatgcattagacactagtccaatctgcaagacaccaagtcatatgtcctatcggcaagatactattaaataacactttagtcaacttaggctatctacttacgaaaaaataaaagaaggaaaagatatatagtgatgtgcaaagtgcacatttattttttttctctacaatatgcagatgaatatatgtgttaggacttgtcttgtggacccatattgcctttgggccatgctcggtgagtggtgacataaataaacttggccagttcgccacctatctagtgggttgggtttgataatactaccatgcaaagcgaaagataaccaaagaaatctaagaagatcagggtgctttatctgacaattctagtacacaagtttcatcgtattcctgtttgattagcacactattacgaaagcactaccagtctaccattgtatacaggtgactaattttggtttgtacaggtgggcggttgggtgactcgctcgcctctgataaattacctgcctcatagacagtagtctttacttgcaaatatatttgtaaaaaaaaatatgaaaactacatcgaatcgcagttctacataggtcatgatcaaatttcccaagtccctcttcataatccctttgcaaaagtggtagcaacagccgagacgacgtccttactacggtcatcatcatgatgttattgtcgagtcttagaccctgttgcggtcatcattgctgtaactgaaatgaagccatattgaggatcaccaccgctatatctagtggtcccgaggccgacgccgctaaatttggcagccccaagactcgctgccatcgatccactgctacttagatctatcgatgtcgaatccactcttcttggccctgccaccatcgatatgcgctcccgagccccacagttatcgtcgatccgccactcccggatggtagaaaggaggacgataagcatgaaggctaggagggaattgcgggaagggagggaggacttacccgcttattcggcccatcatattttaatgtagtcaaacaattttcatagccatccattataaggaaccatttgtgaaaatatatgttcccttaggggtttgtgtgagaatagtgacttctatagacgatttctaaagagatccctataaaataactctattttaatagatgatccttttaaaacaattttcacagatggtcctaaatatttacccatgattttttatgagcatgatttcttatcgattgtttgtacatataatcgaaaatgtttttcaatggtgacacaagctaaatttaattgtaaaaataaccgaattttcacaatcagctggtgcaactctgtgacataaggccattcacaatgcgcggacgtgtcgttcggcccgagcgtgaggaacagaatatttgccgccacatcatctaccagcgttgtcccgtgaagaacgcggagccaaaactggtcacccgttcttcggcctgaccaagggcgcgcggcgcgggagaggggcgcagctccgtgttgtggaggtcagggcctcgccgctcgtggcttcgacaagcggccgcgctccttttcccctcccgcgctctcctttctctcgtgcaagagcagcggaaaggagaacgagagcagcaacacaagatggcgtcggaagcgagaacaagcaccgggggagaagaggaggctaccagggcctgcctaccgccgcccgctcgccgctgaggccactcaaccacaccgttggtgagccgctagatccggtgccgatttcttagccattgacgaggcgttcgatccgcgccgccgagctcagagggtgccgaccaggggagaagatgatgagcgccggccgtgggaagagacagggtcgccggccgcctgcccctcgccgaccacaccacccaaagcttgtcgtgtcagttggagctcgccagccacctgtccctcgccgaccatgcccggaccggcgtcgacgtcagcggagagaggaggggagggggagaggggcgccggctatgggaggagacagggtcaccggccgcttgcccctcgccgagcacgccacccggagcccgctctgtcggtcggagctcgccgaccacgtagcttggagctcgccggctgcttgccccttgccaaccacgctcggaccggcgtcgacgtcggtggagagaggaggggagggggagaggggcaccggcggcggggtagccgaaggaggatgccaaactgccatagtagggagagaggaggagagagaggggtgaggaggggtttatttttttttctagattctagggtgttcagtgtaaattttggacatccacacaaattatgaaaaatattagaactgaaacaaaaatattagaactaaagccatttgcactgtgaagaattaagattttagacccataaccttagtctacgtgatactctgatgcacctcgaatgaggagaacggactgtaaatggtctaatggatcggcgcaagcatatgcatgacaaaattgacatgcatggtggtcgcgcttgtgatcggctgtctctccatgccgtgcccgaagcgtctcgtcgcaactgatctgatcggcgtggcgattgggcagcctctgattcgtcttttggcaacgccttgtcaagtaggagtaatctattttctctctgcagactctgcttctctgccctgcactcctgcctgcctcctggcctgtccgtggattgactgctgctgctactgaaatccatggtactctcaaacacggtagtattccaattgtttttttttttgttttaaggcctatttagatccctcctaaaaagtttacaccatgtcacatcgaacgtctgaacacctgtataaagtattaaatataagctaaaaagataactaattacacatattacaactaatttacgagacaaatcttttaaatctaattgctccatgatttcgcaatgtggtgctacattaaatatttactaatgatagattaattaggcttaataaattcatctcgcaatttattaatggattatataattagtttttttattacccgaacaccccatgcgacacatatataatatccgacgtgacacgctaaaccacccctgtatctaaacaccccaagtcttctcggataaaaactgtaggcaggagtctcatcaggggacttttgttttcttttctttttttgaaaaagggaattctggtcagcaggtgcaaatgagggagatgaatgtgcaaatggtgcttttgcaggtatccttggacggcaaactttactgctatgtgtgatttttagtccagcaagggtcttatactagtatatgagtacaaaattagtgaatagtttccttaacgctcctatgtggccattccctttgttattgaaaaaaaaatcaacttttatatacgaacctagacatatatatgtccactaacttctaaaactcaacatgcaagtgtatcacattatcaccactagcaattattatctagagttttaaatatgatgcaaacatgacatatcattcacgattttgctatatttttataactcaatatgcaaataatgtcaaatcattatcttcacattattttttacattctttaaatatatatatctattatttctataatgtataacatgcatttatccacatatctcatagcaaagtgtgggtatcaactagttaaatatagataagaaaacactaaaggataaaagatatgttggaccacgtacgcttatagtcttaagaaaaatgcgatctaatattcgcaccgttcttcttgaacgtcatattagtttcgggcatatgaagcggtcgtcaatcaaatcatattattttgacaaatttaccactttcaaactaatattgttaactgcaattaatagccccacacgcccactagttctattacaagtctcgagtctcgacaacttataagagggcctatatatctagggaaaaatattcctcaaatgacatctatttgtgaacaaaagtatgtttttgaaccactcatagaaagagcgggccgaggaataaacaccttaacaataattgttttatgatagagcagggctggaacacatttagatgtccccaacagttgcatgctagtcgcaatccggggctcaccaaattaagagcttgccatacgatttgtttaagttcaagaatttctagcactctaggtttctctctctctctctctctctctctctctctctctctctctctctctctctctctctctctctctctctctcatcttataagctacggacactaaggcaagcatcatcaaattttggttatgatatagatcctttcttcccacataagggttatattccacatttctacatctgcacagaaagtataaattcatgctagctagtgtgatccttttaccctcgagagagcacttcttgtgtggtgagcaatggcaaattaatatttgtggcaagagccttttgatcaaaaggtttatctcaatatagaagacatgagaaactgagtcacacgcaccatctttcctttgcacgaggagccagaaataaataaaaaggtgcatatgcagtagtaatatttaaaaatcgcaaaacaccaagggtgcctttttttcgcccaagtgcttgtagatatcaaatggttgcgactttatcaaaaggaagaaaggtagctagctaggtagctgtgctagccatctcggagaaaacttaaaggagggccaatgcgagttttttctcttagcgatgttggaacagttgggaaatggccgaaatggggcaccaccattggttgtcacgtatgtaaccactaggggaacagcgatatatacaggtcccaaagccacacacacccccactctcaacacaacaaacagtactgccacatcatgccaaacagcaacatgcatgcacttgtcaattcttaattaatcaccatcaattgatttaattataatttacacccaaactaattagtatttgtacatagaagtataattaattaagaaaaataagggaagaatatatatgtttttttctccctctttttttttcctgaatactctcattaattagctgctcagcttggttatacagacaaaactaaacctcacccccaaatcaagatggagagaaagatgaaatggagaccggccgatcagtgtcaaacatagcctacgtacgtacgatcaaaacctctccagaattaatcgatggatggatcgaccacgctggttgattagcagctagctagacgtggccacctccaccgccgtcgccgtcgttctcctccccggcctcctcgtcgtcccccacactgatcagcggggccctctccgacgacgccgagcccctcctctgccccgcatttccctccgccgtaccggcaccaccgttgctgcactgctgcttgtccccagccttcgtgtcgacgcctaacgcgtcgccgcagccgcagcagccgccactcgtggccaccatgagcccttcctccagcttctccaggtcgtcgctgccgtcgttgtggccgctctcgctgatgggcacgtaaccgcggttgtcgctgctgccgccgccaccggcattgatgttattggcggcgggagacgttgtcgttttggtgttagcctttgcgttggcggtgttggtgttgctgttgttgcactcgtgctggtggttggtgccgctgcctgtagtggacgccttggtcagctccttggcacgcgccacctcgacgtcccagtcggtggcggccacggcgcgcgccatccacaccgcgcaggcagcctgcgcggcaaggaggcccagccacagcccggcgaagcctaggcgggcgccgaatgccagcgccacgccgaccggcatgccgaccaggtagaaggaggcgaggttgatgcgcgcgccgctggccgggcgggcgctgccgcggaggacgccgcacccggccgtctgcgggcagttgccgagctcgcagagccccgcgatggggagcgccacggccgtgaggcggaggatctcgccgtccgacgtgaacatgcggccccagtggctgcggaccgacaccatgaaggtggcggccgccgcgccgacgacgaggccgatggagagggcggcgccggccgcgcggcgcgcccccgcgggcctgcccgcgccgagctggtggctgacgcgcgtggacgcgccctggccgagggaggacgggaacacgtagacgagcgacgtggcctggatgaggatgcccatggacgccacggtggcgcgcgggttggccaggaggcccgacagcacgatcatgagctcgtaccaccaccactcgaggcacaccgcggtggcggtcggcacggcgaggcggagcagcgccggccacccgcggaggcagtcggaggtgggccccacccacgagtccctgtgggccccggagatggcgaggaagcagaggagcgcgaggagcaggttaaggtcggtgagcgcgacggcgagcgcgacgccggcgacgcccatgcggaggcgcacgacgaggaggtagttgatgggcccgtgcagcagcacggagaagagcgagcaggcggtgatgggcagcgtcaggttctgcgaccggaggtagacgcggagcgggtgcagcacggcgagcaccgccaggtcggccgacgcgtacgccgcgaacgtctgcgccgcgtccgccacgccctcgtcctggccgagctgcttcagtatgtaccccgtggacgtcacccacaggagggagatgggcagcgcgacggcgagcagcagcagcacggtgcggtggagcgccagcgccagcagcttcccgcggcgcgcgccgaacgcctggccgcagatgggctccatcccgagcgccagcccggagagcaccgagtagccggtgatgttggcgaagccgagcgccagcgaccctccggcgagggccagctcgccgagccggccaaggaacagcatcgagatgagcgcccgcgagtacatgacgagccccgtcaccgccatcggcaccgacacccgcccgatcgcctgcgcctcgccggccacctgggagacacgcactcacgcatgttagaaaccaacaagcaaagcaacgtcgtcgtcgtctcgatcagctgttcgtgtgcatggacgtattgatcagctctgccatttcccaacagctggagctttccttttctttctcgttactgttactgccagtgatgcctagctactagtaaataagcattaaacaaccagccagccagccagctatgtcgctatgcgtgcttcttgcattagctctttgatataatggcctacatgttctgttcacgccatcaaaattaccaagccgcgggtaagtattactacagcatatgtaccgcgtgttttaccttggagagcagcagcgcatggccgtcgtcggcgtcatcgtccacgaggcggaggaggtgggaggagtgcttgaacgaggtgagcggcggcggcggcggcgcaggcgccgacggcgaggagctggtgccggagttgcacatggtgacgacgacgacggctgtcaactctcggggagtacacaaaaagcgcgcgctgtttggaggagaagaaacaaagcttgaaggaagcagctcgctcgctgtcctctggagattggtcgccgggctgtgcgagagagcgctacaagtacatttgactggctatctcccgctggctctagcgctctgggctctggctcagctgtgttggttggtgctcgtgtttctctttggccttttggtctccttccagagaggtgagcactgagcacagagaaagagagagagtgtgtgtgtgtgatcaggttcaggtcaggtcgcagtggtgtgtgtagtgtagtggtgttggtgatttgggttgccctggagggtgtggcctcctctgcctatatatatatatacacgcgcgcgcgcgcacgagtgggtgcgtgggggagggagacgagagcgtgtctgccggggggtggaacggaatatatctcgcccgatcgatcgatcgatcgcctctcgccagcccaagcgggggatatatgcggctgtctgaaaattcccctatctcttcgccccccgcggaatggcatatttttcgccactgtcggaaccaacgggtccagcggctagctactatcccgctccagtggagttaaaccttacctctatcgccaacattcaccaccactagtacgcctgatttaactgcaccaccaccatccggcgaacttgatgcgattgccggattagaatggatggacgaatggacggacggaaagatcaatctgaggtcgggacatggcgagtagtgctactattacgatcgagtataatttgtgtgaactgttgttttcacttttacttttgattgcttgtgggggtgactactgctaggtgtaggacgggctactacatacgtgcatgggctaagctgtcgacgttggatggacgtcagtgaggggggctaatctaggcaagcatttacatgatatgcacagcagccaggggcacccagaaatgatggctgtactggtgaagtgtactgcattgagttcacgcacagaatgacaggagcgaggctaggataagcatcgttactcgttagttcgtccgttcgtcagggccctgcgcctgtgcgagcttaattgatgcatcgatcggttgatcctacattcaataccaaaacagcactgagagaggagagaattaagttcagcttcagcttcagctcagctcaaatgctcgatgacaatggcgagctgatcatatacgcccagtagtatcagtgctagctcactcctcgctgctgcctatagctttgtctctcgctccattgttcactgctactcgagcacagcagctgatggtggtccctgtgaaagaaatgaggagaataacttttcctccccctcttttcagagtggcagctagcattgatccttagttctgaattctgatggccagtacaggattttgcgatctagctagagctgatttatttgttctaattaaacaccatgcgcatcctgcgaccctgtgcccctgatctgtgcagaaaaatgcatgcatgtactcttatttactctttgccctgtcgtccttacctgcaagcctgcaggaatttggttactagtactatttttcttaagaagaaattctctgccattttaatctgaagatggcaatggtacagttgaggtagctgattgattttcccgtccttacaagtacaatccaccaacctttcaccttgttgctccccatctaacttcgttgtacctttttcattctcttgcattctggagcaaagcttttcagtagttgtagtagtagtatctgttccttctacagttctgctgcaaacgcccaaagcatcctcaacagttttggggtggactttgcatttgcttccctggccgtaagattgcccgatatatgcagctgcatactgaatttgttccttgctcaacttgactgagtcacctccattgcccttttttatccaggtggccttctttgcggcgttcaggaggaatcctccagctaaagagtatcaggtctaacgtgtagcatttcagtgcctcccacttaagctgcagcagcttattgtgtaatgctagctagtatctctctgtgctgaaatagctagctgtcgttccaaaaatatctgcgcaattaattaaattttctcataactaagacaaaatctccatgtcaaagaaaaccaatataattaatattaaattatacagtagtcaaattatgcacaacaaaaatgtttcacctgtctcaagtaatacaatctcagggatgaattggaatgctagctggagtaccaattacccttttttttttctttaaaccagagttgagattctatcaaattgttccctctctagtcacagtaagttttggataccaacatgatctccaggtacaactttggtcattaaattttatttttaactagccaaaattccagcacaatcttgtactgagataaattaaagtttatctaaaagtatctttgtatttgatatacaattatagctcctgtttatataaatacaatgattttgtacacattatatatataagagtaaatttcacaaaacaacagatattttgatcaaactaatacaaaattacatatttaagatgatgtattacaacactacagcttaaacaccaaatttatcccggaactacatatttaagctaggatatcgcacaactacaaatttaagacttgtttgatacaactccgaatccaagatatttgtagagctggatatttctagctccacaaacccatggatcgacctggatctgcgattacgttaatagtgttctgatgaattgttttgttcacatttgagaagaaattttaaattttaaattaatgtaatttaacatagaaacttcaaatttagcatggatctggaatatggagcattgccaaacaaagcattagtactaaaaaatatcatgaaaatataggtctagtgtcaatttaatcataaaacttggatgctataattcaaacataacattatttgtagggatttaaatcctaaaatacttagttttgcgattcttacccttaaatctatttttttgataaatttgatgttaaatctgtagtattgtaatacaccaccttaaatatgtatttttgcaatattttgaccagaatatatgtagttttgtgatctctatatataaatgcaataatttcatatacatcatacttatccatctgcatggttataatctagacccactacgatcaacatcatagatcttatttctctttctccgataccgcgatgatttctaggccttcaacgtggacaaagtggctccatttacccttctcttataacttgatagatgcgttgctagacctaataaaattatgcaaattctgacaactcgcatggttggattgacaatgcccacgatgagacaccttccaagcctttgtgccatcttagctcgaaagaaagtgataatccaaaatgtcctatagatcatggaattggatccttcacatctagatgactgatgaggcagtgtctactcaacactaaagatgtactacagcctgtgagagagtacaaattgtgtagctcacagctacatagcatttgaacaagattgtgtgagctgatgcctcaaggtgaatgtacttctacagcctttgagagagagtatgtacaaattgtgtggctcacaagtcacaactacatatacatttggtcaagattgtgtggaagctgatgcctcaaggcgaaatggtgaatacatctccacctttggtaccaatgcacaattctttatattgaaaactaccaatttgaataagccaatcaggcccaaatgtgtcccaccactcaagtgcaattcttcgccttgcgatccacaatataggtcgtgaattgtagggacaatttcctgctcctccgattcactctaggagcaagcaattgcttcttcccctacttcaaatactcacagcagggtgtggaacgcggttggaggaatcacgacacactctcacgaaatggacatcacatctatcaaagaattggccgtgtacatcctgtttggatgcggatgctaggttttatttcattttctaaaaaaatatatatatctatcaaagaatactgtagcaaccacagtagaggcatcttaacaaaagaacgtacgttccgcaatcaacctcgtcatgtgggagatttggaagagatgaaagtgcgagaatcttgactcttgaggtcaatacaaagactaggcgtgctactcctcccggtataattaagcttctcgacatacatgtacaagcattgggtacatatagcaatgcttgcacatggataaagcttagtttacctgaggtaaacaataatggtagctagacaaggtggcctacatgtacgtgtacgtactggccgggatcatgcatatataaaatgtaggcgaatcagagtagtctacaaggcactgtgcaagtacgcatatgtcgatggcatgcacgcatctcaaggacacgaggggggagagggtggggaagagacaagaagaattcaatcaagtggacacaaagtgcatgtgcaatgactcgcccgggggacctgagtactttccccatttaactgcctgccctcttccccccctgtaccacgtcatgatcatcatcgatcgaccatggcctcctctccctcctataccactactcctacaactactgccagccccagagagataagaggagatgaatactggtgataaagagagagagatggatggatgaatgcgatgcaatgcaagtggttgtttgcatgcggtgtgtgtgtgtggggatggtaaatggttagcaggcagggagcagttggctgtaggggagcaccgctagctacgcacatgcatatgcgcccaccccaccctgcagctgcatgccgcggctaattacacaccgcgcgcgcgcgcgcaaaccaccgccatctcgcgtccattgatagcctctggaactcgcatgcacggcgcccggccgcgcgcgatggaaaagccgtgcgcgcgtggcgggcgtacgtacgcacacttccccccctttgctgaccggtacgcgcgcgcggacagtgcgtgcagcggcggagcgcgcccgggcgggacgcggcatatcgctatggtggtacacactactgctaggattcgtcacggaaatactagctggcaaccactagaagctcccccgtacgtacgcgttgtccaacaggggttcgctagctgctgcaggctcacccaacccaaactgtggtgcctgtgcatgcgcgcgcgcgcgtacgtacgcgcgccccatgtgacatgatctacggatatgtgtgcccaccatgttgattgactgtttgttgatcgatcgagtcggagtcaagtgtatatgtatatggtggacggacgcgacggagagacggtgcaattcaacctggtcgacgtacgcgcaatgctgctgctgctgctggctggcgagcgatatgatcatcgatcggattatttgtgtatactacgtgaggtggctggtggtgccaattatagtcaggcagggcgtccggccagggatcatgtcgcttgttaccccgtacgtaacaccatcgccatgtctctcgcgcgcggctgcaggcatggagctctgccatgccctgccctcgtgttcacgccaccgtgcgtgccacctacatttacacgggcgcgcttgttctcgcgtcgacgcgcctggtgaatggtgatcatagccgtttgggaggttgagacgtttggcccatctactatactatgcagctaaagcttacagcgtgtcagcttgggcttaagcatttgggcgaagagtaatagtgataacgctgacagagagtgccaagttgggcatggcacacatgacacatcacatgcctgttgccatccaccagctaggagatgtgacggagagagacgaggaggaagcagcggcagcagctgcagggcacagcgtgcgtgttgctacaaattagccacctactaagccttctgtgccattcctctaaacaaattagccacctattcttctcttcccttcccgtcctaaaatataagtacttaaaaaattccatcccaaaatacaagtacttctacattttttcaaaaaacaaaagaataggtgtgaattaaataagagatgtgattggttaagatataaaatcaattttgctttgaatgagaaatagttataattagttaaaataatgaagtagatggagatgttgctatattttagtaggatagataagagtagctgctaataatactgctgctgctgttatcatctccagcttttgcttccggcacggtgagtaaagggaaagatgtgaccggggtagcttgttggttccatgccgacacgggggcattccttatcgtcgttcaataggcgacacgctggctggctagctagaatagcccctggctgggacgcgagacaggacgcagcacgatgatctgacgggaaaatgactcgcgggcgtgtacttccaccaataagaagcatgtgatgtgcagtatttgtggtaatttgtaaagcagcaaagggagttggacatgggcgttactctggtgaaggccaacatagcccgtaggccatagctttgcacgcataacgactagcaatgtcagacaagaagattaacaagcgagaggggaaaaaaagaagaaaagattggagaaatgcaatagcatctactcctactagtttgtcacctagcgaagcaaacagagaaagaagccgcgcagataatattagaggaggtaaagagacgtacggagtactactgctgctgttgtgggcaccctgattatcctcctggccggcttttactgtcgacgccctgtgcaactgttacaaaaaaagaagcacatttcagtcacttcctgtgcacaattctacatgtttgttaggttgcaattcatatctggtgagcaattgggccatcacaattacgcagcagcctaaaaccaaaaccaaatctgaggaccatctccgcagaccagaccaccatggcccaccctcaaagcctacattggtccatttctgcagacgaaaacatggttttccattctaaatgttcaattaatcttaggtccagcatcagatgttcaatcattattttttttcacaagtaacgacaagaattttttttaccaatgtgtaaagtcagctaaaggtgaaaaataagaactgctttggggccacaaactgaacttgggacctgattcagatcaaacagctgcagtcttcatgtgacatatcgattatgacatgggcacgtctagcctcaaacagaactacagcaacttaccacgccccacaggagcccctccggattggaaatgtcttttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33237 - DNA, 37032 bp, Oryza sativa
catgttgaattcaaagttgctggatttatattccaccatcatgcatgagctgacattgctaccaatttttcctgtttctccagggaaatggagctgaaagctgcttgtcaaacctcaaattatagtaccttgttgcgtatgtgtgcaagcgacgacaggggcatcgagtgtgtattgcaagatagcctgcggcaacgctcatggcattggcatttcaccgttgcctggatcattgcatctgctgcatcgtcttggacgggtcctgatcacaagtcaggaagcagccaatggatgaacgagagcactgtcgatgatcacctcttggaccaagcagaaatgcccggagcttcgtctccgagatggatgatttcgacgtaaactatgttgtgtccgtacgtgtgtctagcattgcaatggacaagaagagagtatatatgtataggtatgtatgtctctctttgtctttagtctctagctatagttctttacacatcggtgaagactgaagaaccactctttcctgaacatcatgctatgtctgttcaccagctgttcatgttagcgacagctgtccccgcgtgattatgtatgtgtatataatgtaggtgatgtttttcccttgtcaattagctgccggtttgtacgttcgtacaatcgtactacatgacggaatgagcaagccattaatttgttcttactttcgtgcatccacgcaacggaactgtattccatgagaggcgattcagtttgatacggggcccgtttgattcgtttttagtactaatcttgcaagcgatgtcctcttgtttactgtaatttttctttatgcaagcttcagagggacagcattgagctgaagccatggcctttggctgggtaagaatggctactgattgattgattcagactaaaagttttcttgcagatatcttccaagaagaaagattgcgatgtgtgtaccgtggacgtgaaataattggccgggttgggccttacagctttgcttgatggcagaaaatgtggcattcgaatgcattcatatgactgcacagacgcgcaaaacaggtccctcggagaacatataaaaatagtagagccaatatagtacactgctataattctttaagctgctgtgagatcgaggactcaatggacttatgctgtccattttggaattatttgattcggaatctcaaaacagtagcagtacaacgactactcacttttcatttttttctgaaggtaacagtatgatgaatggatcgatcgaccgaatacagagtagcagtaggagaagagataaacagggcatgtaaagcagtacacagtagctagttctattcccccagactccgttaacttttcctttcaaaatgttgtgtgaattatcagacttcggacagtgtgatttgaagtatattctctctggaaacttatcataaacctggagctgcagccactgatgcacgagcttctagctaaggtttctgggctaatgtgaagagagatgagagagcccattgccattacattccaatgacagatgagccccactaacatgaggacccacggttcatcctccagccaaagttcgtgagaaagctactccccagtactcgatcaagactgcatttgtttatactaatcaaacagataagccacatgaccagcaaaaaaaggtgcctgcctgcttagaacacagacggacactgattggggtatttgtttggaagtttgggaaggtatgaagtcatggaatgtctgatgtccttgtctccttcatgccaagacaccagccaatttcacatcagcacctaaaaaagtgacccggctagccagccaggccactccttgcctggtacacaagcaagtgcacaggtaggagtaataaaataaacaaattgcccaactaattgcaagtaaacaaatcgcaggaaagggaaaggtgttgcaggtaaacagggaaaagaggaagaccgggagagagaaattaaacataacatcggatatatagtaccatctcatggaccccatggaattgcacctgcattcattattgaggcatatgcacatggaaaatggcacccattagccatgcacagggagagatgcagtcatgcagcacaacaaacacatctctcgtacatcaccaagaagaaatctgggcagttacactgtgacccgggccggtgtccatctctgttaagtacatttgccttgcacgctgtgcacagtccgtgtgcctcacttgttccattttattgttcatgccatgaatgctaagctcaggcctgcagctagctagctagctgctgctgctggtacagtcgccatccttgcgtctctgtctctggtggtgtggcatgtctagccagtgcagtaatccttacatgtgtgtgcttaatttggacgctatcagttggccgtttcaggggatggacgtcgtcggtgtggccatgaccaggctcttatctcgttttgggatttagtttttggctaagattattgttactgcaggcgtacaggttgaaaggtactaagctagtaacattcatgcgttgcatgtgcgagtgtgcgtatatgtgcgccttgtgtcgagtgacaatgagaagaggatgatagggcggttaaccgaacactcttggtaggaacgaatgatgtgtttactacgcgaagatcgagcaatattccttgagcgtatacagggaaggtttggtttatggccaaaattgatctaccaatttttatcaatgtaaaattttggcaagtttttgttttttgaaacagattaattatattgacccggctttgaaagaaagcccaacagacaaaaagagtcttataaaaaataacaaacaatgtctgaattttggcaagttttagcatcactaattttgacaaggcaatattgtgtttggattaaagccaaaatagcttaagtttgctattgaaatggtatatttttctaagcatgtcaaaatttagcatcaaacaaaatgatactaaacactattaaaattaccaatattggtaattaaggctaaatttaggccacaaagcacaaaccaaaccagcccataccgttttgtcgtttgactttgtttagtcatatcgtgctataggatcacattttagtttcattaattgtacagaagcttgaggaaacagttgccaactaaagtcgagctagatcagtgcgtagagttgtaatcactaatcagtgaaaattacctgtaggtttggctgatctactgcaagagttctactacctgtagtatttacttggatgtggatcagatcatcagcgtttgatcactgcctttgactcttcggtgacatgaaaaaggctatcgaaatgacaaaaggtagcaacggaccaatgagtcgccaagaacgcatgcagtgacaaacttattggttgaaaccgaaagcctgatctagctagggcaatttacagtgcctcagtggccaaggttaatcgctcatcgacaacagaagtaggaaactaggaagtttaaggcaaatcggcaatcatccagtcaccccgtaccaataaacgcacagtcctgctaaagtagcagtagtgctagttttttcaaacaaacttttctgaagcacaactattaggctgcgttcgagcgcatgagaaagagagaaaaatagttttgtttttcgcgcgcacgcttcccgaactactaaacggtgtgttttttgcaaaatatttctataggaaagttgctttaaataatcatattaatccatttttaaagtttaaaataattaatactcaattaatcatgtgctaatggatcacctcattttacgtatctttccaatctcctcaatcccctccttcttaaacacactctaaagctatcgatcgatcgatcgatggggtcacaaagaaggcagacacatggaggagagatatactaatagtagtactattaggaagcaccagcggtgtggtgatgaagtcatggactcgtgggtgcatgactcaattaggggtaggtagaaaaagaccgagaccaaaaattcggtcatcaattcgatcctaggcagtgaaaaaccgaaatttgttctctcaattcggttagtctcctcggttaaccgaatagaccgaattagcaaaaatatctaaatgcaacctaaaacccactaagttcaataggattaaactctatttttcacatccctacttcttttaggcatgcaacctaataagagtctttactaatacgtgcttacgaaattttttgtgatttttgtgttgaaatttttcattatttgtttgcatatatgaaaatattgttgaatttcggttaggaccgagaccgagaccgaaaagacagagaccgaatttgtcggttctgacattttgccttgaaattcggtcttcactttccaaagagtgaaatgaccaaaagatcgaagaccgaaaccgaaatttttggtcagaccgaatacccactcctagactcaacccactagggttcaaatcctcgtgaatattacgtacatgcatatggacttccaacaagatttttgtgtgcggcctccgtctcattttaagcgcatatgagtttcaatgtccaattttaatcgtttgtcttatttttaaaaaaaaacatcaagtactattcatgttttattatcatataatacaatagaaatattaatagaaaagttttaaataagacgaacaattaaagttagatatgaaaactcgtagtggtgtttaaaatgggccggagggagtactatatattgacgtggccactctgggacgtcacggtcacaaactcacactgatgatctggagcgtttcgaaaatgggtccaagacaaacaggctttgccactagccacctggaagagcggaacagaacagaaagatggtatactagcgcccatggcctgcgcgcgcgtggagcgtgtggtccacgccaccgcggaccgcacagcaacacacgagacgcgcacagcgacacatacgtaatacacgcatccgagtgtggctcccgctgagcggcaaccacgagacggtgcatcgtgcgccgatgcaagcagcacgctgcgtgcgtcgctgccgtggtcgatatatctctcctctttcggccagacgcacgcacgagactggagggaaaggccatcgcgacgatcgagccgtgcgcgcttttacgtgctggtgtgcaggcagcagcgcccgcgggtcggcgggtgcggcagcggctggatcagagtgaattcgacgagggatcactgcggtggtgggtgctcgccggcgcgcgcgtggcatgcatgcttcgctttcgctgttgtgtactcgtgcgcatcattggtcgcgcgctctggggctcccgggccccggccaccgatacatggggtgttaagacactaaagttttagagaatttttacggtccagcaggtacttggtacctgcccgtacatgtaatttgaaccatcgatttcgtttgatctaacgggtgagaaagagttgtacctagtagtactgtccacgtgattttatagagcatagaaaggtactccctccattccataatataagtcacaaccactttttttagatgttccatattataaggcatgcatacatgtagagaattaactatgaccacttctccaataaaatattacttttttagatccttcactctcatgctttctaattctattggatgcatgcattgtatttattaggatgatccaaactacaagataataataataattatttcttggtctttgggttagggtggttatgccttatattttggaatggatggagtactaaagaagcaagggtagttaagtaatttcgcgtgtatcttcttcatcttcctcctgtcttttctctctccaaaagatgctgcatgcctgcatcgatcgatggctctcaccagggatggacaggctagccggagtggaggtggagggggccgacgagcctccgtgcaccacttcccccaagctcgccggtgacatacgtctaccgcggcccttcccctaatctcgctgctggattcaagcacatcggcaagcgacgcaggtcctcgtcgccttcgccgccgcgtagcagccttcgacgcaggcgccgccgtccaacaccaccggtgccgaccacccctcctgctcctcgttacctcgccgccgtgcagacaccgccggcgcccaacacgctgccgtccaacaccccgccgccgacgcccccggcaccaccggcgccgaccaccccttgtcgcgctcccaccacgtccttgctcttggtttggacttgctcagttgctcttggagtcttcgttgacacagtcactcagtcagagagaaggagcatcacgatcatgagctgtttagcgtgtgagattttcaatcttaccctccgtgaatgaacggttggatttaaattggtacctgaaggtactggtacctcgaggtacaatatgctggactggagcaatgctcaaagttttaacgtgtcacatcagatattatataggatatcgtataggatgttcggacactaacaaaaaaaacaattacaaaatccgtccgtaaactacgagatgaatttattaagcctaattaatccatcattagcaaatgtttactgtagcactacattattaaatcatgaagcaattaggcttaaaagattcatctcgcaaattagttgtaatctctgtaattagttatttttttagcctatatttaatatttcatgtaagtgtctaaacgttcgatgtgacaagatgtaaaatttttgcacgggaagtacacagggcctggtggtagtaatagtagtacgtgtagatcatgggctcggtctggcgtacgaacggagactcgatcgccgatggatccgtggtggcaacacccaacagcacagagtctatcgtgaggagaaaggtgtgataaggtgtaaattttttttgtgcggaaactacacagggtctggtggtagtaatagtagtacgtgtagatcatgggctcggtctggcgtacgaatggagactcgatcgccgatggatccgtggtggccaacacccaatagcacggagtcggtcgtgaggagaaaggtgttacaaaagctgcatacagtagattcgactgttcaggtgagctctcaagaaaacagcctcatgcaatgtgtggtgatgggatgggacgtgttaaatttagccagggagcttaacattcgccaggaacggccccatggggccgtaacggcttggtctcgccagctttcccaaagaatcggtaacttttcgaacatggggacccacttcatagaaccatttaggacccctttgaatcgcaggttagaaaaaacggaggaatagtaaaacaaaaggattctgacaggaattgaagtgtaaaacagaggattgcaaaacacaggaaaaacatagaaatggtcatttgattggagcgcatgaaaaacgcaggaatcggatgaaagaggtagactcaaaggaaatttttcaagaagttagacctcttgctaaatttcctttaaaatccacatgcaatgtgccattccataggaatttcataggatttgaaaagcttcaatcatttgaatcagggcccttaaatcctatatacaaaaacataagaagaatattcgtgtagttcgtttttgttacattaattaaagacctatacatatatacacgttcatgaaaataccaccttaatacttaatacatgatcaagagaccaccacgagtaaattcttatcgtgtactaaacttcaattttttaacattatgggcacgtggatatcagaattttaacccttttaagtgaaataatccactccaccacaactttgatacttcctcaagatgaagtaattatacatcatcttgtaaacgtacgcatatggtgttagaatagggtgtggctaatgggcgggtgactgctccgggcgatcaccccccatccccctatacgctactctcttccttcctcctctccttcatctcttcctactacaccataaatttttaaaaaataaaaaagcaaagttgaaaaatttatgtatagaaatactatatataaaaaaaatatttgaattcaaattcaaatttgaaatgggtatgtaaactcttgacttataaactttgggtctataaactaatatttgaattcaaattcaaaattgaatcgggtatgtaaacttttgagttataaactttgggtttataaactaatatttgaattcaaattcaaaattgaatcgggtatgtaaacttttgacttataaactttaggtgtataaactttagatgtatagaaatactatatataaaaatatttgaattcaaattcaaatttgaatcgggtatgtaaacttttgacttataaactttgggtctataaactttaggtgtataaactttagatgtatagaaatactatatataaaaatatttgaattcaaattcaaatttgaatccgatataattcaaattcaaatttgaatcgggtatataaactttgggtctataaactttaggtgtataaactttagatgtatagaaatactatatataaaaaatatttgaattcaaatttaaatttgaatcggacatataaacttttgatttataaactttgggtctctaaactttagatgtataaacttgaggtgtataaactttaggtgcataaatttactaaaataggaaagtaatgcggtgccagaaaagaaaaccacgtggaggaggggggtgactaggggcgatcgatagcccattaggagtttcggttagaatatactccctctccgttctaaaaaaagacgaatcctagcatcccaatgtaaaattagcgaggagtaaaaatacccaaagtgttcctcattattaaaaaaagtatttctcattattaaaaaaaagtagtagtattggtgatagataggtagagagtataaaggaaagtgttcctcattattaaaaaaagtgttcctcattattaaagaaagtagtagtattggtgatagataggtagagggtatttaaggtataaaatttctcgtttaatgtgctgaaagtcagtaggatagaagaagttgatttttttggaacaaaattctaactccagaagttgatttttttttgacagatagagtactatgcatgcgtaaacgtacgccatgtagaaaaatctaattgttattttatattattttctaatctattacgtcgacctctcatgggtatatataggagtatataaaggatagagacttgaagcataatacaagtaagagtagatttatctctagaatatttatctctagaattatatccctaagatatatatcttatcactatatttgtatttgacccgtacgtctaacacgccaaagtcctagacacggacgaatttaggatactcttactccaacgctagctagctgtaccgttcgcctcaggtgctgtgctgcggtgcttcacgcctattcacggtcacggcgtcgtcgtacgcgctgcctagctagctagggctggcagacagcgaaacgactcgactacacgaggggagaacacacacagatggcaaagccacgcgatgcggctagctagcgccacaggcacaagcccccgtccggtccggtccatcgatccattcatcttttccttgccgcttctcttccgcgtcaggactacaagaatctcatcgccatcacggtccttttcaccctttacccgtacgtgcatgtttgccccttctccccatgtgatgataattaacttggcgagccgacgactcattgcatacatgcatgttgatcccatatcacatcgtcttacatgcatggactctccgggctgggcatacgtccacgggtacgagtagacctttgcgttgcataagctttgataattttgccactttgctagtatatacgtacatccttggtttgcaaacacttactcctaggtcaatctgatttgtaagaaaaacgtaagaattttaatcttataaaattatttctacgaaggtttttgaaacaaataaggatatgattaatcatatcctatcattctaaattcctttagaatgaacaatcctatagaaattttaaatgaacaatcatttaaaattatgtaaaactgcatatattcgattggatgtagatgccgggtaaaaatactcctctctaagcaaagtgtggcatgacacgagagtatgccatgaactggtaggataagtatatatggcatgatttgcaaaatgtaataataataataataataataataataataataataataataataataataataataataataataataataataataataataattaaatgacatgtccttagtctagtgtacacaactaatctcgatggaatatacaacggctagccgtgagttccaccgggatgcatttcaagttggcatgaagattgtgacatgtggatatctataacttaaaatttgataccctctcctcttagatagtttttatatttatacaattatattctattttctaaatagaactcaatgatgttaaatatgagacataggtgaaaaagtttgtctttaaatcagattacgcagtctttttctagcgagaggattgtcgtatcttttcgtgtaaagtatcccgatgaaacatcccgagtcaaattaagatttagtggtgagaaaaatatatagtacccgttattaataaaaaatggtattggtggttagttataatcgagtaagaactatttatttattaagggataaaacatcttgattcgtggaccgagagtaaatatgaaggtaggaatcgatatattttgggataattttttcagatgaacatagtaaacttagaagtataatttaaatgttagagataactatatttgaaaagaaaatcttacagatactccttcgtcccaagataaattcatttttcacccatcccacccgtaccaacaaaaaataaaaggactagaacccataaatctcaatataattattccctaatttatctactctcaatgtacttcctccgtctcataatacttgtctttctaggtcgtttagcacaaattaagatttgaaaagtaaagaatatattacctcttatttgaatagaaacaagagatttggtggggacagaatgggtgaaaatttgaattggagataactgatgtgacagataatactaacaagtggcaagtattatgggataaaatttgaactccaaaaagataactatattttagggcggagggagtaattattttctactttataaactcctatacaataattattttaaatatgaattttctttagaataaatagtactagcaaaaataaacttataatgaggcagagagagtactctatattgaaaaacgagggatgtacatcatagtcgagaaaagataatgaacagtggatcaaaagggatgagccgatagatgctcagatttccacgacaaaatgatcgagaagattctcctagtggcttcgccgattacaaccgtggtgtgacctgtgacaattgacaaatgatctgaccatacaccctcacacagcacggacatctctccccaatccccgcaggatagcaacagcggcagcgcgcactctcgcgcctcgcggtcacggccatcacagcagcctcgccaatctctgcatgcagcgaaagctcccgactacgtgttgagtcagtagtcacagccagcgaagccaagtccatcgcccacgccaaaccgcactctgatcagtcccacttccaccacgcacgctttttttatcagaaggtactaaaatgagcatgggagctctcgatcgattctcattcatccctgcgtgaacgctagctccaacagtatcattaggccgcagcaatctgcagcatatcctatgatgcgcggcacagtgccgaaggcatggcagggctccaaaatcaaacgaaccacttacactgtcacaaaaagctttgcttgggtgatgacagcaaggtggtgggcaatggcgccgtgcatgcattgtcctggccggctcgctgccccgcctgccatcttcaggcgagaggagcatggcagtgcatcagtgtactaccgcgatggaattgaccactcacgtgcacgcactccccagtcgccgctctgcccgtactacgtctccgcgcgccccgcgcttgctgcttgctgctggagccaggaacgcctgagcaccgcgcggcaggagcaaaaccgtgcgtgtcctatccccttcccaacccgaaccacgacgacgagctgggagtgcctgcgtgtgcatgtcgcccatcggcacagcacgctggggatacagcagcgaccaaaggtacgtacgtctccacgggtgatctgtattgcgacattttttagcaggggtagggacagcaccatacgggtgtactagtagtattgaccagtgcttccagtagcggccagggatgacagtatgacgcactggccaataggccatgtgtgtccgtgttttttttgttgcgagatcgatacgatctcaatccaattggttggagaggcatatactggactggagtaggagtagttgctttgtacacgagaggagacagattacatactactagtagtagattttatcaaccaccattatgtaacaatataatcttaatctagctaacaatactaccgcaaatattggagatttgcctctacttggactcggacccggacaccagcacagtccaggacaccagcacagtccaggagtacgccaagacgtacaggggatgatgctacggagtaccggtacaacggggacatgcacgcacgcttctagatgctaaggagatcctgctgtggcggggactcgcgtgacccgtcctgctgctgcatctccgcgctccggtcttgctctttccccgacccgtgcgacggcgcgtccatggccgtcgccgccgccgtaccgggcaggtcggtcaagatctgcacgacctcccgcatcgtcggccgctcgacgctctgctcggcgacgcacagcatggcgacgtagaagacgtgcgtcagctcgtggaggggcaccgtcgagagccgtgggtcggcgatcttcgtgacgccctccttgctcgacccggtcaccatccgcacccagtgcacgatgtccacgccgtcgccgaactctcccaccggcttccgcccagcgatgagctccagtagcactaccccgaagctgtacacgtcgctcttctcgtccaccttgagcgtgtaggcgtactctgcggatgcacagggcaaacacacagctcagaccacataagatcgcaggccatcaattcccaatgatgattcattaaaacgacaaagtgacgagaggcacaacatccagcatatgtacaactcgatagtgtgggggcacagtaaaaaacaaatcagagcataccaaaaccaaccattttcttccaaatttcaatgtgatagtgagtttgaaaaatatgaaggccccattgtaacatttgccatgagcaggacaggactagtactagcaattttgggccttttctgcactttgtgatgcatgattttttcaacactggaaatgatggtggatagtagtactagtagcaaccgggtacagtcaacagaatgagctgaaaatttgtagggggcagagggggtacactcatacataccgggagcaatgtagccgtaggagccggcgatcgcggacatgcactcggagccaccggcattgccgcggaggaacttggcgaggccgaagtcggcgacgtgcgcctcgaactcggcgtcgaggaggatgttgttggacttgacgtcgcggtgcaggatcggcggcgagcagtcgtggtgcaggtagcagaggcccttggcggcctccacggcgatcttgtaccgcgtcgcccactgcaggtggccgcccttcttgccgtggagcacctcgccgaggctgccgttcggcatgtactcgtacaccagcaggttcgtctcccggttggcggcgaacccgagcaggcgcacgatgtgtcggtgccggatgcgccccagcgtctgtatctccgccgagaagccgtagtcgtcgtgcgccgcgccggagcgccccatggccgggagccgcttcacggccaccaccgcgccgccgggcatcgcgcccttgtacacgatccctgacccgcccttgccgatcacgttctcctccttgaggcagtccagcacgtcgtccacggcgaagtcgaggcgctggaacgccgtgagccgccacgcgcgcgcctcggcggaccgcttcagcgaccgcgccttcagcaccgccgcgccggcgaacacgatggacagcgcgaggaggccgagcacgaggagcagcttcgacgccgacgagagggagccgaaggtcgacgtcgtggcgacgccgtgggagcggcacggggagaggaaggcgccgcagaggcctgggttaccggcgaacgacgtggcgttgaagtaggcgaactggccggtcgccgggacctcgccggagagattgttgtcggagaagtcgacggctgttaggctctgcattccggcgatagcaggtggaatctccccgtcgagcgcgttgtgggacagattgagatagttgaggattcgtagcccggcgagcgccggcgggattctgccggagagcctgttgccagagaggtcgaggaaggtgagcagccggcatccggcgatcgccggaggtatctccccggagatcaggttcccagataagtccgcctttgaaagctgttgcagcttcccaatctcacgagggagttcgccggacaaccggttcccggcgaccagcaacttctgcagcccgacgagaccaccgatccccaccggcaccggaccggacaaccgattgttatacaagctcagctctcctattgatggtgacaccacgccggcgtccagccggagctcgccggagagcaaattatcgtgcagctcgatctgcgtcaggttctgcaatgtaaacatcttcgccggtatcgtcccgttcagataattctctccaagacgaagcctcgtcaacgacgggcacccggcgagcccgtcgggaatgctgccgaacagtgagttccccagcgcaatgaacgtctccagccgcttgccggcgcagagctctgttggtagaacgccggttagcctgttcgtgctcacatcgacgatcctcagcctggtggctgccacgccgagctgagccggcactccaccggtgaagttgttctcccacagctgcagcacctcgaggttcggcaggtcgccgacaaactcgggaatctcgccggcgaggcgattccggaagaggttcagcagcgtcaggttcttgagcgacgcgaagctcgcggggatctccccgacgaacaggttgttcgacaggtcgagcgatttcagcgcccccattgcgccaatctccggcggcagccgcccggagagagcgttgatctgaagaaacagagtgtcgagcgacgtcaggttcgccacctccggcgggaccacaccggagatcccgcagttcgccatgtcgagccgcacgagctccttcagcctcccgagctccggcggtatcccgccggtgaagctgttgaagtagccgaggtacagttccctgagcgtcgtcaggttgccgagctccggcggtatctccccggtgagctcattgccggagagagccaggtacttgatccggctccactgcccgtacgacctggggatgctgccgaagaagaaattgccgccgaggtggaggtgaacaaggttggtgaggttggggagcgcggccgggagagcgccggtgaggttgttgttgtagaaatcgagaacgcgaaggttcttgaggctggcgatgaggccctccgggaaggtggagttgaggatgttgttggagaggttgagtgactggaggtgcgagagggaggagagcgccgcggcggggatcgggccggagaggttgaggccggagaggtcgagcgagaggacgcgggagccgtcggcgtcgcaggagaggcgcggccacgagcagaacgcggtgtcgtgcgtccagtgcgtggagaggtagcccgagggatcaccgagcgcggcggagaggttgaggagtgcggccgcttcaggggaggcgggggacgagactgtgtcggccgcggcgccatgggtggcggtggcgaggaggaggaggaggaggaggaggagaagggtggaggtggcggcggcggcggccatggagccagccagtgccatggatgaggcggtggcggtggcggagtgggtgtccgagtttcggtgggcggcgtgggatatatgggcgtgttctttctgtttcggttgttagacttaatcttgttgtttactgtgtgagttattccgtagtgtacgtgtgtgcataagttagtttgattagagtgcatgccggcagcccgtaggtgcacgttggcttgacactgtggccaagtgaagcacggatgcatggcgtgaagagtggatcaactagcaggtgttgtgcgtggtcatcagataagagcagtcaagcaggattaattggagaaaatcttgcctgtatgcgcgtcagttagtggagctcttcatgcagtaatatttgcctcgcatgagggtgaagacatggttgcagaccgtcttggccgggtcgtgcagccgaacaggacggagtggtggtgtatgtggtgtggtgccaaaagtgaaatacaagagcctgttcactgtgatgttattttcaatcttaccaaattttgataaaattatcaaaaagttgctatatttagtttgttgccaaaatttgacaactatataagaaatcataccaaaattttggtaagttgcgaaaattttggcaactataccaaaattttaataataccaaaatttaataaggtttttttttcatcaaagtgaacagcccccaagtgtttatgttgtgcgcgctggtttgcagcgtgaaatacaagtgttcattttcattctccgtcagttcatcatctctttgtgtgtgtttcacactttcatcaaaagtgagaaagagagaggtgagtagctgagccaacatcggtttctcgcgtggtacagaaacaacgcatggggcacgggttcaccgaatcattggtggtacagggatgtacaaaaacaaactcatatttgtgtacatgtaggaggatttagtgaaggcccgaggatgattgtggcccagtattgcctgtcaccaccttactgaatggaagaatgagctgtacagggaaacgagaaatgcactgtagtaccggaaatgctagcccagagcgatcgggtaggcctccccctccctctaccttactttttttgacaccgcgttattttcctattttattacatttatacaactaaagtttatacacctcagaccaaaagtttatatatccgattcaaatttgaatttaaattcaattgtttttttatatatagtatttctatacacctaaagtttatatatccgattcaaatttgaatttgaattatatccgattcaaatttgaatttgaattcaaatatttttcatatatagtatttctatacatctaaagtttatatacccgattcaaatttgaattatatccgattcaaaattgaatttgaattcaaatattttctatatatagtatttctatacatctaaagtttatagacacaaagtttataagtcaaaagtttacatacccgattcaaatttaaatttgaattcaaattttttatagataaattttctaactttttgttttttttaaattttttttggtatactgtagtaggaaaagaaggggaggaggaaggggagaagtgagccccccccccccctagtacattacagcactggatttataccagataatttaacctcaacttcatatgttatcaaagtttacactttatccaaacccactacaccccaatttatccaatctattctgattaatgtacgacttttatttgtaaaataaatcttgtgggattttattctaatttttgagaattacagtttgggcgacctatatagctaaaattcactttagaccatatctttaactgttgttttcacttggattagttaatgttacatttttttttcctttggaccacgccaactctattatctagccttgtcaaaccactcctccagtaaagatatggcttgcgcatgagtaatggagtttactggcgcactggaagtatgaaattaatgtgcttggggtcattgatgtgctaaaaaatatatatgggatggtctatattaggacaaaaataaattacctggtccaaagtgaaaagttgagacaaatggtggtccaaaattaaaactgctattcactctttatattccaaaaagcttaagttttagactttttagacaacccgatgctagattattatatgatgagcggtggctctttaatggagccatggagctagagaatatcaaagccttgatttttcaagaaaaaacaaataaataaatgcatgtctctacttcttatatcgactccatggccaaagaaaaaatgcttgtcataggctcacaacaactttctaacgtggaaccttacatggtggcataggtcaatgcttgtgctaacattgattttgctctctctccctcttctctagcctctatggcaaacggacatagaatccatcatcaatggttacttttaggtttaaagctaccatcatatgggtacacctttaaaattaaggttatgcaccgatgattatttagctcgtagctatacttaagtattaggaatcgactaagaatactgagagaaatccattcgggtgattgaaggaaaccttgtaggcattgactacaagtagttttttacgatgaagagagagagagcgcgcgccaataacacggaaaaatgtggttcagaaaaaaaaaatgaggtgagctaaagtggaagcgactaacctctcggcaataaattgagaaaaatctagtgtcgcttatatgatagtgtagcttttaccgttacatatgccctcatcagatagttccaatcggtgcgatcgtatggcaatagaaaagatagctactacgactacgaacatgcacatgtgtcgctatgtacgtataaaattcacgagtgcctggcctcacacatgcttaaagaggagtgcatcaattttaaatgcctagcttaacaatgtcttttggggaaatctacggcggctgatccacaccaactaaccagccaaaaggataacaagtgtatatggagagatttttccatcgagggaaggggaagtagtacgctgaatgtagagtttagcaatgtctgcaattaagagctggactgataatcatatcaacccttcctaaaaccgtttttaacactgacatatagggcccgcgtactgcactactgtgattctgcgatttcaggaaaaccgtgcaatatctgcagtacagtagatgcaaaggataaactacgcagctttccgtatcatggaagaacgcggagcaaaacactagtagcgcctgttctggaagtgggttccaccggtcagctacagtacatcaaacatggtaaactagtgcacggcactggtgaaccggattttttgccggtgggcttgggtaggagaagcacggtaccgtaggcgtttttttctgtcttgtcctataccgcgctaccagcaatccagcacggcacgcagatcgtccgtgctgtaaaaaaaaaaaagagagagagagaaaagttggagaaaactttctcctcacgctccggctgcggttctcatcccagccaaagctaagcaacgtctttgtttaatttaacccacgcgacggcaaaaaaaaaagaagaaaaaaccggacgtgaagtgctgcgcaagcatggggttacgaccgtgcgcgcaacaacaaacaaacagccgggccagcctcacgagcaatcggacccacgatcgagcaaaccccggattctgggatcacgatgtcgctgtgtcgcacccgcgcggcacacagtgaactcctgaccctgtgaaccgcgcactcgcgtatattcgcactgtactggcagcgtcgtggtcgccaccttcgctcgctcgctcgatcgaagcgggacatccatgatgcgtaaattggcaggtcggtgtgtgtgggggggctgtggaagcgagcaagctggaacagcgggcagccgggagacgaggcgattctattcatggtggatcatgatgcggtgcccatgattcggccccccaaaacggtgcgaaatatttgtcgccgatcagtgccgcgaccgaccgctcattcggcgcggccgccgaggaggaagcgtggtgcggcgatgtggggatgggttgggctctacaaaacttaaagtggcagcccactacaagtctacttctgcagcagcagcagcagcagcagcagcagcagtagtagtagtagtagtagtactatagaactgcactgttgcgttttttctgaattatttttcttgcacttcccgttcgtctcgttccagcgttccgctcctgcacagtatccgtgaaaatcgtaacctcgttgcgtgatttgatggagtgctaacttagcttgaggcgaggtgcgtcgttgagcacaaagcaatgcgcgcattaacagagggcaggtcttgcgatcagagtatagtagtgactacactagtgaaggtgaggcgcctcgtgcagtctagagatcttcgttgttcctagtaaagtagcttatctttttccttatttcgtgcttaattttgtcgttactgtagcagcgcctggtcgatctctactctggtagccgtagctgctaaataacctggagtacctaccacagcacgtacaactactaaaatggtgaccagcatggccatttgtcctctaatggaggagtactagttaagtatagccaacgttccattaaccagtataagagtacatatattgtaaacttaagataaacgacattgcaattattttgttctctccgcgcctaatagtaccagctcaacaattataaacgagcgaactgccgaacttggtctagttggtgggactaataactggagtaactagctaggtaagagtatatgacgcgtaccctgcagtttacaaatacagacgcagccacgatcgatggacggttcgtcaaacaccactagctagctacgatatataagctcgggacatctcgagttacttcctccttgtcttccgggagtgcttaggttttggacgtagtacgcttggagcaggagcacggacacacacaggcccaaagccccaggacccctgattacccgggggatcatcgacaggtcaatcgattgtgctaaaacccagttgctaatccagagaagaaatctacatgcaaatcgaaaccgaaggtcaaaccatatcattaatttaattttacacctatggcgttattaatttgggtcaaacctatcgtgcttttttcattgatcgacaaactcgggctcgcccatcgaacgtttttacctgcgcattggtctgcagggataggctcctccgttcgtggcacaaaatattttctgccaaaccgcaacaccgcacgcgcacggaccgcgcgtatcaaggaagcgtagcgcgatcatttcagcacttctcgtgggccggagtgccggacgctcacctgtcggagggccgtgtttgtttccttgtgcagcgcgtccatcctagatgaggcccatattgcaagacacgtatgaggcccatctactgtttgaccagatgaggcccatattgcaagacatgtatgaactatgaactgccctcatccaaacctatgggtaggagttaaaggagttgtaactgggacataaatataccactgatataagcatcaaataatttggtagaagacagagttggctaattcggtggagaggtaggtaacttgctgaacatcggtcaacaacgtctgtgctcctacagtactattatgaattataacccctttcatcctaaaatataaaatttagtacatgacggctcatggtactcatatttcttctatattatattaggttgctatatttttagaactactatatcttttgatcaatttcagagttctaccatatatgcacttgccaacggggacacatcaatacgtgctcttccacatcaatggaccacaaaattcatttgtggagttcaacatgtcaaccgcttgttcttgtacttgagtggaaacgagatccaaatagatatagcgggtgtggcattgtgggtaatctcggccgttcaaatataattttgatgcaaaacactaaagcataagactcattttgcacttaaaaaatcattttaccatacacacaatactttgtatttatggtaaaggatcttcatctgcaggtaatcacccatgcataccatatttctatactaatataaaaagcaggagttgtctccttgcaatcctacaggtgaaatcatccgaatcaatctttaccgttcatccacgtctcatctaatctcatccgtccgctgtacaccgtagctctatctcctccacgcaaaacccaccggcgattttgcccccacgcgctgactccgccgtgaaaatccccaccgcgatgactctgcctactctctccgtgcctcgctccccgcgcgcatcctccctcatcctctcctcgcgacggcccagcgacgacggaccgccgggccagggccgacgcgtcccgcaccgccaggccagcgacgatgcaccatcgcaatgccggacctccctcatcctcgcaacggaacagcgaggacgcaccactgcaccgccggactagcgccgaggttcgcgttccctcctttataagccaggtagccccacgccgttgcaatcagcgcaccagcggccgagggctccgtaggtgtcgctgcctccggggcggctccgtcgtcgccaccgcaatcgggcccgctggtctagggtttcgttggtgccacagccccgtcgctgaccggtggtccagccttccgccagcgccgctgctccattgctctccgctggtccagccttcggtcgcacctccggtcttgccgctgacacgaggggcatagtagaccgcaggtacttctagctgtaagtcaaaatttcttctgctcctgagatcgagtgagacactcaaattgactcttctgaatccccattagtcttctgtgtggattttcttattcagctgaagggtatgcacatatattaaatctctcctcttaatggtgtgattcggttcttatcgatccatatgtgcatcattgcaggctatatcctatcaaggtgattggtgttgctccatacagactaacattgtagacttgtagttgccatgctgaatctcttccagattattttatacagaaattttattgtacaggtttgagaattgttcaagttcgatcagattaaggggatcgactcacttttgagaattcatagattcatttgtttagtactttagttcttgagcacagattattgtgagccttcatccatgaataaattatatatatgttcagtcattcacaaagtgattatctaacctgagtactctgtgatatagcagttcatgtgtgttaccttccttttttctgttgtctaatttagatcaatgcatgactggttagacggtgatgcatcaggcggtggctggccggacgggtgctaggcaagagccagtgtgcagctgatcagtataatgggtatttgccggttttaattctttctcccatttggttcaattttccttgttataacaaaccattcttttttacctctggcaaagaaagctaatttgcacaaaaatggaggatacaacatttttgctactcaaggatgcggttgaagttgaaaagttggtttcattgattattcctgggaacatgaaatgtttatattttatttttcttagcctaataaaaagcaaatcttaatttctgatttaatgtgatactgcaatccaccatttgatttctttagctaggcatactataaaacggccatgatacaagcttatacagatatgctgaagataggtgaacaggatggaaggcatttttataggcccttgtcagatggcttttggctttaagatgctctatgaggaaggtcaaggggattttgttattttatttttcattgattggcctttggttgatatatatgaattaatatactccataggcacaacaaaaaggtaatattaatatatgcagaattatttctttgctttaagtttttactatttttactatggttactacttattggtcactggtcagataagggtacatgcatatatttttgtgtactataaacttattagagaaactcagcttagtgtatgcaagggtaaaggcatggaacaactctgattctgaataggaataacttcttcctttttctgggctaggaatttgagtgtttactttttcattaccaaggcttatatgctcctagctagcagctgctggtgatttgacaagttttggtgattttgtcctaatgcttcaaattttgttttgggtagatccaaggacaaatatattctccaaacagatgaacttttgttaaagataaaaaatatattttattttgaagcacaaaatgtgctataaccccaacctgaacattttactgaagcgattactgtaacaagttcattttgtctgctcgctgaactctacccaaccatgtttgttgttgctccaaccaaaatcaggaggctttatggtctttgtgtgccatacaactttatatatgaatttgaatttagttttacatggtctgaacttgggcttgcattgctcaagaacttggttgacaacattctgaaattggcctcgcattatatggcatcctgtgtagtgtaatgtattgtttctattcaacataaacatgcatagtttccctgtgaactattggttatgtactgagttaataattcctgacagcctttagaaatgtggaacacttttatttttaacaatttcagtacaaatttcctgggagcaaaaaattgtcaatcacatctcatgttgtgtcctccaaaaaaaaagttctaattttctgtcgtgctgatgacaaattctttatatatacctcaaacgtgtgcactatagatgtcgaacatttgccaggttagtgtttgaacatttcttatattattttctgagcatttggcatattagttttcgacttgtccttatgatgtaggagtatctgaattaagaatctgaacttcgacaaacatctaaatattgttcaatgttttaatttgctgtgagctaattaatgttatgaatttcttatagctcaagtactggaagtttagaaattcaccagtcgatgtaagatttgtgtgggtttagtgtctgaacatggaatatactcctattaccatttaaggttgaacatggaatgtatcttttttttatgaactacatggaatgtatctgaattcagtgtgtcatgtttctggagttaagtgtatgaatatggcactgtttttccccatacttttactttttaaaatatacattgtaaaaacgtgccttgcacgtgcattactagtcctaaaaaaatgtcttactccaagggcctgcttggaaggcctgtatttggcccaaaaccggtataagttacaggcccataatttttttccaaggataaactcaaaacgctgcttggatgggccgtaacctattatatttccaggcgttttcggcccattccgacgaaaaggtaatgtgggctagagatgtcacattttttgggggtaaatatcgagctcaatccactcagccttcaactccggcctcaagttacgcaaccacatagagcgtgttattggaatcctgaagatgtgatttccaatcctagaagttgcaacattttatccaatcgcaacccaagtgataatccttgcagttgcaatagtcctccataacataatcaggagccaaaaaggtgatgataagtggttagttcagaagaaacttgttccagtacatgagtggacttatatggagatgatgtagcaccaatgaatagtcaaagacacttgggaaataagctaagggacaagattgcaaagaatatgtgggctgaccaccgaagaatgagagagcgtagggtgcaaagaagagcttcttgaattctcataacacttgaacatctcaagcgtagtgtgattttcttttcatgttgaactttttattatttgtaataaagcaaacatgtttggatatgttccacattatttgaatatatcttgatgttttgaattattttgaatgtgttgatgttctagattatttgaatatgttattatatcatgaacaatatcttcgttcaacatttcttgtgatctgttatagatcagatggctcaaagagcaaggtgaacattgaaatatgagaatgcattggtggatctacttatggagtacaacgtctctcattatcgagggcaaaatagttggtgtatagagggcttgaataaaatagtgatggatttcaacaagttattccaagaagctaaatttaccgagaggctcaaatacaggacaaataaacccaaccgaagaaagacttcaaagcaattaaatccattcaaagtcgtggtggcttttcttgggaccaaaatgtgtcgatgattaaaaccacatttgaaaaatgggaagcgatcatcgaggctagattgtacttattttgaattcagaatttaatcttgtgcatcagtaatcttgacccttctataaatatataggaagatcagaagttgaagaggcatgagaacaaaagtttcccattgtttgagtgcttggatcaattgtatgaaggtaggacatacctttttctctatttgatattttgatcttaaaatacttattttatgacatatattaacttagtgtaacatgtcaatatgttgaaggataggctttacctctagtacatccaaccatgtcaacctcaagggcaaagacatggcaacaacaaataacatagctgaggagcgccttgttgacggtccttaaataccaaatttgaccgtcacttcatgcataaaagcaaatgaaagaaaataaaaatggaatacctaccaaacttagaggttgtggttattactaaccatttctacaagtcttggtgaatattcgtatgcaggtgaattattgagaaaacacacccaacatgcgacaaaatacacctccagacaatcagatacgagttaatggattttttttttttgggggggggcacaaaccagagtaaaatcaacatatttgaggccaaccactgtgtaccgtcatgagggcccaccgggcagtgacccatgtgaaggtggtgcgagatagcttggccaaggtttggccgaaccaggggtggctcccctcgcgcccagcttccatgtggcgacgacggtggcacagttcccaaggcaagaaaccaacatctaatgatggttggaggacatatggaggcttgaaaggagttggaggagaatattcccttaagaacatccactctctcaagtcatctaacgctataaatagctcgtccactcctctcttccattttgcaccaacaagtagagtacaactcacttatactagccacctagtcgcgcttcgcatgactctgagtgcttgcataacctgttagtaagagtaggcattgaaatgaccttgttactgcccattcatatttatataactagtaatcgtgcacgtgcaatgcacgttttcacaatttacattctttcaatgcaaaatttctcaattgtgtcaaaatatattctcgagagccacgtgaaattaaacagaaacataaattgagtttcattttcacttccatggtttccaattcatttatttcaacacgccataaagattaaaaaacaattgagagatgtctattacaacctcattttgtgaggcaagatgcagaagttcatgagaatatcatggagataaatttaaggataaattccttaatgccagatctattatcccatggttattcaaatgacatgggcaaaatctcttatattcttagatggagttaatacaatataatccatttagaacaatatttctcttttcctaaaaaaacatggccaaatattcctttagaaccatccaatgcatgtggtggcacaattcaatattaggaattgttgtttgtggtagcaaaatctcaatcaaaagagtaaaaaaaatgctgccaatctcatccctttcctaaaaggattatattgagaagcctgatcggacatgattgctatcataattacttgcatcactttcatatcttacttgtctgcttgggttcttgtccaattctcatcgttgattcatcgccacatcacaacttggattttaaccccctggttcatcacttcatcaccaatgtaatgctatagcaagtgcaccaccaataacatgtcgaagggcagttggcagtagaataaattgaggatgacagcatgggaaaagataaagcaataacatgtcaaatggcagctggcagtagaataaatcgagaatgacagcatgggaaaagataaagcactctgggatcatggatggattgcttaccggctaactatgtcaactattaaaaagcaaaacaaatagtaaaattggttgtctgaaaaagtgtagatgttcaagatcaagtatagggccatctaagctgattaggcactacaagcatttgggcataaccagtggcggagccagcataaaaattatagcggggtttaaaccaaaattaacaagagtaattaagagacatttaaggttgggttaggattagcgggggttaaaccaaaattaccaagagtaactaagagacatttagggttggattaggatttttttgggccttagccttttaggccttctaacaacctcaaacaaagtctatattagcccctcatctataaacatatggattagaattttaggtgtattatgggggctataatggtatattaggggtaggggtctaaagaggccccgcccccacgctgttttcccctaggcataactatagagtttagttttccaagattccctaacaagcacaacagtaacatatatacaggaaagcttagaagacatcaaaacttggtcttgtatagctagttaaaagtagtaacaactatttggaggcaatacctctgagtccaagtagtaacaactatttggaggcaatacctctgagtccaattttgtatttttcatttgcccaaaccaatcatgtttagaagattcctgatgcttatagcccttgtaagatgacgatgttctgcaagatgaaacgataagttgagtttctgttaatgacaatgatactttgttgccttgaatcacaaataatttatgaaactttatgaaaccttagaatcacataggtgactccgaacagtagcatagccatgaccattgaccatattaaaacactgttgaagtgtgtagcaacaggaagagcaattgtcaaagcctgaaatcattaatatgttgaagtattatgctcctcatggaagcacctctgcaagtgagcatgatacactatagagataagcggttaagatgaactgcctttgtagtccacgcaaattttaatcctgtaggtcagcaatatacacgcatcaggtaataataattaatacacacacccagcaccagcagaccatcaaaacaaatatgtgcctgaagtaattataagcctgaaatcattgtatgaactgcagattgtgaatatatataaacttgatgtcccatcattatgcatttgtagttggacaaccatgtataatataatttggaagacatgtactaacagtagtgttcataacaaaatattaaggtatatatagcttgctaaagtctatcataagttgattggtaatatttcttcgttcatatgaagaacttgttactggagcatattgttgcacctgtatacatgtaaatagattgattattaaaatggtaaagctgaaagaaatatctgatgataatttaaatatatgaatagtacatatatagaaaggttgagtagtcgtgcaatgataggtgtaatttataaaaatatagacataatgtccatactaaagtgtatgatttagaaggatagcagtcaaatattttatttcatttccatattatgttagttggatagaagtataatagtttgataattgtgggcaatgagatggaatttgtcttccataaattcgtaaagtataagtgctgaacattatgaaataaaagaatgaaagtaaatagtttattaataatatatcacctgacaagaggtataatagtttgatagttgttgctaggaggtagaacctgtgcttcatatattccaaaaacaccacctagttatagaatagattgaacataagatttatgttcagtagattaaatgctttatgatttatttcaaaattatgctggtgattaaatgctttaagaagtctaacaacacatattgatggtcctaaagttttacataatgtgttctatattttagctgttatacttttactactccttgtacaaatttataatacaattactataaaagatctataatttgtccataaagaaatttggcatgtaaacgtggcacttaccttagtagaagaacatatgcatggtattcatgattcatactaaccaaaagtattagtgatagaaagtggcaccattcaaaatattgatttgagttgcagaggaataatgaacatattatattcaaaccatccttttattttcaaattataaaaggtttgacgcattataatgtgttaagtttaaaaatttagaaggttattgtaccttagttggtagttaggtttttgttgccctccgatcagatgtaagagttatgtaaaccagagagttttcttcagtgaaaaagttgtgcaatatataaatcatataataatttaatgataaactataagtagatttaatttggatagtcttcttctcatttttatatgagagaatctcgatggttttttatccttgcctttttctgttataatgtgttaagtttaagactttagaaggttattgtaccttagttggtagttaggtttttgttgccctccgatcagatgtaagagttgtgtaaaccagagagttttcttcagtgaaaaagttgtgcaatatataaatcatataataatttaatgataaactataagtagatttaatttgggtagtcttcttctcatttttatatgagagaatctcgatggttttttatccctgcctttttctgctatcttccggatggtttttttaaatatttgtttgactaagctactttgactaacactgttatatgacctttcatctggaactatcctgatagctgattggtgtattatcccgatgatctaacggtccacttttcttcccactatcatcctagggctattgttattcaggtgacgtggctcatccttgttggagagagcttgttgctttcacatatgtagatacttaggcattgctctagtagagtaggaattgagtgaggggagttccggagatgttgtcactctctccgatcttgtacctcgacgaatgcttcttttataagtgtattcatgatctcctttagttgttatttttttatttaagtaagatatattctcattgttgtgtgtgcatcgctctgcttagatagagtaccttagttttagttcatagcaagataaaggtagtaataaatagcatagacacggtgttaggctagaggctaggactccatgagtcgtagagataggcggcatgtgatgacaaccctgtgatgctaacattgcctatgctaaaactgagctaatgctcaaatttaggctccttaatatgagatatttatttatagtacatatcaaatattgctaattggatcttggtccttcatgagttgttgaaaaattaaaatgctaatcgcttgtagcctgactggatgattgtaactttctgctttctgcttcctttgcagttcatatttttttgcccgactttcattcacttttaacactaaaatttgcaggttaacagttcgtgggtgcgctgcaatgtgttgaatagtctcacattggttgtggaagggcaaaggacctaagatataagtggggggagcccctcacctcaatggctagcttttggggtgggaaatgctctttacgatcctacaattagtatcagagcctggctaggttaacatctctggcccgatggacacagtgtgtgaaggcctgatggaccgtgggtgcctgcggagtccgtatacctgatggaccgtgggtgtggggcccgtatacggtgaaggggcggtgaagggctgagggacaccaatgtgtgaagggggagactgttgaatagtccgatattggttgtgaaagggcaaaggacctaagatataagtgggggagcccctcacctcaatggctagcttttggttgtaaaagggcaaatgacctaagatataagtggggagcccctcacctcaatgtctagtttttggggtgggaaatgccctttacgatcctacacaatgaatatatgaagatttcacatctgcaacacatggccattttgtaatgaggaaagcatgttgtactggttgaacaaatggccaagcaacacaaactacaagagaacttgtcatccttataatagttcataacatgaaaatagtcttgctagaacaattattgaacaaatggccaagtgacacaaactacaagagaacttgtcatccttataatagttaaaccgttgtgtttctttcttctcctatgtattcggcaggagtttagaatttggtgctcaattcttgtcatatataccgaaaggaaaactgctagtattccacgttattattttgacatgcatgtagtttgcaatatattactttgatatgaatgtgttctgcaatatagtactctaacatggataatggtgtgtataccaacatgcccagatgcagcatgttgttcaattcatcagttcatgacagtgctgagttttcaggggtagcgtttacccaaacaagaaaaaaaaatcgaggtgtatttacaatacagctggaaagatcacaaggattattttcttggggcacttgaaaatacaagtgtaaagtttttacacttataatttttttcaatgtttccaggcaggcctctaatcttacgaattctttaccattagatcaaatatagcgatacacgaagctccctaatttcctcttttatcttctccaccaccttcttcactttcttgatttgccgctagccacatgcagtcagaggcactctgcgaccctctgccttgcatcggcgaggcccgctagctagcccaagacctccacccctccgactctatttttcttttcccttaaagctagcctatctcccccgtgtggaaacggatcccctgactttgtgtagtttacagttatggcactgacatgtggaccttaccaatgtatggcccacatgtcagtatcgcaactgtaaactgcataaagttataaagttataggggagtctcattccccccttatggttcctcccattctaccattttctctttctctggcgttatttatgcccctcctaccttcattgctttccactgtccctaaagctcctaaggctgtgttctttggtctgtgttcacaacccctctcccttgtatttcgcatacacgcttttcaaactactaaacggtgcgttttttaaaaaagtttctatccgaaagttgtttaaaaaatcatattgatccaactttgaaagaaagttaatacttaattaattacgtgctaatggaacactccgttttctgtgcggaggagatgggttcctaacccgaacaaacgaacgcagcctaatgctagagaactcctccaactcccactcagcagagtttatggagcggtcagccacgcactaatcatctaacatgagatccgaacaatttatacgctacgtacttcttcgaatgaatcaatacatctttggtctcttcatataatgccaattgtacattttttacgtacataataccaggggcggagacagcgtgggggcggagggtctttagacccccctaccccctaatataccattagagcccccataataccccctaaaattataatctatatattcatatatgaggggctaatatagactttgtttgaggttgttaaaatgcttaaaaggctaaaaaggctaaaaaagtcctaaaaccaaccctaaatctctcttagttgctcttgatcattttggtttagccccgctataattttttcctggatccgccactgcataatacttatactagtcacttgtcctctgtacaccagtttccttttttttttctgccttcatttgaaacctctgacagccacggtcaggttctttacaagctcaaccgctgtcgaaaaaccctcttcgatctgcacaaaactgaaacctgtcaaaaccagctataacaacaaccatctaattacaattttacagccacatttacacagatgcgaaacccaaatgatctaggagtagtagacaggtaaagctagccttgcctttgcagtgatggtgatgttgaggcaggaatccgtgaacggcacgacgctggtgtttatgatggacagtccctgcttctcgagctcggagaggatcatcaccagcaaccctctcctctccttgcagcagattttcaggaggacggtgttgccatggatgctcgcctccacggtcgggctggagctggagctggacccatcgtcggtaccggaggaggcgctgccgccatcgtcgtcgtcgacggtgatgcggcacttgctctcgaaggcggtggtgggctcggccgttctccgcgagccttcctccagggccttcaccttctcctccagctgcttcacgtagtcgatggtgctccccaggagggagatcttgtctgtctgagagagaaatggacaaccgtgttaatgccgcatttgccaaggaatcaatgcacgccatgatcggggcacatgtacacacaccttcttgaggccggggacaatggtggccaacgccacgaactgctgctgcagcttctcccgccgcttccgctccgcgatgacgtgctcctgcgcgttcgcgggcggcctgctcctcctctccggcggctgctggaacacgccgacgccgtcgtcttgctgccatccccttccggagaagtcgagcgtggtggtactaccctgaacctgaccggcgaaggagaggacgttcgaggacgaaggcgacggctgctgcacctgctccttcttggtcgtcgccaccgctccgaacgccaagcttggcaatgccgacgagccaccgaaggccgggaagctggagcagtgagacggatggaactggtttggcgccatggatgctgggtagaactgatcaaatcgaactggttgctcgacgagcggcgtcccagcgaattgctcttgcatcctggcgtgctcttcttgatgatacatgtaggttaactcttcaggctcctgacattaacaatgcaataatcatttcgtcatacgctttgctcgaagatttcagagcttacatggaaggactggatgtacttgccggctccgtgagccactggttttgctcgtccatcgcctaatgttagcttgggccttggtgtcgtctgaaactctgaatcctgaagaactcgaaggcaaatacacgtacttcttgcccgttgaatttgctttcgctgtctcctatctcctcttgacttccgatcgatcctctcgtgatttatatacaggccaaccggccgtgtgaactactgaaacagtctgaagtctgaacctatgggcattgctgttccgaataaggcgtccacgtgctccttgttgcattcgggagataaggtgtagttgaggcgagtactgagcacccagcaaatatttgcacgtttggctctgcacacgcgtttcaatttctttttcagtgccttttcaggtgtagtctggttccatgttgacatcacggcattgatctcgggagatctgttgttatcttctggtatcttttttttctctctcgaccagaaatatgcgatctgaagaagagttcaaacaactctttctcccagaaatatgcgatcttataaaagaatagttcaaacaactcttcgagcagacctcagcaagacctgtctgaagattcagtaggttcgacgacagtgacactttgttagatagtgtgctcatctgacgacgaaacgaaagcactcaaaaattcgatccttgcagctgagttgtgcaattcgtacatggatatgtactggctgcatcgaaccaaatcggatggtacagtaggtagctggatggtgatgtttttggacggatgtgtacattttttgttggacgtaagtccacactacgcagtttgtgaacttcgtcagcagtttgcatgctattactttatacttctacaattgtttagggatacatgtgaaaatggtgctgcattctttatgatgaatcagcaagctttagattacaaaaagcaaatcccaagaaagagggttcagatcaaagtacaaatacgaacaactgttccaggacagctaacctgaagaagaagaaaaagaggacgaatccaccattgttttaactcgaccccatcaatgaggttaagctacttattaaaatatcatattgctgcactagtgtttcaagtgtgtagcttgaaatacggtttatggcacatgccgaaagccagcaaatctgacccagcaggtgccaccgatctcttcccaggtccaggtgctatctgttctcaagtgggacaacccagtaaatattgaaaaaaaatactccctccgttttttaatagatgacgccgttgactttt

SEQ ID NO: 33238 - DNA, 3630 bp, Oryza sativa
ttttctcacatgtttgaccattcgtcttattcaaaaaatttacgtaattataatttattttgttatgagctgttttatcactcatgatactttaagtgtgatttatatcttatatatttaccataaattttttgaataagaggaatagtcaaacatgtgagaaaaagtaacagcgtcatctattaaaaaacggaggtagtattagcctgtttcgtaatatatagcacctggtaaacgaacatgcagttgaaatgtataacgaaacatggttcgatattattaaataaggaaaacgattacaacatatttaacgtcctcttcattatttggttaaacctattacgactttgctgcaattttagttaggcatttgctacaaccatatcaaaacgattttattaataatttataactttaacccactatgtctcggcgaggagcaggcggaggtcgaccccggtggcagccctaggggcagcggcggcctaggatagcatcgatctgagcaccggcggaagtctttcggcgaggagcagacggaggtcgaccttgtcggtggcggcagccctagggacagcggtgagctgggagttcggaaggtagaagagcatcccccgacgacgacggcggccttatgagcggcggaggcctagtaatccggcgaagtggaaaccgatcccgtcgacttatgtccggttggctaaatctgactaaacaacgaattacgacggacgaaagtgggctaactggcagcgcgcagcgttagctcacctgaaacggatgaagatggcaccaatggaggtttgtagcgacgtcgcacttggggcggcggcgactagacgacttccactcatcaaatctagtcatttcaagagagtatgtcaggaagcaaaaaggcaagggcgtgcctaggtcgttagttttttttttcttttttggttgtgtgctcttctctttattgaggtgtgagtgtaaatgttcttgtatcctttcggttttgtatatctttggtggatgtagaaaccggattaataaaaatctattatataaaaaaaatatgtgtctacaggtgggctctatttgggctgtgtgagttccaaatgcatgcctgacaggtaggcttagattcatcaagtgaacaaaattgcagttttttttgggtaaaactatcgacaacacacaatgttacgagagatacacttgatagtgcagtgatatggggtgtggtttcaaccccaaggtcccgtgtttaatcccaaatatactcataatttcttcataaaggagtgttaggagggtcccgtgttcaattccaaacatactcatagtttcttcataaaagagtgttaggaggacgtctctcccttcaaatctttttttttacacagtgttatgaaatgtacactattagttttaatgaattacaagatgtagttttaagaaatttcccttcacactaataaatctaaacctctaatgacttaaatcagagaacctaaaagtcttaattactagagcagaacaaaagaaggattggtatattttagcttgtgatctagcttttcagaattacatcatcatcatggtcttaactcatctaaccacttccgaaagaaagcagaagagtctgatttgatgggtcctgtacctctctgatggtgaacattgctgcccgggggactgaacgtgtttgaaattcagatgtttttttttcttttgcctagattcagtgacttgaatcttccaaaaccacatgggctaatcaccaattaatcggttgactaaatttataaactaacattggccaacttgattaataattacaaacggaacctagaaaacttggtagtgctgccagcatgatatataatgctagctagcacacaactagctaatttgcagcaacaacaaattactcaacttggatctgattagttacctaagctaatcacatgccaatgttatgattagccaatttattttagcccaaggataacttaatcaacttgcagataatagctggtcgagttgtagaagtcatgcttgcatcaacttgggcttacaactagcaataacatcttgaccttgtacatgttggcacattgcgttctgatcgtattatataattgctaacaaggtacaaaaaaaccaaacggcagatatgcaaatctgatgacctgataatagccttaaagtttaagacttctgcagcggttgcacttcacctttccacaggggcggatccagaaaaaaatagtagtgggggctgaacaaattacgccagcataaatcgaaacatgtctcacatgtaaattggctaaatgtcagttcaaggtacacattgaattaatgatatgtcgagaattttgtccataccaaactaatatcgaatagatgacgtgtcacacccaatcgtctattattcttcatgagtagtaatttatacaaagaaaaaggcaaattaacgaataatcgaaacatacttattttggattcaaataatttagagatttagggaggaatggaggcatagagcataccactaatttctgttgaggtactaacatctgacgcgctttcatatcttcaaattgttggatgattttttcatccgattgaaaaaaccctgacttgggtttctttggctaacttaaacactcattactggatggaggatcactttactggatggaggatcactgccatttgtgttgcttaaactaaaataatacgtgagcaatgttctttttgacatgttgacaatctaaaaatgtatagaaaataattataagtttcaagcacaagtgcacaacctcattaagacacaattttagactatctattagtattagaggttactagtttaccgatttctaacttcaaatcttcaatcacagtcacagtaggctgcgactgcgtcgttgactcgttgctgccttgccggccactgtgccgctgacctgctgcctgcctgcctcggcgccttgcgccctcgcggcacctcgccagcgagcggcttgccaccttcccggcggcgtggcggcgcaggcgctggagtgctggaccaccgcctccgcctggcctgcctcctgtctggcccatcgccggctcactggacgccgccacggcaccttgccgctcggcgctcgccagcttgcagctcaccggaggtcgccacctgctccgggcatgcactggaccaccggggcaccgcctggcacgcctcccgtctggcccctcgccggacgccaccgcctgctcggccgccgcccgccgcctgcgcctattcgcctagggttagggatttaggagaggaggaggtggccagtgggattggggaattggggaggcgggaggccgggagggggagtagccaaatgggccgactggaatctgccaccgtgggcctttgcttggagtgggctagacaaaacttgaagactgcgctcgtggtcgtgggctgctcttcgaaacaagcccaaatcacgaaataacatcgtcttcaacctccagccttccctccagccaacctgacgaagctccagccaccacatctcgtgaaaaattttagtgggggcttaggggggtctccatggaccctggggcggtagtggggtctcaagacccccc

SEQ ID NO: 33239 - DNA, 5462 bp, Oryza sativa
gggggggggggagggggggggcgggtggggggggggggggggggggggggggggggggggggggggggggggggggggggggggggggggggggggggggggggggggggggggggggggtgggggggggggggggggggggggggggggggggggggggggggggggggtggggggcggggggggggggggggggggggggcccccccccccccccgcccccatggcaaatccgcccctgcctttccaatttgttgtgatgaaatttggaaggttcttaggatgctttctacaatgaccaatctgtgctcaacttcaagtaatctgtgaccttttccgtgctaaacttccatattaactctgcgagatactacggctcttctatggaccgttctaattgatccattttgtctccagaaaatcgtattatgaaacggccgaaagaaaaaaactatcctcctccgttgctctgcctcgccgtgggccatcccagcaatgggctcccctcaaccaacttatttcttggatcgtattgggcttatatgtatcgtgactgatgctgggcctcctatgtaaactaatgcatcatcgtcaggcccattttcccatgtagacaacgaacacattcgtcgatcgtcaccagtgatttcaccgggccggcgaagagtgtcatcggtgatgcggagcagatgtaatgccgccgtcgcgtactcgcgtgttgcaaaggacgacccggcgaaaaccgagacgaccgcacgtcgagttggagcctaacacggcgcgcgccaacgttggtgcatattatgcgtagcaccaccacaccactcggccgccccgcgctcgcgagtgggttagtagtagggtggcgccggctgcgggttcacacaccacatgcggcaccgtacgtcgtcacgcacgtagtcacgtaccaccactagcttgaattcgcgggatcgcggagactcgtgtcgggctcgttcgttccaatcgcccagattccacacgtttgcgtgggccgcaggcgacgccgagacatacgtacgtagcgcctgcatgccgcgcgcgacgatcgggtcatcgcggcgttccgcgcgcgagaccgatcgagcctgtcgcgctcgcgcgtgcctcggtgcgccggtcaatgcgtttctcgcccggattattgccgcgcgcgcgcgacgtgcacggtccagcgtctcgccgtctggatcgctatcgctgtatgtgtacatatggtccgagatctcacaagattattccgtttcgttgtccgatccgtctcgcgcgctcgtgcgtagctagcggattttcaggtgctacgtacgtacgcgtcagctggttttgctgcacgcgcggtggaggtgagctgtactttcgaatatgtgctacttaatcttcagtttgactgacacggtgagctctagctgaaagcatgaaactttgaccggccgtcgcatgctttgcattcatcatctcgcagattgacaggcaccattacgccagcaaggcacacttctcttgcatggccagtagcggcacgctacggacacctcttgttcgacaccactattttcaacaatgtgtggcatatgctgcataagaaaaggatctatagtcttcatacgtctactacctttgtgtcacaaattgtatctgtagcagttgctttcggagacatgtttgatgtttcccgatcgagacggtccgaattgcgccactgtcggctggctgacgccgacgggctcgcacccagagcccggaggaggccggacggctggacggacggtcagccgctgcgtggttgatccatcgatccacatcataattcagagaaaaaggccggtcccgcctttgcattgcccttcttcttcgatccccactgcgcccgccgtcctgatcgatctcggcccgggagttagtgtgagtgggctagtccaagcactagtttgaaatggccactattgcttgctactcacttgcatgcatgccggtaagctgcaaggagaggagattctttttccccattgcggcgcatgcacatgcatggtctatggcttgtgtggattcggtcgcttcggcgaccaccattccattccttcattccccccctcttctctcgcctttccgtgtttgattttgaccaacttcttgccaaaaaaagagcccaaagtggcgcgagcgcattgcgcgaaactggttaattattccattggtctcgatggaatgtgcgctgtgtgtctgttttttcttttctccaggtagtcaaatacaggaagctctgtatgtctgtttcctcgtagcagtatcgagagcttcagagctctggagttgcagtactgtggtggtgttgttttctttgacctactacatatatgctcatccttgaaatatacgtcttgcaatgaatctgacatctgtgatggctaggtgaaagtaattgtccatccacgttttttgttagttccacacaatgccagccaccatgggaggcattgattcatatgcaaagcaaagctaatcgaaattctttctcgtgccatggaagctactgtcaaagtgcgatcctcggtgaattccttcagaaaccaggcctatgacactgaacgaactctgaattaggtcccgaaccaaaatgttgaggtacagacagatcccgggtggatctgactcggagccaactttgatccccatctgtaaacagaaatgataatattaatttatggttagcaaaaaagattgattcttggttgacacacatcaagctttacatgcatcgatcagaaaggcatgatttagaacatgcttaacaactcaaatcgactttaagatatgcaggagtacgtgagcttaagcttgcaaacttctaattaaactgttcaattcctagcttttggctgatggtttgggaacttgaaccaccagcaagtgcatgaacatcatggtgagaccgactgtactgtccctagccagtctttccctcccttccggccacacgacaacaaagagagaactatgtatatcatattactattacggaagcaatgatggattagtagaagatcaagccctacaagccctttaagcaccttttccaaagatgaaaaagatatcgaaaccaagcgagacagtgcctctctgttctaaaaaaaaccaagttgcagtcgtataaatcctgaaacgagcattagtactttaatctaattggaggagaattgttcagggtggagtacgtataaaattggttcaaagtggaatgttgaagtatatcggtgaattgtttactttttcttatcaatgctcaagcttatgtactaactagttggttatatacttatatgctattaatattatgtaaaatcaagggcacaacatttttctatcaaaatcaacatgcatatatatatatagctgaatatatgaaagctaaattctatatgtctgatgttattctatttttggtgtgtgatttcctaaaccaaccacgtaagcttgtaacagagcatctgcttaattgcttcatactaagcatcctcttcttcctttagttcctttcctttttatttctctgaaacaaagacagccaccaattaggacaaaccaaaccgaaagcaggggttgcacacatgttaaacaaagcatggacgttcagaatcttcagatacagcccaaagaccttaattagctcaccaacgacgacgcccctgcagcctgcacacacgttgccaaaaatggtaaaaaagaaagtcatatggatggcgcatcgatgccctaaacgatcagcttaacttatcccaatcacattactgttggtcggtctgctccaagccggccatcttttggcctgctgcgactttcagtgttcaaactccaaagcgatcgatgtgctatgatctcatgctatttgtagcttgcagcagcagagatcaaaaggagcttgaaaaaggagcaatgtccggccgtcctttacatctttctaaaccctagctttgcttcatcaagaaacggatatgtttttcttttcgccaccgttttcatttcggtgcagatcgatcgatcgttcgtcgatagcgccacacactgacgggagaaagggagaatttgatcggttttgtcaatgcattggagatcttacgaccaagattgacacttgtgcgtcgtgtatgtagtgggtggttgggtagatgctttgcccatataaaattacttgggagttggatatgcgttattgggtcaatgaaaggtaattattagtagcgtaatgaggcagtatgctgatgtgaatatcgtccgtaatgtgtggattgtacccatatgcttgcatatccaactaactatcggagaaagttttggccagcttttgcaaatgataagtgtgtagatctcgaccatgtgggggccatacatataaacaacgtgtcaactgagtgtgttgcacgagtatccaagtatctaggagccagagatgtggctaggcccttttgcttttggacttgacacatggcctagatattctatgccaaattttcagacaacttttagtacatgttcactgtccacgcacgcatgcatgatagagatcgagtgatcagcaaacattcacagagaatttccctttcaagaggacgtacgtgcatgcatcgagcagtgcaaaaaacacacttgattttccaagcaaagtattggagcctagctaaccttgctcagaaatgcttggatttccaacacatctacatatggatacaaacgtgggctgtgaagcctatagacaaatggagcccactggcctcaaggctttacataattggcttggttggtgtgtatatatacaaagttgcattgacttgtcataagctctaaggttctcctagcctcgtggagacatgaagtggccggtttatgataagagctcacaagtgtaaagaatacttgtgaaggccgccttctaaccactgttactttgtcggtatgctcatgaacacatgtaacgcaatgcatggtgcttcaaaccctaaaacctatgtataggtcacccttattgatgggaagcaaagcataattcctttgaatcctcaatatgacaatattgatcatgtcatttgttgtaattaattaatactagtatagactatgggcatgtttagttggcaaaaaaatttgcttctgcatgtcacatcggatatacggaaacacacttgaagtattaaacgtaatctaataacaaaacaaattatagattccaccaggaaactgtgagatgaatttattaagcctaattagtccatcattagcaaatatttactatagcaccacattgttaaatcatagcgtaattaggcttaaaatattcgtctcgtaatttcctagcgaactgtgtaattggtttttttttacatttaatactccatacatgtgtctaaacatttaacgtgacagtatgaaaaattttgtttggaaactac

SEQ ID NO: 33240 - DNA, 719 bp, Oryza sativa
ttgggtatcaagattatgtgcctgtacatttttagatttgagccaatacaaatgtgagatttatctaccatgatgtacagaatacaaatatgtagatacgcaagaacagaaaacatgaaaaacatcaacagataaagagaagaaattacaccagcaaaccaaacaaagtcagtaaaacagacggtttttagtcagtaaacctgcgtgatccagtcgtcaggcaggaactccgcggaggcggcggcggacggcccacctcacccccccccccctccccccggctcgccgaaaccctagcggaagctccggcgatggacgagtgcggcggaggcggcgctgctgcaaatgtggtgcccggcggctgtgcagcacaacagccgcagcacgcgctccgccacgaggacaatcttccgcgcgcgggggtggggggagcggcgccggcgaagcggagagcttctctttagatcgtaacagctcgccgctcgcgtcgcgtgtgtacaaggaaggggaaattgtgggggcaatgataggttaacgcgttcatttaaaatttgtttcaacgctcaaacactgagcgcctgtagctcagtggatagagcgtctgtttcctaagcagaacgtcgtaggttcgacccctacctggcgcgtattgtttcgttaaccaattttattttttttattggtttgtaatatatgcgcgtattgtttcgttaaccaat

SEQ ID NO: 33241 - DNA, 15703 bp, Oryza sativa
  unsure (1)..(15703): unsure at all n locations
aaactaaaatgtagttgttcagcttacccgatatcttggtaaatcgcatcagaaagatctttcagctttaacttttcagagccatcttcatttattaccactgactgcttcacctctgcaattatgttgctgcgtagcacctcctgcatgaaaataaattgcagccaacttatacaactacacagcattaaggtcttatctggtcttcagatgtgtgcttctgctaggccagcagtaaatcagagtgaaacatgctaagcttgattaaccatgtatgctggatgtacatataatacacataaacttatagaaacacagcatttaaaacttatctggctcacagtatgtgtgctgctaggccacagtatgcaaatcagagtgaggcacactaaggccctctttgtttaggcttaggcttattggcctagacttttaagtcagcttattggcttatatgatttataagccggtggatttaatgtcctaggtttagtggttgagtcatacatctacctcacataaactaaaaaagcttctccaacctagtttttggcttaatagtgttagagtggcttatggcttcaaaaaagctaaacggaaaagctgcttgtttgtttaggcttagacttttcgacttataagttggcttataagcctaaacaaagagggcctaagcttggttaaccatgtatgctggctgtacatataatacacacaaacttatggaactacacaacattaggacttatctggctcatacctgtatgctattgggccatagtatgtaaatcagagtgatacgtactaaactttcagccttgtttgcaggcaaatcagtatgaagccaagactattataaaaaacaaattctatactctaggatacaactcttttttgcagtcatgggatgcatttacaagtttacagttgtgggatattagtatatatcatgggaacacgtttacagtcacagcggtggggtgctacaaacgtcttgggtactagttacctcttccacataaataacaatgaaggcatgccaaatttatggcataaaatgagactatcttcaaccttcaatggggttatggggcgcttgattcttcaatccattcactgtatccctttcgacacagctctacagcacatttatcttttatttatctataataatccttactatctatataagtacaatccactaattgcagttaacttaggccattcccaacccaatgactaggatgttgtccatagcattaaataagctaccacctaggatgaaagatgatgtgccaagtgaataaatgaggaaagagaagaaaaccaggtcttgcatgagacatggtttctacacaacatccaagatatcatgtgagataagtagcattaaatttaagtatgaaaaagtggtgtttgcattgaaatctagtactagtttcttgatgatgtagagtttatgaaaactatgactagtgtcttgggttggaaatggccttatggctatgaagaagccctcacgttgagccaggtcatcataattgtttcagccattagatgtctgacagcccaacggccacaccatctttaaccaatacttgcaaatttccttgtttttttacacaattagtcggttcaaattcctgcagcaacgccttggttaacccaccagtataatagaaagatatgtcaacaatgtgtaattgtgtatgcttcccaattcccaacaccaaaactagaaaacacaatgctactacaagaaaatttccaactttactactcacatggacaaagtaaaatgactattgaggacgcaatggtttcattggacaatgtaagaatatatggacctgaaacacaatttccgatgatatgaataagctggtaatcaatatgactcatttatgacgaacaaaggcgcaaccctactcacattcatatgtcaatagatgactgtataagatatgcaaggttaccaaacaatgtagtaatgaagtaaagcacacaaacagaagctgcaaaattttcttacgttccaaatttcctccgaatatattatcaagttctaaatgcgttgctacagcaacatacgattggttacattcctgataaaacttgaatcacgtagttctggtaattcatgagaacagacctgctcagagcatatacattcacacccaatgtctaaaacttaacacaagaaggcacattgcagttcgcctgaagttgagataatgcaggatgatctatgctaaatccactgtccccatggatgacttcaggaaaatcgaacccacccaatcgcggctatactgtcagtgaccccataccaaacgcaggatcaacgcaattctcagcgagggtttcaatctagagcgaccccttacagcaaatcctgcggtatacgagggggaaagtggggagcgtatgatgggagcttacgttgtccttgaccttgcggatgatggcgcggcggagcgcgtcgaagtccccgtcgtccttggcacgccccaccacctcagccctcgacggctcccgccgcatgccgagttcgcggagatcgctcatgggagcgcgggggtggagcacggctccgccgcgggaacctgattcaccggcgtacgccgccgccgccgcccttcgagttcgttgcagattggggagggaggggactccgtgcgccgccgcttgcttccctcagaaaattttggggtttcgtcggagagagcgagaggcgagaggacgagaaaaaaaagaaaagaaaagaggaaaatactcacgcggtacgtactcaagcctagtccctcggtcacatcaaaacccaacctaatcaaaatttacagtagaataatatgttatattcaatactaaattggttatttaaggtacagaggcagtacgactcaattcgtcccggtgataaaattgtctacctcgtcctggtgataaaactgtctagcgaaacaacccgtagaatttttcagtttcattggttgacaacattccctaataaatcaaaacagtttattaggaaataaaaaaaattatagataaaacttttatatgtttattcgtagtgacttaaaagccaacgctaaagagaaatggcgttgaaaacatcttaaaatcaactttaaaaattcaaattttgacttttattttggtttattaagtcaaccaatggagctctgagaacaaaagacaatggtggtgtttgaatctcttgaaaatgaagataaagataaagataaagtgtttcacgtaaaacgaggtagtaataacatgtgattaattaagttttaattattacgaacttgaaaaatggattaatctaatattttagaataaatttcatatataaagtttttgcatgaaacagaccgtttagcagtttgaaatgcgtgtcaccaaaatcttcatcttcatcttcatccaacacttgttggagaaacgataaatgcatcagacatcgaattcagaagaaaacacaacgccttcgcaattttccaagaacaacattctatcaaaaacagcacagatatcatcagccgaaggagaaacaggctagtatgatttttcttgtctaggagacacgatgcctcaactggcaatcggcaagcaaaccagatagtactgaagaattcacgtttcaggtcacatattcaatttcatgcgggatacacagagatattcacgatggctacaagctctcatattcatgtcaaatggtagatgctcgcgacttgagagaatcgcaacgcgactggagaaaaatgcaatctgatttcttctgctcacgcattcaaagtttctgtccataacatgagtgaagctctcacggctcaacggctgaaacgctctgaaatcgacttcggtatgaggctggttgtgtttgactgtttctccagcctgcgtcaagaaacgaatactgttaggattacatgtaaacatgcacgcaacatgtgcaaggggaaggcagcaggaagtaagaaccttgcaatctcttcgacagatctcattatttgctctgaacttgtttcaatcacttgtcccccaagtatcatttcatctaaaattgtatgcagctgcatttgatatttcaattagcctaataaaaatagtgattacctttaagcagtaacaatcatcactatgacacttccgttaaaaaaaacaatcatcactatgacacgagcaaagacagttgagatgaattgttgtaatgtttggtattgacgactgagggcagcattaccaaaggtgtgggcttagcccctagctctctctctctctctccgcaacaaaatttccagtgttactttttttttaccatttgtgtactaacaaaacaaactaacttactagcaaaacaatattggtcctctcttgtaaaggaccataagcatgctttatgaacttgacccttttatattcttcaagcccagcctcaatggagcatattcaaagtaaaaggatcaaaacatgagaatcactttaccttgttgaagttaaatacgatgtcaagctcacacacattcttgaagcatctgtccaatgtttcaacaaaaactgtgcacaagataaagttttctacagattaattgatctgctgcaatcatggctgataaaacggggagttaaagtgaacttaacagaagtgaaaagagctgagtagttcagcagctacccagcattggacgaacaaacagtgcatgtttggggttgggatttgaggagtagcaaaccatcaattattgagagaatgctaaatactagtaaatagtaatgtatgaacactgaaactgaaataagtgccacagtcatcagctatgagtttgaatctaaaagaggaattgatataaagaagcgcaagtgacattacaataaacatgtaaaataaggcaggtcaaacaactgaacaagcatgtagtaagatcgaacatgaacataacaattatttttggcatgggagcgtaaaccatgactgtatggttgttgccttgttggcatgtcacatgagtcaaacaattgcagtaactaataaacagtttcatcaataaggcactagattaccttgtacaagatcaagcaccgcaagttcattttcagagctatcaaagacaaaaacaaagtacaatgtggccaaatgtttgtagaccaatttcgctccctgaaagtgcaaaagaaaaggttgaccatcatgctatcatatacaaatcgctaaaaaagttgtttgtttccttgctacagtttgactgacatatagaagagaaacagacaaacagtaaatttcatgaggaagcatgaacttgtacagacgtcagttttttttcctttacttttttttttttgaagaaagtgtttgcaattgcatacagattgactaaaagtctaagatagtggcaggttacataacaaacgagagaaatcaactgacattagagcaaggagctttcaaaaattcctatgtcagttccagcatatgcttgtattttagcaagatttattacaagatcagtcttggagagggttcattaccggtccaaagattgcatcaaccttgacgaaattgctgacactgtccggccttgcagacaacactgcaaaacgtgcttcacaaatcaagcatactacgtataatcgtatacaaaaggtgaagagcaggaaagtagactgtgggtgatacatacactggaagacgccgcggacgaggtcctgatgcttctcggggggctgcatccaataaccaatccatgaagcagagaatagatagaaggggagagcaaagtggtcaaaagcatttcgtcaatcacgtaagctgctattggtcttgggtggggaaattgacccagcacttgtcgggtgggcgaagattggaggggtgggtgaacggggtagaatcgaaacctggtagctgtagaacttgaggaggcgcggcttgccctgcgtgctcatcaccatcacggcctggatcatggctgatggggatgaggaagaggcgagcgaaatcagtcgggtggtgtttggttagagtctgtaaacgcaaatggtaactgaatcaaataaaactgttaatggaatcagattcaagcaatcctaaactttgtttggcttgatggtgtaatgaaagccatttcctttattgtgttttgaatgaatacatttaacggtagtaagattgcatagcatacaaaatcttcctacaaagttttttttttttttgatctcaggcaaatttcattacccggctttagagaaaagcccaaaacagacagagtcttcctacaaagtttgggtatcaagattatgtgcatgtacatttttagatttgagcgaatacaaatgtgagatttatctacaatgatgtacagaatacaaatatgtagatacgcaagaacagaaaacatgaaaaacatcaacagataaagagaagaaattacaccagcaaaccaaacaaagtcagtaaaacagacggtttttagtcagtaaacctgcgtgatccagtcgtcaggcaggaactccgcggaggcggcggcggacggcccacctcacccccccccccctccccccggctcgccgaaaccctagcggaagctccggcgatggacgagtgcggcggaggcggcgctgctgcaaatgtggtgcccggcggctgtgcagcacaacagccgcagcacgcgctccgccacgaggacaatcttccgcgcgcgggggtggggggagcggcgccggcgaagcggagagcttctctttagatcgtaacagctcgccgctcgcgtcgcgtgtgtacaaggaaggggaaattgtgggggcaatgataggttaacgcgttcatgaaaatttgtttcaacgctcaaacactgagcgcctgnnnnnnnnnnnnnnnnnnnnnnnnnnnnnnnnnnnnnnnnnnnnnnnnnnnnnnnnncctggcgcgtattgtttcgttaaccaattttattttttttattgttttgtaatatatgcgcgtattgtttcgttaaccaattttttttattgttttgtaatatatgccaaagactaccttcgatgttaaataattttagtttgtattttcctagtacaagatttcatctattttgatttggtccaacacattgaacaatgtacagaacatggccatctaggtgttagcaatttcatcatttgttgattacgagtcatggcgcttattaggaaaaaaaatgtgtaaaacttttatattttttttacttaaaaactacttggaaaataaactgagataaaaagaattatcattttttttgcgagggagaattatcaaaattaattgtagtgtaagttttaaagtttaactagctgggtgacccgcgcaattgcgcggctagcacacatacaaaatttatatatttttaatctgattttacttcaaatttattaaatagctatctcattgtcttaagattttaaaaaaccaaaccttatcatccccgtgttttctaattttatagttctaaaagtcacaccagttgttatcccttacttatgtcatctcattttttatttgcttgctcgatctaccacggtttctattcattttccttggaatctataaaagttggattgtatagtttttagagtttattatctcgttgggttttatttttataatttctagaagtctcgttaaacgccgctattatacttctctacggtccgtccacttcctcttctctttattgtcattgagattttaaaaatcgaacataattatcgtttgtgttcagtttttttactttctagaagtcttgccaaaccatcagcggctttgccactgcactcctctacggctcgcccgctgcatgcactcctcaacggatcgcctgctgcatcccttctttattgtcattgagattttaaaattgaacatgattatcattggggtttactcaccttgtagttttaagagtttattgtctcgctgggtttcatttttctctaatttttagaagtctgatcaaacgttgacactatactcctctaaggttcgtccaacaccaactctttattatcattgggattctaaaaattcaaacataactatcgttaaaattcattttttactttctaaaagtcccgccaaccgtcgacggctctgccactgtactcatgtacgactcgtccgctacctgtcctttttattgtcattgagattttaaaaatagaatatgattatcattggagtttattttttttactttctagaagtcccgccaaccgccttgatcggttgcttcacggcctgcccgtcgttaatccttttaatcgtcattaggattctatttggtgttttattaatagttttagatgtcccatcaaatgccaccactctactcctttatagatctgttacttaattaatctcgttatatgttttagatgatcttttttttcaatagtctttattttttatcaccaattttagttatttataagttgtcttatttttctttttctaatttcagaatttattttatttgtatatcgaattttaattaatattgtattgtgttcttttaatatttttatttttattttcaaatcaagttgtttcaaaattgtattcgtacttgaactttctttttaatttgtctaattttggattttttttattttatacttaattcaattaatctcgtattagattcttatatggactcttctttcaatatactttatttttaatttcgaatttaagttaattttaaattatatttctacttaaactcttattttcttttcttttttctaatttccaattttaatttactttttattcctaattttaattaatctcttattgggtttttatatcgactcttctttcaatattgtttaattttaattctgaatttcaattatttttaatttttttttctacttgaactcttcttttcttttttgctaattttggattttattttattttttattttgaatattaattaatctcgtatcgagttattatatggactcttctttcaatagtgcttatttttaatcccgaatttcagttatttttaaattgtatttctacttagactctcattttgtttttcttcgattaatgtgggaatttctagtccccacaacgaacatggtgtctcctttgaaagagataataaaatatgaatagtattttatgtttgacttatttttttaatattttttgaaaactcatgtttgcgcttaaaataggatgatcaaagttggacaccaaaactcatgtttacgcttaaaataggatggagggagtaaggactaaatatggccctgtttacattccaacttttttcttcaaacttccaacttttctgtcacattaaacttttctacacacacaaacttccaacttttccatcacatcaaactttcctacatacacaaacttccaacttttccgtcacatcgttccaattttttcaaactttacacaacatatattgaagaataattgtattggtagtctagatgtggtgtttttttttccatctgcggccagttttatggtatgctagcttctggattttatttggctgcaagtctgaatgcatcaattaaattgggtttgcagtggacagatctagtgatagttcaattcctttttcacttcaaaatccaaatctacgtatgtattgaagccatccgtttgatttatttttttctatttggaatccatatggtattcaatttttttctttcccccaatcggacaacatcctagccaaatacaataaggaatcagacatgcatgcatgcatatttgtgatgtacctcaaagatcagagttactttcctatttgtatcgaatagagtttgattcatactgagagaacttttttctgataaatctacaccctttaatttaatccattacaatctaatggtatagattttttctctttttctccgattaatatgggaatttttagcccccacggcgaatgtggtgccttcttttcgagctgtcttaataatataatagatagatttttagttatggatgataaactaaggagcagaccgatgcatgtttacagtctcattttgcttattggagaatcagaagcagtaatagattttttgtttcccgagatatggcggagatcttacatatcactatcaacaaaattgttatatgtggcaggaaacagttgatggagactagtaagactaccattaccaagttcaagatcttaaacactaggctatacttcgtttgttaccagccacctaaattcatgtctttgtagtttgtaacatgaatgctactggatacattttcagccactttgcaaaaatgatatcgacatgtcagaaacacaaaccacaaaaaaacagagaaacaacaaaatacacaagtggtttcatgtcctttgtgtgtgcataggtggctgtaaacgaaatacgtatgtgaagctaaataatagctgagatgttggattcgatgttttgccactatttagattgggcaattgaacgcacgttaaaaggccccaatcagttacatatgggcatctgttcacagttacacattgagaaattaaataaaaaattgccatcaaaagcaatttccattttccttcatggacaactatatattttattatttccttttactttttcgaatggcaactttatatttttttttcttctgggctgccaaaagtaccaaacggaattatgcagtcatgcatgaagaggtgttttttggactttcgtgtgcaatgtgtgaggtgtcagttgagggatttacggggctcaattccttggagaaataaattcgtataattgagaggaaagcctcttttcaggactactagtccactgttcgtctcttccttagcatactgtgtgcataagtgaagaggggaagggggagccaggcatcttcgagcctaggagctcaatctggtaaggaattatgtccttgcttagctctgtgctcttcgatactgttcatggaaacactacgcaggattccttgtttgggagatgcttcaggtgttcagtgttaagtcagaaactggaaatcaaatttcttgttctctgattccccaaaatcttatactctgtgcaagtggggatcatgattatgattacattatgattttatcatcctcttcttccccgttccatcttatgcaggagtatgaaagaactatcaaattattcagcagtacttcatccttagtttagaaaatcaaaggggatttctaaaaggaaccttaacactgcatcctaataagttcttgagttgtttgcgagtttgatttgcttttgttaaataatttctagttatgattcttatcattggggaaaaaaattcttccatttatgtcctgtatgcagaattcatcgtagttcttgagaagtatccggtatctgtatgtatttcatattcagaatttagcaaggtgttcgtccaagaatctatcttctgctcctatgttttgtatgaataggtcataggttttcattttcatccgtcatgtcctatgtagaattcataatacatgagcagtatcagtgtcaatgacttgcacagttgtgctcggctgaaaaatttgtcatatggtgcagttcatcacagatgcctaaaatccttccattttaacaccttttctttagtttttgattgttgcagatggaatacccaaggacactcacttcctgaccgctcaaatatcccatccattccatgctctgatgtgagcaactcggttccaagaatcttggaaacatggggaaaattcccggatcagcagtcgccatggccacgccgccggagccgtcgtcttggctgagcctcaaggtgttcttcctgagggtgagcaggtgcgaggtgaacgagtccatgctggattctgtgaccgtcacccacgccccgctcaccccggacaccgtgctcgaggtgagcggcggcagcgtcgccagcaacggccacgtgtcgctccgcctggaccgcgccggcggcgtcggcgccgccgccacggagggcggcgactcctgcaccttcgtcagcacggcggacgtcagggtgtccgggagcgcgcggttcgacgtccagtgcagaggcgagcggctcgtcgtcgggatcctggacacgcgcgacgccggcgctggcggcggcggctgggtgatgaagtgccaggtcgcggcgcagcgcgggtcgggcctcgtgaggcgcggtagcaaggaggcgaagccgccggtggtggaggtgtacgtcgccggcctggcccgcggcgcgccggtcgtcttcacgagggcgatgcagctgcggttcaggaggcggcgccacgtcaaggccttcatggagcccatcccggagcacggcgagccggcggaggactccaaagaaacgctgcctccgaagcatgaaaccgaggtaaaaaaatcccagcattttctttctctccgatgaatctccgtttattttatcatcgtcgatttcttgaactgaaatgcttgagctgcaccgtcaatgtaggtgtcggagtacaggtgctacaagccggagcaggacgccggcgacgccgactacgacggcttctacgtgaagcctgcaggcgaggaagacgacgacggcgatttctcgtggttcaccgccggcgtcagagtcggcgtcggcatcagcgtaggcatctgcctcggcatcggcatcggcgccggcctcctggcccgttcgtaccactctacgtcgaggagcctgagaagccggctgatctcgagtctgttctgaacatcaacattgcatcaagatcactgtccatctcaaaattcagatatccctctgttggagatggactagtccagtgtgtgtgtatatatccttgttagtatagttgttactaccgtcgtagatagatgagatgtgctatctttggcactgttggttcactggtttatacttatatgatcaggcattgtcaaattgagaccctttcatatctacccagatcgatcaatcgatgtcattgatcactagtgcatctagtctagagccctatgttgttagactaatttcatttgaagattgcacaagtctattccgcacggttattacttgatgcggctattcttgaagattgtggcgggcatcgccggccggcggccatggcggtctgatagtcacatcgctggggagggacccaacaggaatagcgggaaactcaaggggctccaccggaaaactcatccgaattggtaatttggtatggatcgggcgatgccgtcgctagcaatggtagcgacccaacacggatgggacaagacacggcccatcgttgtttgcggacggcaaggggggaggcgcgccatgttattgggctcgtattcggacactaatacgaaggaaaagtacaccgaaggtccctcaacttgttgtcgagttacaaaatcatcccccaaccgcaaaaccagatatccgacgtcccttaactaatcaaaaccggtgacaataagtctttcagtagttttaaccccggttttatcccacatgtcggaatgccacgtcatctctctcccctgttctcttcctctctctccgcctgttgagcgcgagcgtgaggctctccagtactgagctgcaggcgagcaaaagtgggggaagacgtcggcgccgcgggggaagcaaccgctcctggagcaccttgagggaggatggtagctcgacggcctcaagctcaccggcagagtcggaggagagcggcacctccgtactccgatggcggcgcggccgccttcgaggaaactgccacataagcgccacgtagtatgccacataattgaggagactgcacactgaaactagcccatacgactctttgtgggccgaaactgcccagttacgcagcccatgccgtcgagctgtcggcaaattgaaaacagttttgctagcattgaaaactataataaatttgtagtggcaaatttagacttttcctcagcggtcaagcgggcccacatgcagtgacggagagctcgtattagtggcctccctcaatctctgtgttcacgcatgacagccgcatcagttgccgcgctccaacgtatataaaaccatcacggatcgttcaagttgtacagcaccgtcatcgtggatggcaacgcgcgtcgaggacgaggaggaggcggcggcggaggagagagcgcccgccgcggcgttgctccgccggatcatggcgcccatcgcatggagggcggcgcccacggcggcgtcggcgtcgtcgtcgtcgtacctggtcgccgccgaggccggcggggtggagaagatatccatgctgtccggatacgagcgacttccgagcgtgtatggcacggcgttccacgacgacgacggcggcggcgcgtggtcgtcgtcgtcgtcgccgccggcgtgccctccccgcgcggccaggctgctctggggggcgctcacccgcgccgtccagaggcctgggaggtgcaggtgccccggagacgaggaggcgggggtgacgacgaccaaggagcggaggcggtcgtcgtcgtcgtcgtggcggccggaccccgacaggcggtggccggtgcagggctggagctagccgtatttgaatgtatttcttggggaaatttgaatgtattttctgttggtttgatgactgttcaacgaaattcagttgcaaatatgaacataaattacgtcgcaaccgagactgtggttagaccggaacagaggccgaatctacattctgttcgagcccatctcttccatttggaagcccatttcagaggattgatctgctcaagcaaattgcgcgggtagatttctgcagctcgatcagcgaaatgcttcccatctactcgtcccgtgaatcttaccacgcaagttggcatgtgtacatgtaaatgttcagatgctatgctttaccttgtgacaaagaccactgctactcctgcgcaatagcgcaagcttcgctttgaggcgtgagttacagacttacagtaatacagtgcacatcgagagcaagtgttgccatctcaaagagaaataaaaggaggtgtttacacttcacagtgtcaggtaaggtatatctcaatcagaacattgctatgcttttcattttcttagctacaatctccctgttcttttccgagtgttactacatgataagaatatgcagctaatagcaaagttacaaaaagaaagaaaagttacaagcttcaattttgtactacctacagtaagcagagacctgtacatcatgaattgattatatgagtgttagtactaatcaaatgacactgccaaaatgtactgacacccacagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33242 - DNA, 13865 bp, Oryza sativa
  unsure (1)..(13865): unsure at all n locations
nnnnnnnnnnnnnnnnnnnnnnnnnnnnnnnnnnnnnnnatgtgtgctttgtgtaggtttgtgatgactgaattatttttgcttgcttgtgatgtgcatgcaggatgtgcatttccaggggatggatctcaaggatacgcctgccctgctcgattatcactgatgattaattttcaaaagaagattatcactgatgaaatcttgcggcggcttgtgtcctgctcagctctgcagttgttaccaggaaacacgagttgctgttgatctgttgtatcctccctcggcctccccaccaggcggacgcgcgacgggtgcagcatctcggcgacaaggttgcgccggaggatttgccacacgggcccgcatctgcagcgcgtgatggtgtagtcgttctcgccgaggagcgagcgcgccacctccaggcggttggctagagcggcgccgcgctccacaagggtggcgtgcgcgacgcagcagtcggccatgaaagaggaggaggagggcgacgaggcgaagcggcgccacagacagccatcgccatcgccatccactgctgccgccccgcaccaccgccatcgccatcgccgccgacggcagttgctctgctgttttttttttaaagatagagggagaagagggccctgacaagctggccctacgttttttatatttttccctaatcaattgcatgtgggccttatgactgggctgacacgtcagcataatgggccaagtcagcatgccacgtcagcaaaaccgccctccaaaaccgctgagggattcaatttgtactagttttaataattgggggagtcatcctgcccggttttgtagttaaggatcacgaattagattcggtgaacaattaagaaagtcaaagtggactttttcctttccccttttgtccatgactaccacactctacacacttacagcccaactcgtatgttggaataagttcactttaagtctctgaatttgtaaccaagtctgaaagtcatccctaaccaaaataccaatacaagaagtctctcaatgtacaaaaccgcatcacctgaaatctagtagtatcatcagtattagctaacgtgacaagctgagtcagggtaggaacactggtcccatatgtcagtggctagcactatattcttcctctctcccctcctctcttcccaatcccctccaaggtgacgagtggcatgaaggacagcacgacgagctgcagccggtgggaaacgaaggcagcgcccggcggagagacgggcggcataatgaaacctgattcgcttccctccatgagtttccaacggtgggccaagccaggagccgaaatgttgattggctggctcggctgagctgtttttcccttgacatttcttgaaaaggacgtcccgaagaaattaatgtctaagagtacaataaaatcgtgaatttttcgatctagggccggccctaggcctaggcgggttgtgcgaccgcctagggcccaggccagagggggcccatcacttaccccctcccaccccatcccggccaacaggcctagccacagcccagagccccagacgcgcgcctcaggtcgccctcaactgctcagcgaatcagcgatcagccagggagcagtgcgcgtgcgcgtcgcttcgcctgccgccctgcccaccggccccacaccatgagaaccgcagcgcaggcccaggccgagccgcgtcgcttcgtcacggtctcgccgatgtcctagtccgcgagaggccgccgtgagtgccgagaccgcatcggcgccactagcctatagcgcctgatcgccgtcgcccatcggccaagccgccaaggcggtatcgctgtcgacgcttcctatcggctgcctggatggtggctggtccctgccctgcccgcgtgatctgtgattgtcatcggctcatcggccatttcccattcgcccctcttcttcaggctgaaggtaggtcacagacctagaagtcaatcgacaagctttatgcagctatgcctctatcaatttactttgcaatttcactgcttcaggtgttacaatattacctagaaacatttgtcgggtgctatacataactcataaggtcgcgaaaaagctcttttttataagggacatgggatatttgtggtctcctattaaggtgttcatactaatttgtttctatggtatttttagttgtcaattatactattgatattatttattaaagattaaattgctctatcgcaacttgcaaactgcttgatttattatttaccgtgttaaaaatgtttatttgtgtcactctatggtatatgtgctttatagagtatactgtatgtattagaagtaaaaaaaatagatataactccttaagggctaactccaaggcccatagcgtcaagtctgcctagggcctccaaaatgtcaggactggccctgattcgatcttcctatcgaacaataagaaatcgatacatcctgatactgcccctgatctaccttggagacgagaagatagaacgtgctgtgcatccggatgagatgcaatggagaggcgtcctctgcatccgcctctcgtcttcttctcggcatggctgatgctgcttgtcaatggcgtaaggtcgctgcaattcaggagggacgacttacccgatgaccgtacgccgtcttcccgtcatccgtcgccgaggaggggattgggaagagaggagaggacaggagaaagaggagaagagatgggatgagagaaaggaggaagaaaatgctagtcactaacatgtggggtttgcgtgtcccacgctgattcaacttgccacgtcaactaaaatcagacgtaatactgcctaggatctcagatggtccggttttataaattgagatacttgttatatctggtatttcggtttaaggatgaatttcagactcggtgataaattgagggacataaagtgaacttattccctatatgtttgtgcacgtacgccagggtttgtagcggattttctatgtaatgagaaaaacataaagatttgtagtaacttttagggagaaaacagctctcttactcgatgggatggtaagaagaacaatttctcaagaattgaacgaaaaggaagaggaaaagaagccagcaaagcaggctgttaccctccccacagatggaactaatgggctaggtttactctatatctctgatgcaatcctctaatctgcaggcccatgtatactacgcaggcaacccaagacgtatacaggctattgctggcaaaaggtggccgaggggatcttctgatcctctgattaaaaataattactagatcaaaagactggccaaaacatacgcacattcaccccccattaacatctccaaaaatttcggtgcgtgttgtgcgcgcacaaatgttgagggtgggttgcgtacaacatgcatgttgtccaaaattagttgctcacatcatgcgtacgatcaccccttccaaaaaaaaaaactaaaactgagctgctatattttgagattgtcgaagtcaccatgagtgtctcactagtgagggtatgtcgcatgctactaaaagaataattagctataaatgcgagcacatgtgacaaatcaaagacttcaacccgttgaatcggttctaccacaagaaatctaattagttgaactacgcccatttcgttacttaaggtatattttactgcaacataatgcgagagaatgttgatttaatcttaatatagatttaattaatcatgccatgttgcgaacttgcgatgcccacatgcatgttgagcccattataggaaggagagagcatatgcatccatcatggcctttctcttctccgccagctgcccctctcatgtaacctgcaaaatgtgtagtagtagattcaaggtaaatgtggcactaaatataacttaaatttgtggtaaatctattcgatagttttgtttaaaagaataagtcattaataaacctgtaattttacgatagtgtatatgagccgtaaacatgtaattttgtggtaattttgtcaaagcatataaattattttttgagattctactcttaaggaaaattgactagatatattatcaaagacactggatgccaaaaatgtaaagtattctaggtagggcctattcactttgctaccatttttaaccataccatttttcggtaaaattgccaaaaaaaaaatctacgtttagtttgttgccaaatttaatcaatacataaaatatcctgctaaaattttggcaatattgtcatttgccaaaattttgacatttgccaaaattttgacattactcaaacttgataaggtttattttggctacaatcggaaaagacatgtaatgttgtcagggcctcaacataatctgttgcagtattatttccacaatttaatgcagcagatattctggagctccctgcccagatccactgagggcacccacaatggttatttataggctatctacaaaagatccatgtcagcatattttcctacttgaaagatattaaatgaagagagagagcaaagctatctactaacttagagatagtctatagagaaacacgaggcaatgcatgagagagctatagatacccatgtagacatactattgaggtggtttactattaatctagtctattgctgagatgtacatgttttatagagagcaccttactttaccattgcgggtgctctaacaggctgtctctgagcttgtccaagtgtaccacatgattcagctacttgggctgcttgtacactgccctactaattaaccaagttcagatcagctgcaaattaagagctaattaatttcaccatagttttttcaacgaatggttgttgccacagctgcaaattttcatcagatagctcaatggtacgaggaacatactgtccctcttgcacacgctacatgtatccttacctttaattttgtttttgccctccagctaccatggacaaacgaaaggttccaaatggaatggcaaacacaacaacttcagtcttggtcatttttaatgataatatggttagtttgcttccctagccaacagtatatgtctttatttctgtagcttatcgtttgtttaagagctgaagattctaagaagcgcaatgagctagagtttgataattcatttcactgctatgagaaactagtttatgaaatagttcagttcgagagtttggcttgcttggctagctacatatgcttttgccttccttcaaaaaaaaatgtgttggctggtggaatctgaattaggatgactagttttgtttttcgccctccagctaccatggacaaatgaaaagttccaaatgaaaatagcaaacacggaacttaaattttggtccttcttaatgataatatagtcaaaacatgcctttatttctgtagcttatgccttatggcatgtttacgagctgaagattccttgaataaacttacatggtcatgttaaagtagttttactgcataaatacaaaacaaatgtagcattttcgcaagaataaacttgcagaagtcgacatttctctattatacataattcaacaaaaatggtattttattttaaatagtgaatacccattgtaaataccaaaaccgcaaaccatatcatcacacaaagagataaatacgagaagcaatgcgcattttaataagattcaatttcacagtgattggaaacaaaatcaataatacgagttagctaacttaacatatttcatatgttttgttgttttagtagagaagaatatccttctagaaacaaaattaattgtacactggacaagtgaaaacaactacatgtgcaccggaggtatcagatcaaatcattctagtagcagtacatttctgtgtccgtagttgattgtctccatttaccctatccattatgcccccatttcatcatctgtttctgccctttcaacacctccattactgcctttagactcgtaggaccaaccatggacatggaggtaccatgaacagcccatgcttttttctactttcaaaacctttattaaatgcctttaggaacatgaacaacccaaccccaccctaattcaacccccataaaagcacttatccaacaggatttaggcaaaaagcaacccaaaaacatgccgcaatgtttttgtactaattatctttatttttataaaagagtgtaatagtcctcttaaccccaccatgactgcttggttaccccattctaaaaggatacctccatctttaactagtaaaaggcagatgtgtgtactgttgtgcatctatctctctaaacccaaaaaaaaaaaaccattggtcttaaattaaggtgaggttgagtagtggtacaatcttaatgtaagcgagaataatgcctatgaatctcaattcccgtttgaaatgtgggaattttccagaatcctaggagaattggactatttgtcctaaaaaatgcatagaagtcctatcaaattcatggtttcaaatggacattttgaagaacttttatataagttagtacaatttatgtagagacatggaaaaaagttctgcatatttcaaatggaacccttcatttcttacttacattgcattcgagaaactcatcacctcgtcatttgcccttcagctgttaatttttgaatttaaaaacttgattttgattttttttttatcaaagtttatttttttagcattggtttttaaaatcgccaaggaaatatacatacaacatacataagtttatccacaaatcatatttttttaacaagttatatggcttataatcagcattagaccaactaataaaagctgcatgttctaataaatagaacacgcatggatgataactagagctgtcactatatgcacgatcgatcagtacataacatttcttacaaaaaataatccttattccattttcacttggagcaaaggatcgccgctcctacgaattcaattgaaatggctcaagacaatgagattttggataaaaattagtattgaggttcaacctaatagtattactccctctgttttaaatacataagtcacattaacttttttttattagtcaaactatttcaagtttgattaaatttataaaaaaatacaacaacatttctaacataaaaaacatatttgatgttatatttaatgaaactaatttgatgttgtagatgttacaattttttctataaacttagtcagacctaaaacctaaagaaatttgattagaaaaaaaaatcaaaaacaacttacaggggcagttcagattgatgtcattttaaaccatacatttttggtaaagtttccaaaatgtacatacatttaactttttgccaaactttcataaatgcgtaagaaataatgccaaaatctttttgccaaactttcataaatgtgtaagaaataatgccaaaattttggtaatattgtcaacttactaaattttttgtattgccaaaatttagtgaggtttattttgactataatctgaacaaccccataatataaaatggtgggattagaaaattccaactagtcttcttttccttcttaaactcttaagctaatgtgttttgcaacttctgttttatacttctacttagtatcaaaatcctatatatttgctacttagtatcaaaatcctatatatttgctacttagtatcaaaatcctatatatttccccccattcaatgtaggggggagggggacctcaaaatccactcactctaccctaacccttgtcaatcccataacaaaatatacacagatggggaggataataaaaagtaaaaaaaaaaaaaaagaaagcctatgccccaggaacaatcaacaaccaaggcccattcccaagctcacttttacccaggaaacatgatcatacatgcatatgtacactcctgccccaaaagcaaggtaaaaaaaaaaaaagaaagccatttgcccccactctccctgtataaccttgtacccatccccaaagattcccctctcctccatccttgtgactctctcctctccatctccaagactcccaagtgctcttgtggtggctgtcccctacctctctctctctctctgcattagtgcactgcagaagtgaagtgaagtggagtaactccactgctctgctctgtgcctgaatctctgacaactgcacgcttcttgcattgcatttgcattgcatcaagaaaatggcgatggggtggttgccgagatctgccaccgccgttcttgtgctcttcttggtcttatggagaggtaggtaaatctgtgatgtttgatcttgttcttgttgttgttgttgtggatggttggtaatggcggcatggtttgttttgtgtgtgtgtgtgtgcgcagattggggggtggaggcggcgacgttcacgttcgtcaaccggtgcacggacacggtgtggccgggcgtgctgtcgaacgccgggagcgcgcggctggccaccacggggttcgagctcccgccgggcgtggcgcgggcggtgccggcgccggcggggtggtcggggaggatgtgggcgcgcacggggtgcgccgtcgtccaggacggcggcgcgggtgggggccggatggtgtgcgccaccggcgactgcggctcgggcggcgccgagtgcaacggcgcgggcgccgcgccgcccgcgacgctggccgagttcacgctcgacggcagcggcgggctcgacttctacgacgtcagcctcgtcgacggctacaacctgccggtgctggtggagccatcgtcctccggaggaggcggtggtggcggcgggtctctgacgtcggcggcgacgtgcgcggcggcggggtgcgcggcggacctgaacgcgatgtgccccgcggagctccgggcgggcggcggcgcggcgtgccggagcgcgtgcgacgcgttcgggcggccggagttctgctgcagcggcgcgttcgcgaacccgtcgacgtgccggccgacggcgtactcgcaggtgttcaagtcggcgtgcccccgctcctacagctacgccttcgacgaccccacctccaccttcacctgctccggcggccccgactacaccctcaccttctgccccgcctcctccccaaggttcacctctctcccgccattcatctgctctttccactgctgtctgctagctactgtcactcactcactgtcactgtcagagagtgatctgagctgcaaatctggatgcttagtgagctgttcatgttgtgagctagaaatggaaagaaagtgcaaggattgtagtgtagtagtaattaggtggaggagatcttggcattatctttagttaattagttgcagatagggtgaaaagaaaagtgcaaacccgagcttttgttttgtttcgcgcgattagtttactgttgattttgcttgcagccatggatttgattccagatgcatatacacacattgctcgtgagctgaccatgtgcgcttgttctttctctttccatgtcacgtggtgcgcagcggcagccagaagtcgacgacggcgacgccgacgccggcggcgatgatgccggggacggggacgccgacgacgccaacgacggcgacggcgatgcctggggcgacgatgcccgggacggcgacggcgacgacgatgccggggacgacgttcacggacgccgtcccggacaccagcatgccgatgccgatgggcggcgacgccggcggcggcggcgaagagggcgtggtgctgagcggcagcgagacgtggatcgccaacatggccaccggcgagctgacggcggcggcgtccctgtcccggccgtcgcccgccgcggcgctggcgctgttcttggtccacgccctgcggctgctcgtgctccggtgatgcccggcggccatgtcggcgccattgtagtagtaacaaaaacattttagtcatgagacgatgtgttgactagtgtgagtgggggtatttttgatgagctttgttgttgtactgtagggggtagtggtagactgtatcggttgtacgctgtagattgttgattaattacttgattaattaggatgttagttaattgcaggttttgaggcttttcacgatgagattagggcaagtaccaagggagagactcagtaaggcctctatgttaattagaggccatcatgttacaatagttaagataatacggtatctaaccattaatataacaaaatactttcttagtagtcatctttcctttattacactcaatgcaataaaaaaatttctaataaatactaagagtcgactctgtatcgttctcatactcatacggagcaatcatcttttatacgtagcaaacatttttctcttttttttttctctctagtccacatcaaccaatatgcttgtatgataataaagagagaccgttaataaaaatcattgtacatgccattagtcgtgtggttttgtttcttgtttaagggccggcagattcgtcgctcgagggagggcgacccggcacacgggcagccgggcacggcacgcactattacattatttttatactactaatctactactactatacttaattagcactactacagcatactaattatttacttaaccaattaacagtaaaatcgtgctaatagtacgactaaatcacttagctgaagtaactaatgttgatgctaatcgtaatgctaccggagtggagtaggaatgtacagaagcgatgggggtgtcgaggagaggggggcacatgcgatgtgattgttgagggcgcggacatcgaggcgcaaatgcggtgggggcccacgacgagagaggagatggacgtgacgggtccagtccggtccgtatgggtgggatgggcctagcctcctcggtcgctctttgccatggtatactagtactactggtaattgtgtaccgtgccaccgcattctgggtggatcgtcgattcgatctcctcaactcccagtgcggttattagtgcggtaatttttttagtttttaaaatggacaatttcgttttccccccaattttatctctaatattgattttgtctctacttttagggttttcgtttttgccccaccttttttcactgaaacagatatttacctctggtttggatagaagttagtgagaccgggtttatggcagaaataaagaatttccgaattagtgatttactttttacccctacgaaatgttaaccataaagagtctttctcctctcggcgacagacctagcccgtgtccaaaaaaactggagacctagccggcggcgagcgggcggcggcggaggagagcgggcgtaggctaggcgccgctcctcccggcgtgtgcaggagagtagccggggagagggtggcggccaagcggcacgctaggtggcggcggggagaggggtaggtgtaggcgctggtgctgcccctagtggaggtggaggtggtggtgttgctagtggtggtggtggtgagagaggaaggggaggaagaggagggaggctagctcaatggtttggacctcatatgtaatagctttatgagtgcttttgtttgaatgcatgatctggacagctacttgttactatgttggctatgatttgaacctgtaatatgtgatactatgttggttatgatgtgaacttgattatgttggtgcttgctatgaactaaactttgctattttggtgttggctattatgttgtcatgctttgagatacttgtaaggtacaatatgacttcatatgattatgtaaaatgttgttgaaattttgtcaaaatgctgccgaaattttgtcaaaattccttcaaatttaaattttgtccaaattgtaatgtcaaaatctgtcatttaattttaaacatattcaaaaaataaatttccaaagccattgcataatgggggcaaaaacacaattaataaatagatttgggggagggcataaatgtcctatttaacaccattaacttttccatccaaaacatgagcaaaattatctttcggtttaaaaagtgggggcgaaaaccctaaaaagtaggggcaaaatcaatattagagatgaaactatgggcataaacgaaattgtccctttttaaaaccacaatatacctcacgataatcgtatggtttttacgataagcatgcggttaacacaggaaccactaaatcctaggatgacggtaaccctaccttaaatgatttaagtaaaccctgactccaatgcacaacaccatggggcatgcggttggtgatcatcatattgcggtatcgacgatgagctccagccgagaagcacaggtttgtgaacataactaacacggactagtactctttttttttccgaggaatagtatacacgagctccatcattttttttaccgagttacaaaatgcaaaaccaaaagactctaaatccttaagcggttttgttcccggttttatttgacgtgacaactgactcaacatgagacccacgtgaacaccgcatgttagtgactacttatccgctccacctctcttcctctctcctccactcctccccatcttcttggcgatgaccgacggagaaaaggaccggtgtagctggtgacgggcggagagaacgggaggcacgacggccctcgcaggagaagcggaggcggccgaggcgatataacttcctcatttctgtcggtcatcatggtagagagggatctagtatggggtgctgaggtagcgacgtcttggcttcacaaccaccgcccgccctgtttacctcattcgctcccatccgctcgccctcctcatcctggagttggagacgaggagttggcttttcttcctccctcgaactcctcatcggtctaggatggcatttcagcatacacgattcagttgggtgtggtgttctagcaaaatctgtttaagtgatgatattaattccagcaaatctaatcttttgtgatagtagatacgcaattttctcatgcatatataggagagaccttttgggacgggagaagcgaccgtcgaattttggtggtttctcagctggcaaaacaatgtcatggggtcgatgtaaattacaatggtccttcgtatcacggcttcacgccgtgctttttttcccaacgatcttgtagtggtggtggttaaaatacaactatcatcttttcatctaaaaaaatcatcttaattaaccttttccccttcctttttgggaaagaatctgacggtatgatgcaaacgttgtatcatatgttaattgttaacgtgaatgttaacaatttttttgacaatataacatattttaccgttttgagctatatactttgacaaatataatatatttttaagtatttataaaatttccacaaataaaataaatgcttaaaaaaataggtttgaatggtgctagggtcgattatgagaaaatggagggacaaacatttcttttaaaagcccgaacttaaaaactagagagcgttcattagttagttgaataacacacgtccttgctactgcacttatgtatatctttacttctttcgttttaaaatagttttaagatataatgatcaatacttgattatagtactatgagtttaaaaattttcagaattgtattactgattagtatctactaattgattagtgatataagtatattttaagagagaggaagtactactaagggcacccacaatggttatctataagctatctacaagagatccatgtcagcatattttcctacttggaagatattaaatgaagagagagagcaaagctatctactagattagagatagtctatagagaaaaacgaggcaatgcatgagagagctatagatacctgtgtagacatactattgaggtggtttactattaa

SEQ ID NO: 33243 - DNA, 1962 bp, Oryza sativa
gcaccctactttaccattgcgggtgctctaataaccgaaataaacgcgaaagctatagttttgacattcctaccctttgcaaaacctcatttcacgatctgacatttgccagctgggaacatgtcatattactgtagtaaggctgggttactttgatgaaaaaaaaaccttaccaaatcatagctgtcaaaattttgagaggattttttatatagttaccaaaatttgacatcaaactaaatatagttattttttttaactttatcaaaatttggtaaggttaaaaatgatatcaaagtaaatatgctctaagtttgcccagagtattacttgtaagagagtcgcaataccaaaattccaggcatgaaaaaaaaaagaaagaaaaggagaggaaaaaaaagagacgatgtcctaccgaaaatggaccgtacagtggtgagcagtagtaaaagcgaatttcacagagaatcccatgtgggccagccagtggacacctttcacgtcttttcttgctgtttactccactgaccccaccctgccgggaaggaatctcacgcgtttcacacccgcacacatcatacgacagcgtggacccacacattctggtccactgtaagtgagacaaggtgctcattttgtagtcaagtcaggttaatctttgcaccgggatgggtagaaatcacggtgcattttttttaaccttttgttttttaccttgcaattttttaacggggaggtagaagtacccgcagataggacgatgtggtcagtggtgcacggggagacgagattgaccgcattaaatgagctagcaagtgtgatgtggtactacactgtagagtagggctgctgcttccgttggatgaactgcacacaaacatgtgctttgatctgagtagactttggcttttttatccgttcttaatacttcgtcataaattatagtataatgagatatattatagtgaaatgtatcttaatatatatatatatatatatatatatatatatatatatatatatataggacactcatatggggcaccatggtttcaaatgcacaaaatcactcaaaattttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttacatatatatatatatatataatttaattttatagtattataattatgttacgatattttcagatggatggtatcagatttgttgtactaagaaatatctcattcatccaaaatctcttttattttaagacagagggagtactttactatacaatgttttaaaaggataaaactttttaaaccaaggtactctctctccgtccataaaaaaaactagaactgatatgatatattctactggacgtgacatattttaatacaacgaatctgaacagaagtagatctactccatccgtgccaaatataacaacttttagcacacataatttattctaaaatataataatttttttaccaacattctctgcccaacccattacaaccctccgtcatttatttttctcacctacctacctacttttttaataaccgtgtcaactataaaactttttatgttctgaaaaggaggtagatttatagtactagaatatatcacattcagtactagattgatttttaacgagacggatggagtagttcttccccgtacggttgctatct

SEQ ID NO: 33244 - DNA, 28842 bp, Oryza sativa
ctagagtggccatttctcgatgtgttatgctactaaaccatgcatgataatctatcactcacaattgctcaagaacttcttgttgaggtggaggagtgagagagagtagagagaaaaagttgactcttttcttagcaacaggtgtgataccaagtgcaataatagattccggaaccattccttgatgggttttaagatcgcggtgggaggtgtagaggatggtagcgtggtataggcgacgatcgttggcttccttaaccattacgaacttgtgctatgcaccatctttctcttgtacttttgtcctaaaatataaacagttttggttagataaaactattcttcctcttcccatgtgttatctcgggaacatgcatggcatcgtcttccttgtatccatatttcaatttcaactcttacacacgcctcagcacagtaaaacacatagtagtatggatcatgatcgttgtcgtccaaacctagaatcatcaccaatcacatataagtcgatcgccgtttgtttaaaaatattgttttatatgcacgaatatacatggatcgccaattatatactactatctgaagaactatcaatcaagataaatagattaggggaatatgcgtgcatgcaaaaacttctccttcctttctttctttctgtcgatctgcatcggaattgaagacgagaaaggcgatggagagcgcacttcaccaaccaagcaagcacagcaatgcacgcgtgctactccaaaaggtgagagaagctagagctactgaagatgcgatgagatcgagcaccaaatctaaaagccgggcaagcagctgctacagctttgatcggccggcctgccggagtgcagtgatggacccaagatatatacagaaaaataatcccagacgaccgaaggatccaacgaagttgcataccaagtttctcgaccaattttttgtaccctgtacgtgtagctactgggcctatacgtatggccaacttttgccttgtagttgatatggagtagtagtatgtgttaagctcttttctccctgggtttgagcttttggttgaactaattggtgcatataatccaacactatctccattctcaaaagaacgttgtatgtacttaaatatcgattattaggctaagaaactttagattcgtcatgaagaacaatggttatgtttttaacaattttataagtttttttataagtatattcaattagaaaaaagtggtgatttacatgtacgtatgggagacttcgtcgatgtcagtaaaagaatcgttggtactagcatttgtttctcatgtcacacccacatatttaattcacacgcgatttcttaccacaaaagctaatggcagtcggctgagtttaatttagcaacttggctgagcaacttcaacatattttgtgagtacacgcttttcaaactactaaacactagaaatactttataataccatatagacgtttctttaaaagaatcaaatgtatctattttctaagtgtaaaattattaagaattaattaattatttattaatgatctatctcgttttatgtgcaaccaagttaattggccgagctaaatgggcagttcaaacgcacgatagagacagacaaaatgctggaaagtttacataagtccatgggaattgtaaaatgcgtacgcgaatgtttatatcgaaagcccactgctttgaaattttcgtaactcggcctccagggaaagcccagtgtgatggatgggccgagaaatttaagcctgtcaatgaggccttaaagtggggtggtacgcatctttggtgatatttggtccatattagctgcagtacaaacaaattaatctagtttgtatagattgatatcattttaaaccatattattttttggtaaaataatccatttagtttttattaaactttgataaatacataaaaaattatgctaaaaattgacaatattgctaaaatctttaaaatttgataaatgtttatttttgctacaatctaaacaacccctaagactcagcgaatttatactccagagcaagatagccaacaagaacattaacaagtgcaaccaccaacatgtccatttaatactgttttgaattggggagactgaaggagagggagatgattgtccttttacaaatgattacataaatccatgattttttatgagtaaaatagattgcttgcccttaattaaacttatcctaagatgtcatctagtttcataaacttagataacatacatcttagatacataatctttgtttaatataccacgtcaagtccaaagtgctgcttgcgggactagagtactgaccagggttccccttattctttttgcgcggttaccgcacccccacgataaggtgattactacggtaaccgcgcgattaccgagaaaccacgagacgtaccgtggtttaaaaactgaaaaagttaccgtgcatggtaaccgctataactgcatagtaaccgcatggttttgtaaactatgtactgacgtggccatctaccgtgggtgaagtttcttatgcagcccctttcgttacaataatatcaaaatcggctctcataattcagcatgccaccacttgaataggagagcaggcgaagaagtagctatatattagggcgacattgatcatccacaatcaaattaaaggtccccatagcgagatatatgacgcgatagggagacgttaagtttgtgcacatacgaatgacccggcctatactcttccttcccttttgagccgagcaattaatttagaggttactgtagtggaaattaaggggttaaatgaaaaggtcccatcattatggatggtcatgttagctctatggcccatctaattaaccgatctcacgtggtacattaagccaaaattataggctctaaatgagcattttgttaagttatgggtctagatgacattctatgataagtttaaggattggcattgtattttgcctttctttaattaatgtagtataaaagaaattttgcacaccaatattgatttgacatttttgctttatgatcgatcgatcgatctatctatctatctactagcatcattattattatcaattattattatagctacacataatatgggcatcccattcttttacacgacaagaaataacagtgaatccccagtatttaagtggtaagagcataaacaatagtgagctaatagcgagaaaacggacaatatgccactgtacaggttgggctgggataaaataccactcaatacaatgcaccggatacaatacattgtctataggatgaaatgctactttgaagatttttgtgcccaaaatatccttggagagagagaggagatcaggggagcgccgtggagggctgcccgggtggcgccagaggcctcgccgggcggaggcggctggcgaggatgacggggggaggaggatagggcagcgggccagcggaggaagaggcgacatcgcctggcgaggccttcggcgccgcccgggaggccttccctggcgctcccctctcctctctctctctctctcgggacattttggacataaaaatctccaaagtagcatttcattcagtaggcaatgtattgagtggcattttatccgatgcattgtattgagcggtattttatcccaacccaacctatagagtggcatatcgtccgttttctcgcaaatagcctgcttacttaggattttaacacatgtgatagataaaagaaatagtagagagaaaaatcgggtactaattagttagcggccaagtgttgcacgtctattttacaactgatagcttcgttatgagccctcttcatgccacaccaacgaataggatgacaacgtgtgatcacacggtgtacaattcgttggatcaagatataccagtactatttagaaacttataccttaaattggtgaaagcaagcaaatagcctattctaaacaacaaaagagaggaaaaaaaaagagttttagcaagttttagagcttgcagctagcccttttgaactggctcaaacaacaaaacaaaaagggacaagagaagagatggcccactaatcagtgaccatagagtccgtagtatagagccagtgagtgacaagtgtcgcacagcctcgaacgcgcaacccccccccccccccccgccaaaactgtccgtacgatggggtgcatgctcccctcgccgcagcgcgcgtgcccgggcgccccgccgccgtcgctgccgccggcggaggacctcctcttcgagatcctcctccgcctcccgcccgaccccgactgcctccaccgcgccgcgctcgtctgcaggcgctggggccgcctcatccacggcccggccttcctcccccgcttacgcgcattccaccgaacacctcccgtgctcggcttctaccacaactcccgctccctcggcccctccttcgtcgccctcgccgcgcccgcggggccctcgctcgtgttcggcgacggcgactggagcctcctgggatgccgccacggccgcgtgctcctccgcagcgggcccggctggctccagctcctcgtctgggaccccgtcactggccaccgcagctccgtccgcctcggccgcctcgcgggccacgtccgggcctgcaacgccgcggttcttggcgaccaggacacccgccgacacggctccttccgcgtcgccttcgtgttcaccggcgagggccgcgcgtccgcctgcctctattcgtcggagaccgccgcgtggggcaggctgatcaccgcggggacagcgcgctgcggcgacgtgggcaagaagcccagcgcgctcgccggggacgcgctctactgggcgctcgacgacggccgacggcgacatcctcgagctcgacatgggcaaggagaccctcgccgtggtcgagccgccgccgcccgacgctctggctctgtacgggaggagcagcatccagctgatggcctcgccggacggcgcactcggcctcgccgtgatggacgtgttcagcctgcagctgtgggcgcgggaggctggcggcgccgatggcgtcgcaagcaccagcagctgggtgcttctcaagagcattgacctcgacgtgttcgctccaatgccattgccatgcgcaggtgggcgggtgattctggtgccgcctgtccggctgctcggggttgacgaaggtggcatctctgcgttcatatggacaattgaggggatcttcatgctccatcttgaagatgagatgctgatgaagaaggtggctgcttccagagtggtggactttgtttatccctattcaagcgtctatgttgcaggtataacatgcaatgtttttttttatgtgtttacttgctctcattttgaatttgatttgcctctaaatgtgtaattttcgtagtatctgaagatgaattgcacaaatgacttcaaatccctgtctgttctggttgagtttagttgcagttatagattgcctttctagtttgtgctttgtggataggaatgcagacatgcacatatgaaatggatgttagcagtatcaagttgatagtttactttgttgaagtgacttatcatatttcttgcaattcatggattcaagaggatgtaaaatgggtagtacgcagaaattggcttatcagaggtgcacctcaactagcatattgttaaaatgttactgtgaatatccaattcccgtatggtttgagttagtaagaacatagggcttgcattggtatccattttctaccataattgaatatatgtgccttttatgggtaagaatatagcttctgatttctcttgaatatatcattgaaatctggtaatcagctatcaggggatgagctaaagattgtactggtggatgtgaatggtgatcacatatttttggagtcatccgtatgtaactacagtgttgcatattgtagaaggagctatgctttaccttccatttaaaaaggaaaattctggggtcaccctcacccatatagaactatagcatgtttactctataatactgatacaacaacatctactatataaagtttgaaagtttttaaagtataacaaatgattcgcttagctattttaagctccgaagttactcatttctgtaagaaagctgacgaatttatgacatcataaattggccaaactagttcatgctcttgtcttttcagaattaactagctttcttcacgtcgtacatgcctgcaaaaatagaggctgtgatgtgggggtagcattgtagcaaccatgcacgacaatctcatatttcttttatttttcctgtgactgttcttgtgcatctgcaattcacaccatgagctttgttggtaaagattacatgaataatactccctctgtttctttttatataatgttggttagttcaatcatatattttgggatggaggggggtattcatttggattatattgtatccagtaacctttcatgtgtagtcttttctgattgcttttatttgtgggttacgttaaaggatggacacgaatattcgtttcatcatgcactacactgaactaattacagagagctttaacatgcattcttgattctagtgaccttcagaaagatggattctagtgaaagaacctttctttcctttggggttacccacaagtagttgtcaaattgctagaatttcgaattgccatatatgtgttgtgcgttaatgttgttacatatcccagttttgctggtttctgtgatggactgatggtcttccataatttggcctaactctccagtaatggcaggtggaggtggtgaaggtgaagatgctggtgcagttcatggaagtggacggctgtaggatctttggtttgcagaggtgttcaaggatcagctatgcatctgcactgctttcaccaatgtctaacgtattaagcacatactaccatataagtattattagctattctaacttatgttagatcacgcatgtttcagtcgtaaaaggccaatgtgtcagttgctctatgtttgagattacagctaatactccattgagcatatatttgctttatgcgaagatattatcagattatctttatgctccgtagttcttctgtaaacagaagatgatcttattctgtttgttctgtgataatccagcagctgctctagcctgtaggctcttctcagaagtagcagttaatatcttaaatggaaaattgatgattttctccatagttgcatgtgcttctacattttgtccaaagatattttttcttgatcttctgtaaacagatttgggacaaaaaacatgaagtacagtctgtacagacaacttcgtggcatatttgtcgaagcgcgtgcaactgtagagcgaacaataaaatttcccatttagaagtattctttgttgaaaagaattttaaaatcgtgaacacacggaattttgaatttcaatatttgaagcaaaacgtcagactttggctgccaaaattggggattgttgcatcaaaacctgaagaatttgcactgtgtatttgttctctggaacagctttggtaatttaaaaccataagaacatacttccttcattattttaactttgagttgttaagctttgaaccgacaacattttttttttcaaataatttagttatttgacattaaattcataccaatagactactagtcgatagtactttactaggatttcacattttaattttttttgaccaactcgatctgacttagcataaatcttaattggtcaaaattcatgtgctctcagtcaaaaattcaaaatggatataggaagcattagtgatatagaggttgatttgtggatgcatgactccagccaccaagtaccaaattttaatacccacgaatattacacatgtgtagctttcaatatgattttagtaagaccagaatgtgtcgttggtttccgtctcttaaaaagtgtgttaggaggggcacatatgtagcgacccacgtatttcacttccgaggtagaatatcagtctacggctcattcctcagcaagaatcaacttaccgagaaataggcacactagagtagcatagcagaaacagttatagcgaaacccattaaataaaaaccgtaaaaaaataacttttgccaaaataagcactaatagtaccttgctactatagaccttcatcaccttcaactctcagttgatgtagagatatggaacgattatttgctttgatcttgatcaatcatgtagaatatttcttcacctaattgttagctcaacactataaggaataatatatatatatatatatatatatatgggatgagtatgaatggtactcaacaagtccaactatagcaacccaacaattatatgctcataatccacctgcataatacatatatgtccaaagtcccataatccaacaaggaaattcatacatgttcataaaaacagtgttgtaaaagctcatattaagtaattatgaaatctactgcatataaggcaccacaggtattagaacctccgataggttcctttcctgccacgttcatagtttctacctgaaacaggaagtgacatatcacaattcatacactctccagaggtgtgtcgctctgtacccacagacgccttaaacattttaatactcacgcccgttagcgcttgaagcatacttcatggtgtatgccagcaaggctaaggtcataagcttttcatcaatcccatctatcaattatctctacgggtgattccctcaacaacggcgatccacatcatctaatcggatcccgcaacaacggcaatcctcatcgctagcctacgctcacggggttcacggaagtccttaagcccgcaggataaagccattaagaaagatctactacgctagcctgtcccattccaggtcatgtggtctataatacaccgagtttcaaattagtatatttcagaaaatattagaacagatgcgcaaaagtgcaatttttaaattgttgttcgaatagacgaccaggaaccatggatgcgtagggcttgccgactaatgcaaaatagactataagttagtttatagtaatcggagtccaaacgaagtctcggggattgaatcgatttggaccgttgttctcctttctagactatatataaccaacagtaaaaaaaaagggggcaaagagagggatcgatcccagccctagccgtctttatctgttttgggcaccgccatcgccggacgtcgccgctgtcgccgatcgtcgccggtcgtcgccacagccgtcgtcctccacagccggtcgctggtgagctgctgctccttctgttaatttccctgctgctgccgatctgatctcttccttgctgctgatgcatggcttgttgttgctgccgatcctcgttgctgcttctgctgttgttgatgatctgcaacgaatgctgctgctcctgttgatggtctgcaacgaacagagaggaggagggttagaaggcagagaagaacatgaaggagggagagggggaaattagatagaagaaaggaaatttggggaatttggtggatatttcaaaattcattgttttttttacaaattagtactgctaggtaattcgttttagtctctatttgtttctaatttatacataagacgatctgtttccgatagctcaaatttattttattggctgctgggctgaaaacgtatttttaaatctggtattaaaccatcgggattcagattagttgttctaaataaagtttgtagtcatcgccgatatctttctaacggcgctggtttcactcgattctgataaacggtttgagacaaacatcagaaacaacagtgctgacctggtccggaaatcaagatagcaattcgttttgtttaatctgagaccaataaagacttaatctgattttgtgcccaacatgaaagatgtagacaattttatctagatgtccgaagtagtattatttgctagatttcgtaaacggtttgcgagttacgcataaaacagtaatgaagctgctatatgttgtttaatataaatcggttaaagtttatatgttctaggtttcgattttagtgtaactattattagttgaacatagtggtttattcgtagttttgctgcataggtgtggggagatctggtgtggagggtggttcgtcgggttaccgtcaaggttaaaggcaaatgcatgatgaactaattgtgtgattcttggatcgtttactctatctatttatttctgacatatttttatgtgataagtgactgtttatgttcagactgttgtttacgccatttagatttcaagtttatcttatgtctatgacgttattcttgtttcgatattccggattctggttctggttaaataattcaagttccatgcttgccatggatgtgcaatatggtttcaatttggttctttgtttctggtttcagttattcatgttccatgtgagtcatggatgtgctacttggttttctatttatattcctgtgggtaagtgctgatcacgcttactcagctttgccggcaaatgctaggatgtattcacaattgtccgggatggaaactactatttcaattcatatttgtctgggatgggactactattgtctttaacttggtgtttgaaatatgattcttttcaaagaaagaaagttttctgttcaggctttattgcgcatgatgtgtatacgtgttttctagttccatattatacttgctgagtatttctgtactactataaaaaaagtatttctgtactcactcttctgtttatttgattttagatacacattgagatcgacatgcatgggcgggaagtagcacccttggattacacatttatagcactaaaaaaatttggttttagattatgatcctgcttagcataagttttgcgtagaatttgtaaatgtcaattaaagttatggttcgtattcttatgtgggatttatggaactaggatggtttggattgtgcgaattatttcattattgatttatcttataactgcctgtcgtggatgttcgtatttataggggagactgtcgaaatttctaataattttgggagttagtggttttgagtgtttttggtgtggcactctaggtacgtggttacctgggctgttacatagtcgacacgatcgctacgacacttgcatgccatataccagttgtttttttaaccttatgatgataaatatatgcaactgagcccccaccacaatgacaagtttagaatacatccataatatgaccaactgctccaacaaccaatcgaatccttcaacatatttattttaattgcagaaaatataattaatgcaaggtgatacatatagattgcaaatacgaaaatataacaagagttggtcaaaggtgttggacttgcttgagatacccgaaatcgaagaatgaataaatcaataaagaattctagaaatccaagataaacacccaactaaaagaaacaataaaacacaactaaatatgataatgtttatatgaatgcaatgggatgttctactcgaactcacatactggatctatataggttatgggtttgcttttattaaacttattttaagaaagagtagttattttgtttagaagaaatttgattcactatagagattttattccataatctctagatatatttctttaattagaacatatattttggtttgcttgacaagataatttataaggtatattttgaaggaatacttttatttagattatagtatgaaagattaagttatatatatatttacttaaaaaacaatttaatttaatttagaaatatgctgaagggaattaaaataatacatcagcatttgcaagaattaactttgaatagtttaaaggatttaaatgtcatatactattttttctttattttttaactctacctctaaattctattagcccatctacgaaagcccacaacaacacgatctacctagcccaccttttttctctcctctctttttctcattctctttctttttctctcgctctcccttgcgccgccgcatcctcaggtctcaccgtcaacgccgccgttccaccccactccggccgctgctccctgctccggcagccgctgccagcctgaatatgttctgtggctcctcatgagtctgcccccaagctaaccctagccatcaacccctctccaatcgatgctgctgctggctactgctctcaacgactgagattggaatttcccagccccatcgcccctgattcaagcatggctcagaccagccgtgtctccccgagctcccctctgatcccttctttccctacttctgtggtgtgatctaattggtgttctcttgtgtggtaacctattgtgaatttcgatgcttgtgaacacgtcctaatgacgaacttgatggtgctatactaaggattatcctgctgtctgtagggatgaatgaatgaaggcaaaaaattgcttaagggcatccaaaaaagtgtaataaaaaaagtgtaattagttggtggacaccgaaataacgtgagtttgttgttgggcaccacgaaaaactggtaattagctgatggacacttgcaaccttattttatgattctgcccttgcgtggctccaacacaatattctctcaagtcctcatccctatttacccaagatatttttgatgttcttgttagcaatagctaatcgctttttgggaattgaatttaaatttttctggatcacaccgtcagtccaaaagctagggaaagcaaggaagcagcggactcaccaatgcacttgccggagctctccttgggaggcggccgttgcggttcatctcgtccaagaagcgatcgacatacttcgatccctccttcctgccggccggacgtcttgtcgaggaagtggaggtcgcggagccccacctgcgcgttggactgcatccacgtcatccttccccccggtcgcatgcccatcccggccaccctttccggcactagaacgacgacgtcgacagcaactgctccaccccattcgccaacgccatggacgacagcatcgacagcaactacggagctcgagttcggcgagctctaccacaacggccagatccagccgcgaaccttgtccccgcccccgaatctcgaccctgacagcgatgacgatgacgactgctgccctgtgccagtacgaggctgtgagccatcgtcgcggagcggatccgcgcaccacacgcacaaggtccatgtcgtcgctctggatcttggctgggctctcttgcactcggctgggtcggaggagctagccgcgaaggcgtcgcatgaggatccttgatgccgcccaggtccctcgagctccgccgccgccacccaactgctggtcgctgtcgtcctactgccagcctcgtcgaactagaggaagatccagcgaagaagacaagtcttacaggtaggccccacagaagaagtttgacaagggtaaatttgtctttaatgagtgtttctctctccaatttctccataaatagtaaaataatcttaggagtgttcatcagctaattatcagttttttgtgatgtccaacagcaaattcgtattgttacggtgtccaccagctaattacatattttttgaatgccctgtagcaaattttgccatgaatgaatacttacataatatatcctagagtaaatgcagtactgaaattaaaagcacactaacatgattttgtccttataaatatgcttgcatgtagaataaccgaatttctgaaattagtggcacattagcaggattaaatccctgaattaggtttattgagcaatttacatgttctacaatttgataattatggcaagatctgtactttatatagttgaattataacctatgaaatctgacattgaatataaagagatggtgactgatttctttcgatgatttactactactatctatatgtcctgacatcaatgtatgctttacagaacaaataacacaatttatgtcatacttgattagaatggttgacgaggccaataattgaactattgatcaactaattatatataagaaacttatccagatgctatgctctaaatctaaacagtttctatagactatctactataaacgtctatggttttctactcattaatcttatcaccccaatttaattctttttactggaacacactactcatcttctatacctgtatatgcacattaatctgaactactggtgccatctggacttttactaaattctggaggttaaatccagtaagttattactatctctaattaactatttataaaatcaagattcatcttacagggtcttttggtctttactgaaccttatcccacataactagttatatatctagtttttaagcccaacagcacaattaccatacttctaagcaatataaaatatttcttgctgctagctacatgatgatgcatataattttgaactataactaatctttctacttgtcagctaaatcaaaatatttataccctattggttacacatgttctacaactgaaattattatatgttccttttactgattcagagatgctcttgttcatattctttttttttaataatggaaatgggctacatctccggcctctgcccgtaggcacacagccaaaaaattcagacgtgaacagaaaagttaaaaaaaggcgagatgggacaaacccccaacttctgccgatgatatgatctactaaaataatattttttttcaaaatcacgtgaatactatcacgaaattctgtaggtactacgccatccaaactggaataaaagttccttggctactaattctaagcgtgtagcaccattgcgcatagtatcctgttgttcctgtgaaagcatcatacaccaagagtggagccaattggaacacatgaagataacctgcatgatgttagacatttttttatggttaaaaactatatcattacggcaacgccaaattgaccaacataaagctccaaacaaaatcattttttttgtgggtctaggtactccccttagccagtcaccaaaaatatcttttgcattgtggggagagggatgttgaaggcaaagaagacacatcaccaagcaaaacgtgcaatatgacagtcaaagaaaagatgttggatggtctcttgtgtattacaaaaacaacattgcttgtttccccttcaatttctctttatgagattatctttcgtcaagattacttttttttgtgaagaaaccacataaatactttgatttttagtggtacctttacctcccataagatcctcttgtggattcttacattggaattgatgatcgcattatacatggatttgaccgaaaaatggccatttttatgtagcgaccaaataaagcaatcattttcatttgacagggttatgttagctagtcgagagatcaaattattccactcaactaactttggtcctacaattgatcgtcggaatgaaacattcaacggtgttgtgctcataacctctgccaaagtagaatgtcttttttggaccacattgtacagagaaggatattgatatttgagaggttgcaagcccaaccatgtgtcttcccaaaatcttatttccatcccattaccaggtttaaaagatccatactgaaaaaattgatcttttactttcattaggcaagcccaaccatgtgtcttcccaaaatcttatttccatcctattaacaggtttaaaagatccatactgaaaaaattgatcttttactttcattaggccagcccaaaattgggatgttcctggtttgtgtgacatgtgggagaggggtttaccctttaagtacttgttgcgcaaaaggttttgccataggccatcaccattaagaagcttgaatagccatttgcttaacaaacatctattcatgatatcaagatttaggacacccagtccaccttgatcttttggccggcatatataatcctattttgttaaccgatatttctttttctagctatcactgctctagaaaaagctcgatcggtagtaatccaatctttgaagtacacctcgaggtatttcaaaaaaggataacatgaacatgggaagactcgaaagaaccgagttaagaagaaccaatctcccaccataggagctgtttttgcccttccatgtgctaagttttctttgaaacctatcctccacaaatttccaatcagaatttttgagttttcgatcgtatatggggattcctaagtatttgaatggaaaggaaccagaattacaaccaaacagttgtctatattggtcctccatttccttagctcccccaaagcagaaaatttcacttttatgaaagtttattttcagccccgagagatgttcaaacacacaaagaatggccttcatgttttttgcttgttcaaaatcatgttcaagaaatattattgtatcatcggcatatgggagaatggacaaaccatcatccactaagtgtggaattacccctctaatttggccatcggctttggctctttcaataagaatggctaacatgtcagccactatgttaaaaagaattgaggacattggatccccttgtcttaagcctttgcatgtccggaaattttttcctacattatcatcttgttcatattctaatggatgagaatgcaacacacaactcctacacagctctgattgtccatcctgtggagaatcatgccatcctcaatccgcaatccgcaatccacaatattcaaagcatacatactaatgtgaattgtctggatcttacaatctggatcggaggttctcacaatgcaaaagcatcagtggtccaggttccaactaaaggcattgcctcgttggtatgcatctcttgtttttaatctgtctgttgcaaggttattaaggcggtatggcgagctaaggcgctgcatacccgcctcaacgctattgcgatatggcggtaaggcgtggcgatgccctaagaaggtaccctgctagcgattagaggggaaataaggaataatttggtatggaaaaattaaaaaatgacaaaacagaacatcaaaccaaccctcccagtaacctattggtcaaacattctggcctaaaagcatcgcgcattagatgtccacagccgccgccacatgagaaaaccaagcgaagaagagaggaagaaaaccaagcgaagaaaagaggaaggaaacaggagcccagccgagtagaggagggaagcagtggatgtagcagcgaggatgccagcggggacgtgagggagacaatctaccgtagccagagctgatggtgatgggaatcgtggattctgagtcatcgccgccgctgctagggttccagatgagatggaatcctctctctctctatatctcgcggtgatgttttagggtcaccataatccgaaattgctaattagcgcccagttgcgctcccccctccccgcgcgcgactgggcacgtggcgcgatgggggagggggagggctgagcgacgcgatgggggaggggtcacgtggcgctggttggttttttttcggttttttccgtttggtttttttccggttttggttttttttcttttccttttttgcggttttcctttcaggttttttctttccgatttttttatatatacgtatataaactttttatatgtacatatacaaagtttgtatacatgtatacaaactttgtatatacacatacaaactttgtatatgcatgtatataaagtttatatacaaacttttgtatacgtacatatacaatgtttgtatatgtgatgtttttttttgttttttcaattttttaatacgtacatatacaaagtatacaaagtttgtacacatcgtatataaagtttgtacatgtatatatttcttttgatacattagaaatatatattttttatagtagtagtactaatagttatagtagtagtgtagtactagtagtgtactgtagtagtactagtactactagggggcaccgcacggcaggctgggcgtgcgtccagtcgcttgtggcatcatcaatgtttactacctactttatgaataagggtgggccctgcatcagtgggtattagttgttgttgtagccacaatggtgaaagaacaaaagtgggtagtaagctggaccccacaatcactagccatgagagaaagatgagagaaatcatttgtttattccttatgactaggtagtaagtatatgacctggtattagttacttactactcccacaatgtatacaacctggtagtagtagtattttattctttattatccactttagatgtacattgtagatgctctgagtggatgtaaaatccggctcctctaactgctagtaaagagtatacaaaacagagttaaactaggaccactaggagggatatttcttgcaattgtctgtagcaggttcagctcacgttggcgacaaaaaaactaaaaaagtcacaaaagaataaaagcaaaacaagtaattcctccgttttacgatgtaagtcattttaacattttccacatttatattgatgttaatgaatctagacatatatatctatatagatttattaacattaatatgaatgtgaaaaatggtagaacgatttatattgtgaaacggaggggtagatatttagatgtgaagcatttacacatcatccatattttgctcctcaattttgtactacttatcgtacttccttgtacgtgcgattccattcattacttcttgtttgggtaaagactatcttatcagcttaagtgattgcgatgtgttacccaaaccatttaactcgaatggataaaagtcatgtgacaccaacatcattaaatcttaactaattaaaagattcatatttttccgttcgtcacatgattttcgtccgtatgcacgatttttcacccgtccgtgcgatccgtccctcccagagtccgagtctgtattaaaaaaaaatccccgagctagatccccaaatcaatcaatcaaccagacaaccaaaaacaacacgaaaataccaaatttaaccttaacctcatgaatttgatcaccacaagaaacctaatacccatgtatttcctccctcccaatccgatccgatccggcaatacagaaagtcaaacaaaggcaatcatgtatgaatttgctggcaaacaagaggcagcaggaggcacgtcgggttgcaggcgacgtgcggcggcggaagtgtttggcgcggtcgttgggcttgttgtaggatcgagatgtcgactagaggggggtgaataggcgatttaaaattaaatgacacctaatcaaaactaacctaagttactaggctcggtgagggacaagactaactaagcaactaagttatgttttgcaatcctggggtgaaagtggctcaagtatatcactaggaaagtaaatcacacttcctaagtctagtttagcaatcctagggtgaaatgatctctagtatgtctctagaaatataaattgcacaaatgtaaatgcaacaagtaaatgagacaaggagacgagatttttgaccgaggttcggaaactcgccggtttcctactccccattgaggcgatctcaactccaccgctcaaccacgaagccaccgtacgcccccttcgtcaaggggtgggcaaggcgggagccggcccacggagaggactacccaagcctcgatcactagggtagttcttccttcactccgaaggtggtgaacttcaaaccactcacaaaccggcaccgggcctcctccacaattttctcggagaggtcaccgggaaactcctccacaagccgtctaggaggcggcaacctccaagagtaacaagcaatgacccggcgtggagataatcaatcaagtgccacactagctctacaatggaagcaaatgcacttgactcttggctagaacaacctcaaccactacaatggatgaacactaagctcaaaggtgtgtgagagaggtgcaaggggtgtatgcaattgaattgggtgccaagagaatccccttgttgctggagggggagtatttatactcccaccaaccaaaactagccgttgggggcgaaatcccccaactcagtgctctgccggtctgaccggaggtatgtggccggtcagaccatactactctacaacagctagttttctagccgttgcagggctgtcattgggccccactgcctaggccggtcagaccgacttggggtggccggccaaacgggcctcggctcggttagaccgccatcagctcggtctgaccgaatacggctccggcggctcgggatcgacacaccgagacggcaccatccgggccatatggccagccggtcagaccggcccgcacacaccagtcagaccggcgttgatacggcggtcagaccggccctgacatggcggtcagaccggcgacgccggccggtcagaccggcactcggccagcggtcagaccggccttggcaaggccacacaatgagcgcacaacttaaaatgtggggagagtctaaaagcgagcacaagtctaaatgcataatgacctaatgtggcaatttaaaatcatctctttgctaggtcattacccctcttaatagtacagcaaagctataaataaactagcacaattttgatcgcctaacgccatgatcaaattaaaatgaaaacactagtttaccgtcttctcttcctttagctttgtgccgtcaattttaattgcgcacacataatgtgaacctaacttaaagatatagctcaaaagaatggttagtccacaattagcgcttgtcattaattaccaaaattaacaccgggggcctagatgcttcacttgtggacaagctcgacgcgggccggcggcagggatagcatcaaggcgaccggcgcatttggtggcggcgtggctccgaagcccttcctcctgctagatctggcggagggagggcgcctctgggcggccgccgctcctcccgccgcacaccgctgccgtggaggggagggcgcgaccatcactaccgatgccgcctcccgccgctgggccgcaccgtctccacctgccgccgccacctgtcgtccgccgcctcccctcttgcgccgcggcctgccgcctcggctctgagagagaggagagcaaaacgagagagaagaccgacagagaggagaggaaaacgagagagccttatttcctcggtgggccccgccgaggggagggcgccgtcagccgggcggagggcgccgtgcgagggggacgggaagcggcgcactggtgaggggagaggggagggcgtcgctggctgcgacggcagtgggggagagaacaccaagaaagaggaaaaagaatggaggagagagggaggataagggaagtcgggggaaaacgagaagatgaggagacaggaaggatcgagaggcgccgctcgctccgcttgctctctcggtgataagtatcagatctgacgggcctttctttttaaaaaaaagagcactctgtattttaaaaaaacaacacaagtataccatataatcggcacatatagggatttataggggttggtttttaatttttttcggtttaaagtctaatgggtctttcttttacaacttttttatttctataaggaatatttttttaagggctcatatcataaaaactaaatcctaatcatctactatttttatatttgttataattttagtttacccgtagcaacgcacgggtatctatttattaaaattgtttaaataataaaaaaattcttggcctgtccgtctgctctctttttcctatgtccttgtccttttattttgtcccctcattgtctaatcttctttcattttttatgtcaacttattaatatttgacctcaaatacaatttgtaaataaaaaaacaatactcactctcacaaaattaataagatttatttttaagatttgttaaactccacacatttttattaggtaacaatacacaggtacattcgcacaaatgtaaagtgagtatagtttaacttgataggtttcttgtggtggaaccagtcaacctgcattcaaatatttgatttgacacgggtgctcgaggcgttcgtggtaacttcgtcaatctaaatactcgtgttgtgagtgcgtttgcactatgtgtttctaaaaatatatatattctcgcaattcaaagtacattgagtacaaaaattccactcgtgttctacataaaaaaaaatatttccgttcatgatacaaattttcatccgtcgccttttgggcaaagacagtcgcattattcgtccatccattttctctcatgctacaaatcatccaaactaaacatcatttctacaaatatagagcagattatttatctaaaagcaaacaatttttttagcagattagttgactaaaccaaacaacaccttttgtcactgtacacattccgtaatcacccggtgcaacgcacgggcacttttgctagttaaatggataaaatttagaaatttattcgtgtcgttttccgaacgcaaattgcagattgttgactccatctggtcttctcccccaatttcttgctcagttttttctacacccagttgtacgcaggttacttattggatcgatcatgcatatcaatgtgttgaccagttcttgatgcatatacaattgtgtgtcatctcctaccttacaataacaactaatctggcctgttgcattgcaatcagagcttccgaccttgcaaagaatgagctgctaaaagcatttcagtgacagctcgagagtgtgtccaaacatgggggtttctccatggattatcatcttcttgttgagtgttattgtgctggtttttgtcgcttcggccgacacgaacgcaagacagtaagtatagttcagttcctcttcagtatttgttgctgcagtgctaattttgatgttcttcttgtctatctctgcagctgctggcctcaatgggattgcaggtagctgggacacggacaccaaaccatcgaactgggggaatggcaacgatccatgtggagacaaatggatcgggataatttgcaccgggaaccgggtcacgtccatgttagtatatcagcatcagagatttgtatatgtccatggagtgatttttttttcttgcaattatgcagtaatatgagtaacaaagatcactcatgttgtcttcttgtttcatggtgtttttacagaagactgtcaagttttggattgtccgggacgctttccggggacattcagtccttatcagaattgcagtacctgtatgtattctcttctctctgtagtttgagcactttggattgcgaattaggcgtaaacatgtgcatagttggaaatttggaaatttatgcaaacttctgaaacgcttctgtttttgttgcagggacttatcctacaacaagaacttgcgtggaccccttccttcaaccattggaaccttgagcaagctccaaaacttgtgagtagtttaactttggagaagttcagttagtctgctaacttgagatttttcagtcagttcatggattcttgtttgacttgtcccctctcatttctctgcagaattcttgttggctgcagctttactggtgaaataccaaaagagataggccagctctcaaacctgatatttctgtagggaacttagacctgattcttgattatgtctaaaatcttaggcctgcggtcgcattccctgaacttctctagatcatatctaatctgaaaatagaatacatctaatagatttatagtctggttgaaaaatgttttaatataaactccatcatttgaaaaataaacaatttcgaactttattggttggacttttacctcagaatttaaagttcacctagtgatgtagattgacatgatggtaacattgtatattttaatcctaattttaaaatatggcaggtaagattatttcacttattagccaaccatgcttatacagagtatccattatctaaaaaaatgcttgtacagagtaaacagcaagtaaaaaaattaattaatttcctcctgtgagagtattacctccattgggataataggaataacaaccaaatggatggcctaaaaagcttaactacaaaaaaaatcctataagcttgtaacaagttaagaacttgatctggacatttagaaagataagtgtgatgcagttaaaccttttcccttttgggataatcaagtaccttaggtatggaggaggtggttatctggttttattagttggtaatattgaattctcaggcctggtgttcatctattatattattaaaacaacctttaaagaagtcaccatattcaccgtgaaagctagaaattctacattaatcgaagaaaatatgaattatttacaccgttagattgttatgtctatattttaacgtctgagaaaagccttaatgacattgccaccatatattttacttagcaacctaactagtagcaaacacgaagctttcttctatgttcctgtatcagcctttcacgcagtaatcgctcgtcgtaatattctgcacatatagtatcagtataatattgtacatttcctaaataaaaaagtattgttcattgtactctattcctacagatctttgaattccaacaagttcaatggtagcataccgccatcgctttgctgcctctcgaagctatactggttcgatctgtctgacaatcagctcactggaggacttcccatatccaactggacaagtcttgggttggacaatctaacaaacactaagcacttgtaagtaaattacaatattcttgatttcataagattttttttcattttctttgctgttgtctaatgaatatgtacacacgtttcgtcacagccatttcgggacgaatcagctctctggaaccatacctagccagattgtcaactcaaatatgaagctgatacatctgtatgactaaccaaattcttcatcctcctaaggaataagtccactttgactttcttaaaagtgacccaaatctaatccatgaccctgaaccacaaaaccagatatgttgacccctaaactgttaaaaccgatgcaatttgactccctcgacggtttcgctgatgtggcacgttacgtgacgatgttgacctagtcttcgtcctacatggtattgacgtggtgcttacgtgtcattagaattaaaaaaatatgtgcgcccacttgtcattcacaaaaaaaatttgtgtgacccactgacaggtggagcccatatgttagtctatcccttcctcatcctcccgatctccccttctctctcccttttttgttcatgagccccagttcgccatgccccatgccgccgtcatcgagcagccagctctccagcatcgagaacgccggcgcgggcttggcgccgccagtggccatcttgctgatctccgtcgagccctctggcgtctgggcagtcgccgccgccatagccaatccggcctccacctgctgcaaatgtcttaaggggaagatggcgacccccttctccgagcgacggtcggcgaccacagcggcaccacgccgcccctctcctccttcctgcctccgctcatgaatgtagccaatccccttggttgagctcggagaagatagaatcagcgccgccactctccctcccgttgccgccactccggacgccgcctgctgttgccggcccctgcttgccgaatggggagggagagagaaggggaggatgaagaatgtgggccccacctgccagtgggtcccacaatttttttaatgacaaatgggtccaacatattttttttaattctaatgacaagcaagcgccacgtcaatgccacgtaggacgaagactggtcaacatcgccacgtaacatgccacgtcagcgaaaccgctcaccaaaaccgtcgagggagtcaaattgcaccggttttaacagtttaggggtcaagatatctgattttgcggttcagggtcatggattaaatttgggtcagttttaagggagtcaaagtggacttattcctcatcataattgtgtttaattattgttgttaagctcagacctgagactgatttctaccatctgtatattatccaggcttcttgacaacaacaaattatccggaagcatcccttctactttaggccttcttaatacattggaagttctgtgagtacaagcgcatattatggatgagacaataaaattcatagattgacactgctgccttatgtcatgaagttcgatcgatgcaggcgtttcgataacaatgcgcaattgacaggaccagttcctaccaacctcaacaacttaaccaggcttacagaactgtgagtttactatgtgtgtctgctttattaattgtcaattattcaatattaatagcttacgcgctatgctttcatttgacactagccatcttgcaaactgcaatcttactggtccactgccagacctaactggaatgaacgaactcatgtatttgtaagtgatcagtcaacccttccaatgttaaaactaaaattgactttccatttatcatactatgcaactttctggatggtttcatcttactaacttgcaattcaatttgttacaggtacatgaacaacaatagcttcagttcatcattatttgaataatcactagccgacgcattataggctgaggcgctatcagattcataatttacatacctaaaataattatttgaataatcaccagccgacgcggtatatatatccattaaaaataggtctaacaacatatgtatgagaattaatggtacttgtaaaattattttgagaaacatatatatttgtaaattttacctcaggcttggtgtagtagggaaacggtgtagttctatggtatgctcgtccatatgtgcctttagcacagaagcttaactcctagtacgatggctgtgtacacttaacaaaaaatctaacaaattgatctgttagtgcaaatagaagcctttgttcacacgtagcaggatcgcagcactggcgtatgtcttggctccctgtacacacgacgaccacttaacccgagattgctacctggcgatggatcgccaggggcgatcaggattcggtcctcccttccttccacctgattttcttttttggcaccgtattactttcctaaatttatgcatctaaagtttgtacatttcaagttcaagtttagggacccaaaatttataaatcaagtttatatatccgattcaaatttaaatttgaattcaaatattttttatatatagtacatctaaagtttatacacctaaagtttataaacctaaagtttataagtcaaaatttacatacccgattcaattttgaatttgaattatatccgattcaaatttgaatttgaattcaaatattttttatatatagtatttctatgcatctaaagtttatacacctaaaatttatagacccaaaatttataagtcaaaagtttacatacccgattcaaatttgaatttgaattcaaatattagtttatagacataaagtttataagtcaaaagtttacatacctgtttcaattttgaatttgaattcaaactttttatatatagtatttctatacataaattttttcaactttgtgttttttttaaaaaaataatttatggtgtagtaggaagagaagaataagaggaggaaggaagagagtagtgtataggggggatggggttgggggggtgatctttatgctactatggttttgatgtcttcttgtgtcgctatctgaggtttgaaagtgagtaaagatctgaagctaaggtaaataataggttaaaacagaagaatgataagaataaagtacctctctgaatagctactttcttacttgactttctgatcaatagaaaaagacttgctgtcctcaagttcaaggccttagagtgagaagggaattacgtggtacctctctttttcaataagcattctaccactaactatgtgcctggctatggtttgtcaactcttaccttttggtatgagaacggatgctggaggtaaatggatacacagctactgcctgacttctcagatttcagtatggaacaaaaatccatcttggctagctattcgggaggacttctccatcggatcagaacatgaattgtagggcatacttagtagatgcagatataggtattcattattcttcctcagatggggaatgggccaagccgatccgttgttggcactgaaagtgcatttgctagtttgaaaggagctgaattcgggtgggattcaaaatgattcttatgtttcgtagcatgcagcgcagactcacttggtaaatagccttccataaaagaggcaaggtgctcacacatgaaattccctttcttcgtgcactcatttactagatagtcaggaaccttcttttgacttgaccagcttacttgtatagtatagtagtaggcatttgcttctgaacgaccttacgaatggatcaactagaaatgaatcggtgtcataaacgaatttagctaaccgttgtagtaaatagcatgacaccaagcaatcgatcaaagccaactcaaaagaaagcccatcccttcatccaacgtgaaaatattctcaagaagaagccaaaagaaagagaggtgaaacagagtagagagaatcaggtgcttccagtgattagttatcaaaaagcactgttttccagatcggattcgatcacagtcccgtaagcagtagggaccacgagtgagcatgagcctatttcgtgatcggctagttgctcaaaaaatcgtataaaaatcaagcaaga

SEQ ID NO: 33245 - DNA, 809 bp, Oryza sativa
tgccagtggaaggctttctgcgttcagtcaatctacgcagagtgaatcggtccctaaggaaaccccgaaagggctgccgtccgatgggtacactaaagtgacgaagttgctttgactactgaaccatgcctggatcgtcggagcgaattggatgatcgagccgagggctgccccctcttcccctcgctctcctttccttaatattcaccgtcaagtcatcaaagccgtcaactaattcagaggggctcagctggcccggtcgccctacgctactggcgcttcctaaggcgaagctctcgtctttggcaaccagcaaactcagggctaaaacctgtagttttgaagcaagggatgagtgcgaaagccattgcgcttccgtacacgtgcatacgttttcttgcttcgtcgcgcgttagtacaataacgcacagccgttttcttgctggggcggacacggatttctctctaaaggcgaagactcagaagtgggcgaacactcggcccagcgggcgaacatgccggctccggctccgcgcacctgttgacacctttcgaagcactttcacgtgtgaaccgaagtcgtcttgccgaactccttcctttcttatttcagtccttgcctttttcatcttccgtaggggcctttagtcttttgattagactagaggtcgcgagagagcagagcgtaccgcccttccatagtcacgaggatcttaatagtcggtcgcgactattgtcatagtcaacgacggttgaaacttcttggaaaaaacttcgaattgggagggcgatcctcccggtgagctgac

SEQ ID NO: 33246 - DNA, 25840 bp, Oryza sativa
cccaactatcccacctgaactaaccagttcattaagccaatttagggtgagaataatcacggtgaatctggtcgatcgcccataaccgcgagcaaggctattcgaatagttttactctggccagaggtgcacaactgtacccacaagacacaatccaccggcatgtcaccatgcctgcgtagacacgtgaccatgtcgagtgattgtgacaagacccttcgcataactctcctctaaccatccacaccacgctgaggtttcacccccacccctaccccgagagtgggcagtccccccatgcaccgcggtaaatccagcagctggacaaccggacactcggccgacccaactccatcatgcccaccctcgccactggtgcctaggaaagggtctgttgatgcgaaaaacacacactggcctaagagatttgctttactctagtgcaggtctaaagaattgctttcggtttctgatcgtgccagttggtttgatcttgcaaccaacaagaaataacagaaacacagttaagtcttcaaacgatagccgatcggttgtactgccgatgacgtatcgttcaatattaggccgatgtgatgtgaaccagatcggcaatgaagaatgaagcaggataaaattaaatctacccgatcggctgtagatatcaatgatatataatctatttctaaaaatatgtttaaaccaaagtgattgggatagatcgaacagtttgccaagacagtataaatcacttatgtttaaaagtacttcaagatagagattatatatattcatagcatagccgatgaagtaaatctaagatgtatcggctactccgatactactttatactaagatgttaatacagacaaaatatactaaacaacaagcttaatatgtttcaacgcagcaagatcttaatataaagggcagatttagcatatcgattaaatataaggaacaagacaactaaaccaggtaagatcggctgaaactccgatattatctctaccgataatcatagaacaagctaaattatggttctaaatattacttaatagatcgaacctaaccgatgcagcattaggcataaagagaaacataagatttgaacaagtcgatgaaaacctctttgagatggtagatatactatataacctagatcaacgttgatatctaaccctgtcggctgccctctgttggtagatgttagccgatttagggttagatagaaatattgatagagattatatagcatatatgacaactcgacgatttacataaataggattagagtatcatgaagatgtcagcactaatcacgagaacgcaagccgccataacaagttttacctcttgccggagatcgaacccgatgcagcccgacttgaaagcaagaattcgtcgaaacaaaaatagaaaaggtggcgatgcgccaaaagtgttattaaactgattgttcttcatttacaaggtcttgggtcatatttatacccaaaatacataatatgtccttgccggatacgactccaaatctgttacaactctaagatacgaacaagtcttttaggcaaacacttgccgacaaatatctctaaagaaactattcaaaatactctagttaatagatacaattgcccctttttcggatttatcccaatcgtggaaatacttgctcagcacatcaatcgatcccgaagatgattctagaaccaccttaccaagatcggctacatcggctgttctttgtccgatccaatgtcagccgatgcagacgttagccgacgtgcccccgtagccgacacgtactctgtttatgagaaacgatctcctatcaaatccgcttcgactttagctttgaatttgatgcatgatttaccaaatttggtcatcaacagggtcgagctatactacagatcaagcaattacccactcccgcttgtggtaagcgttgtatgtcttccagggtttcccgtgaactggtccttaattgctataggtgcgactagcaaaaccatgcacccacaacccaccattcagtcgcattttagttggataattacgaccaatgaaacattataacgccccaattttcggtcgggattaaaaatcaattaataatgcatttccagaaattatattaaaaattaaatcaatttaatcaagtgacatagtgagggaattaaaaatttcctttaaaaatcatggccgaaaatattttgtaatattctctgtgccctaatgtactctctggatttttccacgaattttcagagctcaagaaataattttaaagttacaaagttcatttaatcaattaaaataaaagcaaacaattttaaatctccatccttgtctttgggccgctatcggaccaatcctccatcccctccccgcggccttcctactcctctcccttatcaggctgtcggcccagcttggtccctccctcgcaagtccatgccgcctcccttctcctccctcctctccccgagttgcctacagatgggcccatattgccgggctctccttgaacctctagcctgggctggcagccgccacggccgcctgagccgcccacgtcgccgcctcctccagctccccctcgccctctcccgtgcgggcccgacgctgccccactccctccactctccttcccccactcccttcgcggaattcggcgccgtgccgccgcctctctctccccacgatgccgctccacgttgccgccacgcccggccacggttttccctccccgagcctataaaatccatccccgggatcccctcgtccgtttcctcctcctccccgagcttctcacgcccccttccgctctctccacgccgcctgccatttccgccgcactccggcgagcttcggccacgcgccaccgccgctcagccgtcctcgttccgtgccgcttgtaccaccagcatcgccactccttgccgcaccttggcctccgctccgcgccttcaatctgccgccgaagcaccacttccaccgccgacccgagctccaccaccgcccgccacacttcagccgcctattgccgccatccccgtctacctcaggttgtgccacctatttccctctctccaccgccgaatccccacctccattgcaaacccgaggctaccgccacattcgtcgcctccggtcaccgtttgccgccgctcccggccatcctgagccgcgccgtggccacctctggcgccgccgcatacatccgcaccttggccgtcgctcctcaccgctggaatcccccgctggcagccattcccctcaacgcactggtgagcacctccacaacctccgccttcggcccatgtccccactcatcgtggacctcatccctctccctaactcctcttaattgaatccccaggtcaccccggtcaccgtcagctgcctcgcgctcgcggtgcgccatcggactgtcgccgcctccctccgtcccgaggagagccgccgcccctcgtcgacgctgcttggtaagcccccatcctcctccgcttcatctccccggccgcctcgtgccgcgccgccgtcgccggtggccgtccggccaggccgccgccgccgctcccaccacacgccgctccagcgccatcgccggctatgctggtggccggctggccgcctccccttggtcccagccgcggccgatctaggccatcgaatcggcctcggcctccatccgggccgcccatgtgtctgcacacgtggctgccatatcggtgctccgtcggcgccacgtggtgcgctataggccaaagcccttgagtcaccgacgtgggggacccacttgtcggcaccaccccttccctcggtggctggcgtcataattcatttaaattgtgcaataatccggtaagaattataaaaaaccatttaaatggctcaaaacttctaaaattcataactaattcatacgaactccaaaatgagccattcaacttgcaaaattcatctaaaattgagctctacatgtttgtttactttttatgtactgtttacttcatgttcattagggtttttcctcgtttgtgtgccggcgagtagatttcgccgtttcggaagtccgcggtcgcgaggaaaagaatccctagttctacttggacaagggaacatctatgggtataaatacaagaccccctagaaggaaaggggcacgaaacagtcaaaatagacaccaatacccaccgccaaacatcgatatcagagataagcctaaacatacccaatttgtcgcctacggaggccaacaagagggatctagcgttatctctgatctcgccaagtccatattcgaggaggaagactaccccatcgtcgactacgcgttagtgttcatgccgccaagtcaatgacggctagatgggttatccaaatattgtacttgtgtgattcttttgaataagagcaacaccggcttcagccaataggagtagggctatttatctgattctgatgaataagaggcccgaacctgtacaaaaatatttgtctccgtctcttttatttcaatctcgcatataccggaggatcttgtaccaagatcccccgtaattttgctggtttctataatggtcacccataatttggcctaacttaggtggtgaaggtgaagatgatggtgcagttcatggaagtggacggctgtaggatctttggtttgcagaggtgttcaagggtcagctatgcatctgcactcctttcaccaatgtcttaactcctttcaccaatgtcttaacgtattaagcacatactaccatataagtattattagtgttgggatacgcgtaggctacgatagcataaatcaaaattttctatcgcgtaaactaggaaccatgcaagtattagatcatagatcgttaccactcgacgcgttgcgcagtggaataaggcgctaagaagtcgaaggaattctcgcgaagtatcgcgcgtcgatgtagaggaagtagtcaatcgcaccggctcgacgttctcctcctcatgcgttctcctcgccgtattcccacgctgttcagcaccgcaaaccagcggcgcctctaccgatatccacacgtacagggacggaacgccacgcgcagatgtgctagcacccgcgcgcggctagggttttgctcgggaggggagtgacggctagggtttctcacgtgatgcaatacctccaccggtcacacctctcacgaatatataggatccatcactcgggcctccaaggcccgtagaactcctattcagatccctatccgaattaagctcatattggatctccatccaatccccttattctggcccattaagtgtgcgaccctgtaggttcatgtacactcggctgtaacccgaaaactccttttcggtccacgcgtcaacagcggcccctagcagaacgtattgacccaccggtcatacataaagatcatatcggctaaacctctagtgtatactttatgaacccctttgcctcacgatatcgattaagctcaaggctagatatatgccatcctctaatagctcaatcattcacttgaacctgtgatagattatttaacttatgattgactcctcaatcacctttggcatggccatgcacttccataatctacaacatagagggcccagagatatctcttcataggaggggcaaatcccattttaattattcatatcccactacatgtttcacaacatacccgaaaactacttttataactacccaattacggagtagcgtttagcagtccctaagtaagctactacacatgttggaaaccataataatctcaggtctaaggattcaacaccaacactaaatgagattactgatgacacaacacatatggctcttgcagtgtctcatgttgggtctatccaacaacatgttccccaacatatgtccacattattaatttggtatctctataccatgatccatgagacatgataatcaattaatacatgtgctgatcatctaaacatatttgtttcacatatgatatttgatcagggatcctttagaaatagtaacaaataacataaagagtctcatgaaagaatcacatattcattaaccaataatgagttatttatttcaatgaacaaagtcggataaatatgtaaatatagtatgtgatataattatctctatgattgcctctagggcatgtcactaacaattagctattctaacttatgtttgatcacgcatgtttcagtcgtgaaaggcaaatgtgacagttgctctatgtttgagattacagctagtactccattgagcacgtatttgtttatgcgaagatattatcagattatctttatgctctgtagatcttctgtttaattctgtttgatctgtgatgatccagcagctgctctagcctgtaggctcttctcagaagtagcatttacgtggtgtttggatccatgtacttaactttagtctttgtatttagatatcaatttagagtattaaatatagactacttacaaaactaattaaataaatgaaagttaatttgcgagacaaattttttaagcctaattaatctataattagagaatgtttactgtagcattacgtagactaatcatggattaattaggctcaatagattcgtctcgcgaattagttcaagattatggatgggttttattaatagtctacgtttaatatttataattagtatccaatcatccgatgtgatagggacttaaaagttttagtcccatctgaacagcgtcttaatatcttaaatggaaaattgatgattttcttcatagttgcatgtgcttctacattttgtccaaagttattttctcttgatcttctgtaaacagatttgggacaaaaacatgaagagtctgtacaaataactttgtggcatatttgtcgaagcgcatgcaactatagaacgaaccatcaaatttcccatttagaagtgtttttttgttgaaaagaattttaaaatcgtgaacatacggaaaaacgtcagactttggctgccaaaatcggggattcttgcatcaaaacctgaagaatttgcactgtgtatttgttttctggaacagctttggtaatttaaaaccataaaaacatacttccttcattatttgaactttgagttgttaagctttgaaccaacaatatttttcaaaataatttagttatttaacattcaattcataccaatagacttctagtcgatagtactttactaggattttacattttaattttttttttaaccaactcgatctgacttagcttaaatcttaatcggtcaaaattcatgtactctcgatcaaaaattcgaaacacaacttacaaatattacgcatatatagtttttaatatgattttagtgagattaagatgtgtagttagtttttcatcttttagagagtgtgttagatggggcgcatatgcgggtatactatgacgttatagtgatgtgtatacgtgtacgtctatcatgtaatcgaaaaaaattcaaaatggaaaaaaaaaagtatattcaagagaaccagacgtgtcacgtgtccatccatcctctgttgagattttagaagtgaagtccgcggccatgagcgaggcgaccgccggccactcctccgcggcggcggcggagtctgcaccggacgacgtcatcgcggagatactcctccgcctcccgccccacccttccttcctctcccgcgcctccctcgtctgcaaccgctggcgccgcctggcccgcgacccgggcttcctccgccgcttgcgcgcattccatcgaacaccccccgtgctcggcttcttccacaactccccggacctcccccgcttcgtccccgccgagggcgtccccggccgcgtcgccgccgaggccgcctccctcaggagggacggggatgacggcatgtggtggtgcgtcgactgccgccacggccgcgccctcctccgcagccgcgactgggccgagttgctcgtctgggaccccatgaccggggagcgccgctgcatcaccgtctccagccagatccaggagggggccctcgacctcaacgccgccgtgttctgcgctgcctccggcggcggtgaccaagactgccactctagtcccttccatgtcgtcgtcgtgttcaccaccggccaatgccatggccgcgtgttcgcctgcgtgtactcttcggggatcgacgcgtggggggacccgatctcgacgccggtgacatcaccatgtgagctctatgaggagccccctgttcttgttggggaagctctgtattggcttcttgatgggagccgtatacttgagttcgaattcggcaaccaatgtttatgtttagctctgattgatcatcctgtggagaatcatgccatcctcaagcggaacatccgtcttgtgaggatggaagacgatgatgtgcttggccttgctttcgtcaaggatttcagcctgcacttgtgggcgcgggaggttgccgatgatggtgcgtcgcaatggattccgcgcagagccattgagctggacatgatcctgccgctggagggctatcggtgccgtgcgatgcctatttggatatgtggatttgctgaagatggagatgtggtgtttatacggactgttgctggagttttcctggtttggcttgatacattgaaattcaagaaggtgtctggctccttactcatgaagactgtttactcctatgctagcttttatgttccaaatggtatgaagaattatgcctctgtccctttgctgtgaagtatagttattacctaatgaaatgacttccaatgtttttccttttggtgctgaacccagtactgtgtatcttgttctggtttaggactgcaagctatataaaagtataaaacagaccaacactttgctaacttgctcttattatggttttctcattgctgagctgatgctcagtagtttaccactatggtagaaagtggattgatggaatacctagttgtgcaaatttcaatgatacctcatttattatttggaaaattttgcctacttaatgctacatgatctgtaaggaaaagtatgacaagtattgattcagcatatgtagtttgctttaaaaaaatatagtctttctctataatcaatggcccatgagatgcaagctaaaaacatttatattgggcggcaaattttaaatttacatcatttcgagctttagatgtaacagtctaatgtgtagtcctgatataaataatacagttgtgagtaatatctgattcttatgaagaaactggtgcccatcacatagtatacttttcctttcagggtgcattgaagcaatttttgtgacttataagtgaacaaagatgtaaataccacatgaatttttatgcacatcttgtgtaacacagcccttgttagcctgtcgacacttgacacatttgtgaaataggcgttgccaaaagtagctttacgaactatgagatctgcttaacttctcattctacatggtagagtaaaaactttcagaggaaagagccgacatgaaaatttaacttgttatttttggacatgagtgctttgtcgatgtccattcctgaatgggacatattattcttagtgttggttccttctggtatgatgtcaatgaaaatcccttgtaactaaatgagttgattaagctaacttatgatttgttgagtataaattgtgtatagcaccatagaatactatagcgagtatagttaagtgttttatgaattctatttgttgtctttattgtaaatcaagccaggccattgagattcagatagtaaatcatgtggacatttgttttttctacttgcgacatttcattgtattacactgatccaagactcattaagttcgactatgacttgagtaatttaagtctattactttacatgaaagttcggtaatttaaatgagctagtacgtaacattaaattgcaccagatatcattaaatgctattatgaaacatgaaaagtttggaagctaatgaaaatgctatctgaaaagtgttattcaaggcttcaagcactgctacttcgtaactacatttgaggctacacaggcagtcacttggaggcaaactaaccatacgtgtttctaggaaaaatatacataactcgatgggtcattttattgtttgctgaaaatggctgactgagtgactgtcatatttcaaattgctcaccaagtttacttcatatttaggaaatatcttttatgttctctggtcaccccgttcctcctggtgatttttgtcgtagttcctgtgtttttctgtgagtccacatgcacaattattgatgtctgctgtcttttcctttgatgttctgcatttgtacatcacatcacagtattttttttcctgaatatgcaagacatcccagtattgaactaggaacatttaatagcgaaattaggaaaacaatataggtaaattccacaaccaatccagtaatctatgagcatgcgagttcctaggagctgtttggatgaatgccaccaattgccacagatgtgttgctaagtgtcgcgtgcagcacttattgtggtgtacaaatctagcagagcaacatgtctatcaattaggcaacgctattctatattgacaatgtgccatatagaagactagtttaagagttctgaagtaacagagtatgactttggtacactattaacttacttttggtgttgtctgattgtggatgtgttaattcatcaaatctcatagcttattcatgctatatacatcttattgtttgctgttagctaatgtcacaggataatgacggaaatttccacagaagcccatgacatcccatgtgttgatagaagcaaggaactactgacattttcaagcaggtgaggcagcctggacatcagactttccaaaatattttgttcttttgtcttatgtgcagtttttttttaaaaaaatcgaaactgcagtggttcttttacattttagcttcactgcaattcacaagctagagcctagtaccagcaattggttcttatactaactcatattacatagatcaatatggcaattggtgagtaaattcatgctatatacatcttattgtttgctcttaagagcatctccaacagcctctccaagtgactgtccatgtcaaatttgagcaattctaccaaaaaatcgtgctccaattgatatagagattggtttaatttcacccctgtatttttgttgctcaatctgttctgttatatagcaggaaaatgtatttcagttgtaattgctattgcaagacttacacatgctgcagtagtacattggtctctctatatttttttgaaacaactaaataccaggagagttatgctgatggtagatgaaacaaaaatatgtctagatatttgtgtaatagacatttgacatttgagacatttgtgtaatagacatttgacatttgagacatttgtgtaatagacatttcacatttgagacatttgttatcactgaagtaaaaaagttgaggtcatttccacaagagttttcctataagaaaattcaataatttatgacattataattggcagaactatactctttcttttcagaaccaccaagctgttttcttataaacatgactgcataaacagatggtgtgatctagtgtagcaactttctatcttgacttgcctttatttttcctttcactgtttttgtgcacgtgcaatttgggctatgagttttgtcggtaaagggtactgcaataatcttcttttcgactatattgtagtattcaggaaccatttcgactatatagtattcaggaaccttttcatgtataattctctctcattcgttttctcgtctgagctattttaatagatggaaacaaagatctgttccttcctgcactacactgaactcatttcagttaggatgaaaatgcattctagagaccatcagaaagatgaattctttggggaggaccttaattctataattgggtaaggacctgaattatagaatcccactgaccacaagtagctgttaatttctttttgaagaataataagtagttattgctagagtttttaattgcgttatatgtgttgttagtgccatgttgcattcaacttgcgccatcaatcttcctaggattttgttgggtaggtgccaacttttctgtgttggtagcttgcttttgattgtactcctgttgttcatgattaaacggaagctcgtttactcacaatgagaaaagtggttacatcattacatgccattagtttgctcctttgtatgatgatctattgatgtcccctaattttttctaccgctcctgtgatggatacagatgatggtgcaaatcatggaatcggatggctttagaatctcttggctgcagtggtgttgaaggatcagttatgcatctgcgctgctttctcctgattgcagagggtgttgaaggatcactccatgtttcaatgaaaaggttaaagtggcattttgttgtcgttggagataacagctactaatactccaacgcatatcagattactccataattcaataaaaaggcgaaattgacattttctcgcctttggagattacagttaatacttcatgtggtacattttattttgtgcgtgcgatatgatattgttgtattcctatctctggttactctgtttgattgtctgtgatgacccaccagctgctctagttcttttttttttctctcataggcaattcatctttcaaatggaacattgatcatttgctccatagctgattgagcatatacattttgcccaaaagttgtgttcacttgatcttatgtaaaaaactttgggccaaaatcaagtgcaaacaactttggatcatattatagaagctcatgcaacaattgggtgaaccgtccaatttttccgttttgtgttcgcctgtgttgtgtggtgtgcatattgtgtcttccgtggaaaaaaaagagccattttttgtaaaaaagtgttcttggttgaaaagaatttttaaattgtgtagatacagaattttgtatttcaattatttgaagtaagccatcaaatgcttgcatgaaattctcattatttgcattatgcatttccaatggttaatctatggcttataatctgacaaagataaacgaagcaattcaaaatataaatttaggataagactttgggatacttttactctaggtgatccaataattaagcccaaagtatagaaaagcggcaaaagaacgtctagactaattgtagacggtaaattgtattcacggtgcatcaacttaacagttgggtggtgcaatttagataaaaacttaagaaatgagtgtcctagtgcaaaaggtgagtggctaaaaaatttataaataataagcttataattagaacaacttgtaaagttgtaaggtagctgcgattttgtggtacaataagttataagaagagatgcggtaactcaattattcaaagcactttttttttcattatacagatttaatttataagtgaaaaaaaactcggaatattttttttcggtgtgctaatggagcagtgaaaatttgaagttataaatcatgtttaaattttacgtgtttgtactgtgttttaaaaaagaaaaaaaaattgagcaggcttgagaaggggtgggcagaaaaagactgaaccgaaagaccgagaccgagaaattcagtcatcaattcagtcctaaacagtgaaagactgaatttggttcggtcaattcggttagtctcctcagttaaccgaatagaccgaaaagactgaattaacaaaaaaaaattgtctaaatgcaacctagaatccgctaagttcaataggattaaactctaattttcacatccctacttcttctagacatgcaattcatacatgcttgcgaattttttttttgtgatttttgtgttaaaaatttctatttcattgcatatatgaaaatgttattgaatttcggtcaggaccgagaccgagaccgaatttgttggtcctgactttattttcgttgtaatttggtgttcacttttcttttttcaaagaccgaaaaccgataccaaaattttgggtcagaccgaatgccaacccttggcttgagagacttgagaggcagcactcccctaccaatccacacgacatgagcgcggcggcggaggcggaggcggcggcggtggagtcgttaccggacgacgtggtcgccgagatcctcctctgcctcccgcctcacccttccttcgtctccggcgcctccctcgtctgcaagcgctggctccacctcatccgcagccccagcttcctccgccgcgtgtgcgcattccatcgaacaccccccgtgctcggcttcttccacaactaccgggacctccccagcttcgtccccgccgagggcgtccccggccgcaaccgcatggacggagtcgacgacggcggcgacgcgcggatgttcatcgactgccgccacggccgcgccctcctccgccgatacgactgggccgacctggtcgtgtgggaccccatgaccggggagcgccgccgcatcgccggccccaaccagaagatgcagggcggcggcgccggcacctcccgccgcagcgccgcgttgttctgcagctgcgatgtttccggaggcggcggcgaccaagactgccactctagccccttccatgtcgtcgtcgtgttcaccggtggctgccgcgcgttcgcctgcgtgtactcttcgctgaccgacgcgtggggcgacctgatctcaacgccggcgccattgccatgtgagctctgtgacacgccccctgccctggttggggaagcctcgtattggctttcttatgggggactcatacttgagttccaatttggcagccaaagtttaactctgatgaaacggccattggagatgcttgccgatgtacgtcttgtgaggttggaagaagatgggcttggtcttgccttcatcaaggattccaccttgcacttgtgggcgcgggaggttgccgatgatggtgcgccgaaatggaaatggataccgcgcagggccattgagcttgacaagttcctgccgatgccaagggtgctcaccggaaaatggtgtggtgaaatgtttgtttcgattagtgggttctctgaggatggaaatgtggtgtttatacggacccttgccggcgttttccttgtttggcttgaagcattgaagttcaagaagatgtctgaccccttatacatgatgactgttcacccatattcaagcttttatgtcccaaatggtatgggaagttctctctctttctttatcctctgctgtttagtattgtttttagctaatgaaaagatttccagtgtctttcttttggtgctgaacccagtattatgtgtctcattgtggtttaggagtgaaagcaaatagagtatacaatagaccaaacttttccaagtcactttcattttatggcttgttgagctgatgttcaatagtcagcattaccactatggttggaagtggattgattctacttgcgccaatttcaataatatatcatttatgatttggaaaatcttttctataatgccacatttctgtaagaaaaaaatatgacaagtattgattcagcatctgttctatttacagtagtaatgatctagtagtttgattaaaataaatatgcagatgaccttttctttataatcaatgcctgtgagttggaagcgaaaacattgatattgcgcggcaagtgttaattttacatcatttagagccttagagatgaagtgctaatgtgtagtggtaacagataaagcatcatttctgatgcttatgaacaaaacataagtccagttcttatcatgtagacatagtatacttttccttcaagggtgcattgaaatgtatgttggcacaatctctgtgacttataagtgaacgaagatgcgaaaactccatgagctttcatgcacatcttctgtaatacaaaccttattagcttgttgacactttgagacatttgtgcaaaaggtactgccaaagttgctttataataccagattgatatctcattctgcatatattgtagagtaaaaactttcagatgaaaagaacagtaacagaaagataacttgtgatgtttggacatgagtactttttcaatgaccattcaggaatatgttattctctgtattggttccatgggaatgatttcaattaaattctcttacactataatgtgttgattacttgattatgctaatatatgattcttttagtataggttgcatatagtataacactattaaattctcatgtactataatgcgtgattacttgattacgctaatttatgatttctttattggttggacttattgtaagtcaagccaggccattgagctgcgaatcaacaaatcatgtaggtgtttgttttttctacttgctgattttcattgtattgttgtggttattgacttattaagttcgagtattggactgattgtatcttaattttagtactttacattaaaatcggtaatcttaatgagctagtgtttcaaaattaaactgcaccagatatcataaaatgccattctaaaacatgaaatatttggaagctaataaaaatgctatctgaaaagtgttgttcaaggcacagtcactttctagttaaaaggcagctagaactgaagctgactatcccaattcaggaagacagaaattgctggttgggttagtccaaccaatatttgggattctttgggctttgctagggctgacttcagtatgacaatcttaaaggtctataattgcacacttgagtgatctgtctacagccaattaaccagagcatctatagcagcttcaccgctttctttttagtattaaactgccttttcaatgtgaaaaaaaggcctaggcctagtactcagtcactcagagccaaaaaaaaaaaaacatgcttccaggaaaaatatacataacccaatggaccattttattgtttgctgaacatggctgactgagtgactattatacttcaaattcttcatgaagttttacatcatttctggaaaatatcttatgctgtctggtcattctaccttcctcaaactggtgatttccgttgtagtacatgtgttttacttgagtccataagggaagtgcaattatattgatgtctgctgtctttttttttgtcctgcatttgtacatcaaaatcccattattcaattaggaacatttaatggcgaaactaggaaaaagataataggtaaacaccacattcgatccagaattttatgggcatgttggttcctatgagctattttgagctgtttggatgaatgccaccaattgcgaaacatttcttgttgccacactttattgtggtgcccaatttagcagaacagtgtgtgtgtgtgtgtgtgtgtgtgacaagcagggattgaaatttcggttcgaaatttccgaaatttcggaacccaccggcatgtcaatattttggccgaaattttcggtttttctcaattttttgtgaatttagtcaaaatcagttaaattgcgtcaaaatttcagaaaatttcggtccaaaaattaccgaaccgaaatggccgaaattttagccaaaatcgaaattgaaaaccctagtgacaagtaggccatgatgttgaagaactgtaggtctgtggcatggacctgcttaactcaagtgtggcaaaatgtggcatggtagccatctggtggcaatactagatcagcaatagcccataagatgacttctaattaagatattctatacatggccaatgtgccatactaaagactagtcttaagattgctgaaatagcaaagtacaagtattggtacaccattaacttactcttggtattgtctgactttgattgtgttaattcatcaaagctcatagcttatatatcttattgtttggtgttagctaatgtcacagaataatgactggaagttccattgaagcccatgagatccaatgtgttgacagaggcaaggaaatactgacgttttcaagcaggtgaggcagcctggacatcagccttcggaaagtttttttgctcgtcttgcgtttagtggttcttttttttattgattgaaactgcagtggttattttccattcttgagctttatcataattcacaagctagagcatagcaccagcaattatacatttttggctcttatactaagtcatgttttttaagtagatcgatgtggtgattggtgagtaaataatctatatgcagattaactcatgttaattaaactagtcaaatgaaaagactttcctagacctttggtaatcatttaaaactatggatagattttagtaatttgtacctgattgcagcactttgccactggcttacaggagctcttttgtgtacagatgtttcaagaaggtagttttcactcgaattctaaaggctggatttacttgaattcttgtgtattttcctctgcaggatacgccacgggtatctgacatcaggtctgtgatctcatgatgtgcatgagttgcagttgcacgtagctcaaatcgtttgctcgactggccccgaaaccccagctgatattttgtaaagaattggtttaaatccacccctgtgtcagtcttcaatccctcctgttagctaccaggaaaaatgtattacatctgtaataggcatgctgcggtagtagattagatatattggtctctgcattttatttgtcttagctaggaagattggatgttttcttcgaaataataatacaaagtaggagagttatgctgatggtagatgaaaaacaaaattgaatgctcaggatgaatattggatatatttatgtccctatttcaatactatttctatgtgaagttcaaaaatattgctaatattgatatcccttgttattaagggtgtgttggaacatgtgggttcagaacccttcccttcctcccgcctcccgacacataaaatggtaaaatggaacggcggatgagtgaatgaataattaagtaatccctccgtttcacaatgtaagtcattctagcatttcccacattcatattgctgtaaatatgaatctagacatatatatctatctagattcattaacatcaatatgaatgtgaaaaatgctagaatgacttacattatgaaacggagaaagtattaactaacaaacttaaaaaatatattaatatgattttgtaaagcaacattcttatagaaaattatagaacacaccctaatgtggatctataagctgtgtgatacgaccatactctttatccttaacaaaaggatcacactacttctgcaaacttttttctctcctttctccactcttaggtttaagatcatacataagtatgaaccagcacacttataagttttaacacattgccattaggtagttaaccatatggctaatagtaagtattgcactaaagactactagtttctaatgttctagttatggacacattttagcatcgtaataaattacacatatacattccatcgtaaataactttgatgatacatgagtattgttttctagatcttgaaatcactggtgatagtgaaattattgtagaaaatagttagctaaccgtaacaagagcctaaggtatgaaacagtagcaataatcttataatctttctcagtaatatataacattataactactcgtttcgtttcaaagatatcgctagtcgaacggtcgaagaatagtttatgaaaactttaagatccactttgttgtgaacttgattattttaaagagttgtacattaagataatatcttcttttattatcggaggttaaggttgaatatttcactttgtcacgctaaatgttagttatgttatagtttccataattaaatgtttagtcattatcataattgtaccacaccactttgtatcccatgtccaacctttatttgtgaaacttgtggataggaaattgttagtcacactttaacaacatgtatacattattcaacacattaatatgggtgttgtatatcagtatatatctttacaattatctgctaagggtattaaagttaattcgcatactgatatatgttaatgataataaattaaggatagtcaattcgcatactttagtatatctcaatatattccctttagaaaaagaattaataattacttaaatttttttaataggacgaacagtcaagtttaaaaaaatcaacgcatcaaatattccctttaaatttaagggcaattactataatatctcatatgttgcccctaagagtgccacattcgattgagtgatgatgtggaagagagaagtgaggagagagatgatgagccacctctaaatcaagaggcaaccttcacaaaatttaagaaggatgtgagagtattagagcaggtacaatagcaggttataagccagctgtaaacatattttaagaagataaataaggagagagaagagcagcgagctacagatttgtagccagctgtagcacggactccaagatgcagtgtgtatatgataggtgggaccagctattaatagtgtaatatgtaactattgtatgaatgagctattagattggctatatatgaattgaagctagtagttggctatattgctcttagagcaaagataatagtaacgcccacagttggctgcaattttcaccatatcatcaaaagttggtttaggtcccattcgtttatccaacaatatttgaatgaagatgaagattttcgtggcacgcttttcaaactgctaaacagtgcgtttcgtgcgaaaacttgctatatgaatgttgtactaaaatatcatattaatccattttttaagtttataataattaaaactcaattaatcacacgttattaccaccccattttgtgtgaaacacttaatttttatcttcatcttcatcttcaagagattcaaacaccaccttagtagcttaccggcacaataagcatgctctaacccgtctgtccatcctttcatgacaatagtattttattcttcattcatcttattctctctctggagattatttcaccgctgatgatctatggcatcgacggggcccacttttctcgaaaaacgcatgcagccaggcgacaatttagtcgccgactcgccctctctcctgtcttttttctgccaaatcatcactccggtctacgtggccagcatatcgccggcataccagctgctattgtacctgctcttaatgatatggtatttgtattggtatttgtgtactagaggtgatgcattgtataggttgactcttagagcaagtttaatagtatagcccactgctagctacaattcatgtatagccaatctaatagccaattcatacaataattgcttactatactattagtatatggtcccacctgtcatacacacattgcgtattggagtccatgctgtagctggctacagatctatagcccgctgctattctctctcatcttttatcctattaaaatatgtttgtagcttgctaatagtctactattgtacctgctcttagttcatgagtgaataaaatagataaatttagaggtgatagtcacatgtaccatagcatttgcccttcagtgcacaaaattcaatcccccgtttctctcatccccagatctgacgatggccgatgtcaccggcggccactcctcccctccggcggcggcggcggagaccttgcccgacgacgtcctcgccgagatcctcctccgcctcccgccccacccttccttcctctcctcggcgtccctcgtctccaagcgctggctccgccacacccgcaaccctagcttcctccgccgcttccgcgagttccaccgcaccgcccccgtgctcggcttcttcctcaactcctcgcatggcgccctcttcttccccaccgacgcgcccctctgccgcatcgccgaccaggtcgcctccctccgcaggaacacgggcgatggcttgtggtggctcgtcggctgccgccacggccgcgtcctcctccgcagctgcgactgggccaacctgctcgtctgggaccccatgaccgaggggttcgtctgcttccccgcccccatccagatggtccaagccgacgccgaccgcgacgccgccgtgttctgcgctgcctccgccggcgacgaggaccgccgctccggcgccttcaacgtcgccgtcgtgttcgtcagcggcgaccacgtgttcggctgcatgttctcctcggcgatcggcgcctggggcgacgtgatctcgacgccggtgactttacctctgctgatgatctacgacgagcccgctgcccttgctggggaagccctgtactggattgttaatggcagcagcttgctcgagttcaattgcggcagccaaagtctagctctgatctcgcggccatcggatatgcccgcaacccacaggtggaacatccgtcctgtgagtttggaggacgatttgcttggcctcgcctttttcaacgatttctgcctgcatctgtgggtgcgggaggttgccgatgatggcgcgacgaactgggttccacgcaagtccgttgagatggacaagctcctttcgctgccagtggcgacggaggacagtcggcgccgtatcgtgcctgcttggatatgtgggttctctggggatggaaatgtggtgtttattgggacccctgctggcattttcttggttgagcttgacacgttgaagttcaagaaggtgactgatggttccctactcatcaagactgttcatccctatgagagcttttattatgttccaaatggtatgagcaactatccctttgtccttttctgtcaagtagtctttaaataatgaaaagtcttacaatgtttactctgttggtgctgaacccaatactacgtagtacatatcctgttccagttcaggagcactagcaattaatatcaaatagagcaacacatgccaagtcacttttattttatgttttattgatctgatgttcagtagtcatcgttaacactaaggttgaaagtgggttaatggggatatctccttgcgcgattttaataatacctcatgtatcgtttgtggataccttttccacttaatgccacattatgtttaagcaaaagtatgacaagtattgatttgtgtctcttccacttctatttatactagtttttaaaatgccttttccacttaatgccacatttatgtgtaagcaaaagtatgacaaatattgattggtatctgttctacttatatttatagtagtaatgaacttgtttgattgaaaaaaaaaatacagttgtaccttttctttacggtgagctcattctataaagatcccactgaaaattaaaatttaacttttgttgtagttgttaataaaaaatacggttctgacaatttgattaatacggctggaaaaaagggagatagcaaacgccttttctgccagggttttgaaaagatgaacacttattcattaagtgccccttagcttactttgtttggaatgttgttagttgtacttttggtgttggtccagttcttagtgtttatcatctttttggaccctggctaaacaagtttaagaagaaactttagtcactcattttgattggaattgcttttgtatgctggtatttattgaaagctagaaattcagcctgtttcaaagctaaattatctaaagatcctacagatataatatattttgtttgcttatggatgttatcttgggctctaatgcagaaaaaggaggaaaacaggagagtgctatagtggggaaccaggtttctgaggcaggtggcaagtgagatcttccgcgccaagttcagatggagactgtgctcaggacagttggaaggatgaacacaaaggaggatgtcactatatgttgggagaattcaccaggtcttttctagttttaagttctgtttagctgatcatcactttctggatgctatttctcggtacatgttggttgtagtcttgtgctttgaaactcaacttttgttgtaaaccagcggttggtatacatggtaggatggcaccatgtgaacaacctggctgatgcttgacctgtttgctgctgaaaggtggtgtgggcgttatgaaccttgtagtctgtttgactgtttccttcagtggtcggtttgaagacaaataaaaaacaggttttcataaaacaagttttaatttgatttatcataataaacacttataggttgttagtttgttatggatcatttatttaacatcatgtttgggtggaaaatactaaatatgtgttttgcgatagatgtgtgtttggcactttggctggctgctgcgagggagaaaaaaggggcacggtcaatatgtttcgtgctgtgttgattgagaacaacactacttttcgtaaaattgttgtgtagtttttgattaaacatgatttcccggttttattgaaacccagtttttcttaccgcttacttgcacaaattttttttaaaaaatgtgattaaggtaaagcggttttaatagaatatgagatacaaacaacccgtcttgatatatcaagggcctatgagttgcaagcaaaatcattggtattgggtgcccagtgttaattccacatcagttgtctgcttactctgttagaaccaaggtttgaaatttcgccccccatcggcatgctcaaatttcgtccgaaattttcggttttttgtaattttttgtgaatttggtcaaattttattcaaattcattcaaattcagtcaaattttcaaataattttggctcgaaatttccgaaattttggtaacccctggcataaaatccaatttcgaaatttcaaaccctggttagaaccttagggttaaagggctattttgtagtggttatagaaacaatagaatgatagatgataatgcatggtgcttatatgaacacaaaacaattttggtgcttattgcactgtattcttttcctttaagggtgcaatgaaacattaaatagcttaccacatgtgcatatagttggtgcttggtttcataagtgttaagagatgagaaaaatggttgtagtgggtgttgctgctgttatctgagctgtctggaaaaccaggaatgcatatgtgatatgttttataaatgtacttaaaacacattctgttgagctgatccattatgtttgcttttggattaaacctggcttattttgcagaaatcaagtagcaagtgagatgtatggcgcaaaacctggctggaggttcggaactggaatgctggactgaattttggcaatcctggtggtttgaccaacaaaatgagggggagatgaagtcctgtgatgctttagtaccatcagaagttttagttgtcttattacagatgttctcgttagctgtactgaaaacttgtataggttatcctagtagcatcacactgatgggatggcatctaattaagaaggggtggcatatgctacactttttcgtgatgcccaattttggcagagcaaaagtgtctatgacacactgtaattgtatagcaaagagtgtttatgagaggattctggggtgttggatgtaaaattctcactgaagaacagttacagacaagcgaccgaagaacgtgtgatgtcaccgaagcgtcgctcgccacttgtgcctgcattttccgcttcagcgagcagcctttagtcaatccccattcctcaccccaaaccttaattccccatttttgaggttgcggctgccattgggaagcaagagcgttcagcttacctctaggatgaaatttaatttgtgagtgcaatttata

SEQ ID NO: 33247 - DNA, 11329 bp, Oryza sativa
tcgttgttacttgcattgcctatagctctgatgatcactggttcccgctgttgccgatggtgaagatcattggcgttgcggaggagggcgacgtggtgtttctatggacattgtcggggatcttcaagttctgttctggatccatggagcttaataagaaggtttgtgaagcaactaaagatatggagattgtgcatccgatccgtatgtgaccttttctatgtctcaactcgcaactcccacaggtatatatatgttcgcaaaccatcctagcttccgataggcaattcaattcaaatcggtttcatggattcgttatttcaattttctagtgtcatttctgaaatgcacagctgttaagaatttttactatttgtctacatccaactgaaccatgtaatcacatatcattacttatgtttgaatcctgaaatgtttgtttccattctgccttcattttgcttagacaattaattcagattattgtcctagttaagtttatggaaatgtagagaccaggttttagtccattttctataataagtttagtggaaatacttaaattaactggtaatatatatgttataggttgtcaaattaacatataaaaatgtacaggatttatcagaaatcaattaggaacataaataaatagtgataatataaaagacaatatttttgtatgaatcagtagcacatgtgaaatcttgctttgttgttgaaccttttagttaattttatgcgcttgtgcttcaatcatcttctagacttccactgagcctttttacttcgatttggagataatgcaatatgaggatttcttaacaaatatcaaatacatgtggccactatttatttaagaaataattattttgccttttgtaataaaaccatatacaatgaaaaagttgcagttagaacgaactaaaattgcacattgcatagtattgcaaacctaggtttagccatacgtgatttaggtgactgaagatttataaaatttgcacataaaatctagaaaatcccttttgtaaaaaaaatttgcatagaagactttgaaaactaataccttggaacaatatatagcaacagttttttgatttccttgcggtttctttttattttctctgccttgaggaggacacggcagatacaaaaatgacccaacctatgctgtgctggatgcaaaattatcactgaagaacagttacaaacaagccaacgaagaacataggatgtcaccggagcgttgctcgatcgtttcttgttcccgcattttccgcttcaacagcctttaatcaatccgcattcctgaccctgaaccctaatccctatttcagaccttgtgggcgctattaagatgtgagagggagagcttagctcgattcacgctgctctttgccgtcactatgttcattggatttgaccgggaaggtctacgtacggttgtacaaaatcaagtaggatcgaggatcgatggtggagaataaacgcttgtaaaagaggatgaaatttaactagtgtcacgccccgaactagccccgaacgggactagcccgtgacgttccaaattaacctgttaatcgataccagtcccaggaaacagtgctggtatcacaggaagacagaatatcacaaccacaggggtctctttattacagagtaggagtacagtcatgttgggctgcggacagatcccgagctcacaactgcattacaaaagggaaagcggaagccaagacttgaatcaaacatcacaggcgcgacttgggaactaggccaaaaccctaaaactcatcgtagccgacttgctcctggaagaactcctcgtcagcgggggccacatcatcttcttcggcaactggggggattatttatatagagcaagggtgagtacaggagtactcagcaagccatgggaattaagtgtttaatgcaggcttcaaaggaaaggctgttgtttttgcaattgattttatttaaactcctttttgaaacaactaagtgagtgcttctcaaacgacacggatgggacagtgcgtcttgtccggtcggagtatgtgcaatgtatcagtctttgaattgatcagggttggcacccggccaacagctttcaaacggtcacccgggcctggttgatcccatcaaccgcagatttttcaaacatcgaacccattccacaacagcaatttcacaaagcagtagtcaaacaaaactacgctaggaatcacctcacatccgcccatgaccgtgggcacggctgttcgaacagtttgttaacctctgcagagggggtgcactttacccacacgacattactaacccggatcacccagcccgtgcagaatggccacgtctggagaccttgacgctttcatgacaaggcatttcgaaagccgacacaggtttaccatatgccaacgagaggggttccagaccaacaccaggttaggtcccagaccatactgtgccaggaagcccgggagttctccccgacaccaccccgttgaatccacatgtctcttggcatcaaggctcccccgattagcaatttactcagccaggggtgtcccatttcacccatgtggccgcacttgtcttatgtttggatgaaattccaaggaaacggtccttaagtgcaagagcgggaaaccgtactcccggtacgtcccccggcctgcgattttggaaattcatttagttcgcaagcaccgacccaggtgtcgggttttccaagtcttttgtaaaacccaagttttaaccatcgttggatgttttatatttgaggggaggtgtcccgatgcgcgtgcccgaaggcccgtacatcgaagcacaacagtcgacaagggagggttaagtgttcaataattcaaggagggtaattgcagtaattaggattgggggccgacgggctatctcgcaagccgcggccgaattacttgtgttaatcctattcatgcaatatttgcggaaaagaaatacttagatttaaattataggtgcaagatggtcaaaggtaacttgccttgctcaagatcttgagcttgatcctcgtaatcctcgcactgtgggtcttcgggctctgaaactacacgcgaaacgggacaactcaacaaacggcaaaaataaagccctattattgacctctaagcgtgccattagatagatctcaagatttgaggaattttggaagttgaacggagtcgaacggatgtacggttgataagatatggaatttctaagattattggatttttgatctaaaggaaaaggatttatttaaatcctttttgagaaaagaaaagaaaagaaaagaaagagggaggggaattagacttccctcgggcggctagggcgtggcccgagagaaaggggcggctcggccgaacttaacgggctggccggcccgagaaggcggcccaaggcgcgcgcgcgggcggggaggagagagagggagccggtgggccgggtccatcccgcgtagtcccgagtgggacccgcttgtcggcggctcggctcgccgtgagcaaggtgcacgcggggcgtgctagggtttgggaaggggaggcgcggcgcacgcgcggttcgcggaggacgcggtgcgcggcgggcccacgcgcagcctcacggctcaccgtggaccatgcgcatggggagggtggaacggagggagtggctgactgggtcagccgatccggtcgtgccgaggtggcaccgacgtggcgcctacgtggctgccacgcgggccggctggaggaagacgaaggcgccggccgcgaatggacggcgggcgacggcggtttctccgggacgccgtgcgacgacgaggggcgacggggtgtacaccggaatgacgagggagaatgagagggagcgagccaacggctcggattcgccggagggagttcgacggcggcggattgcggtggcggcaaccggcggcgagaaaagggggaaacggcgacgaggtcatgaggggctgattcccggcggtgagagcatctacgcagctaaggtaaagcattcctagcaccggattaggaggaaacacgccgtgggaggtcggcgacgagaggttgctaccggactcgggcggcgacgccggcgagtccactgcgagcgacgacagcagtcggggcggcgccagtttgctacggggaggctacacatgctactaaccgagtctaaggggaggaggtgggacgaggagggagaacggggaggatgcactaccgctgcagaggagggcgctgtgacgagaggccgacggcacgggagtgatctctccggcctcgggccggggaagaggaagaagacgagcgcccggagtccccttccgcgtcctagcgcgcaccggctcctctggcacacgcgacgacggcggtcggtgatagagagacagaggggacggcaatggcgcggtggagcgagggagaatgggggagggaaaggaagggagggcgccttggtttaataggagggcaatgtcggtttgggaaccgacctagggcggtcaaggagcgagttggagctcagcggtcgcggccaaaacggcgacagagggcatgacaccggcagaagaagagaaaagggaaaaaggaaggaagaaagggggcttgccccttgtcgctttgggaaaaggaggagggagagggggggtgacgcggcagagggaggaggagctctgcctccgtcccttggaagctagcgcgcggtggtggcggggccgggtcgatgacgacggcgatgacggcggaccggtttggagcggagcggcgacacgggcggcagacacggggcaggcgcggcaggtgctgacggcggtggcgactggccggtcggccaccacggcgcgcgcgcgcgggaggcaacggggcgacatgacgatttggacggcgttggcgggaagcggcagcgagggcggagggcgctcggctcggcgccggctcgcgcgcacgcgcgcgcacgcggcgtacgagcagagcgagggaggggagagccgagggagaggcgctcggcgcggcgtggctcacgcgcacgcgcgcgcggcgcacgggcagagcgagggagagagggagagggagagagagggagagagagagggagggagagagagatgggccgagaggaaatcggcccaccgaacctgagggaggcaaaatggacttttgcggaggaattgaattgggaaggaaaattgagattagggtttggatttagcgatggatcggggattcgagatccggaatggcacggagactaactgcaagcgaagaaataattttcgcaattagggtttttagaatttaaattttcccgctaggcgccacgacggaacgggcgctacaactagtgagtgcaattaattgtcaaacttatgtaatatacatttttgcaaagcaacatctgagctagacatttattgagtgagatccttatatgtagacatttaatttggtgaatttcatccaaatatatattagtgaaaaatatttttgtttctatttatcaaaaaattgtgatattaaattcttaattacctactcttcttttgctcaaacgggcataatgtatgtcgagtgtctagatttcaggtgactgaaatttcagtcacttttatcatcctttaaatatatagcatgccaagagttgtcacttccactattactcatgcaaacaaagtcgtttctttcctgttgaacggtaaattttataagtagatacgaaataaatttacaataaaaaaacaaaattacatgtaaaattattcaaacatagataaatttgtcccgactttttagggtttgcaattttattgctgttttttcttaaatgaagcaaagttttgccattggtttggcctgctgttttgatggtgttaattcaatggcgaaaaggcatatatatccttggttgttgtttgccactactttttttcatctctagtgatttcgtccctattctgttttgaatgatatgaagtaagattgtgttaaataattcaaatatgagcatttttttacttttgccaaaaaaaatgacaaatactaccacaagtaaaattttgatggtacttgaattgaattttgttaaaattttgatagaatgtgctcaatttataggatttcctacatcgaaccctccccgtcatctcatccgcccctccgccacttcttcccccgctcaccgttgctattgctgtgaccgtcgtggaggaggccttcaaggcgctgaagaggaccaaggacctcctcgcaaccttctcccaccttgaggccatcctgccaccgttcaacaagtgcctcacatgcctcaagctgccccgacccatcccacgtccttgccatcgccctccactccctcaagacaacccccaactccatcgctgtctcgctcgccatggccctccacctcgtcgggtcttcctccttcaacctcccgttttcacattggcctcttcttcttttcacgctccctccgctgtctcgctcgccatggccctccatctcgtcgggtcttcctcctacctcccatttttacattagcctattcttcttttcacgctccctccacctcctgtccctgctccttccctccaaagatgttgtcgcctttgaggaagaaggcgatcattatgctaaagtgctgcggggaggcggcaggaagaggagagtgctagggggagggattgaggatgagctgaggccggtggccgtgaggtggtacggtgctggcatgaacatggtcttgccttatgctaccgagccacctgccttctttcacacatccagcaacgtcggtacattgaaaccaccctctccgctgcattgcatgattctcgcgtgctgaggtgctaaaaacactgtggccgccagcctcacatagttgcatcgatgcaccggaatgacgaatccacccccgccacaacggcatgcctcaacgcactggaatgccgccgccgtgcccgccgcgtggtcttgccggattagccgttgcctgcctaggggttttatggtgaaagctgtggcagggaacacaacgggatggttggggtaaccttttcttttactacaagggtagaagagtaaacctatatttcataaatcatttttctattttcgttcctatttatttaactcaatttcgtgggacatacctaacaactgtctaaagtgttggcaaatgtcttcttcgttttcagaaaacggtgtaaattacaaaccttaaaaagtgagggcaaagcaacaatggaggttcaaagcagaggcatggacacaattgtcccttgattaaaaaaaatgtaaaaccatatacataatgataactttgtagttaaaatagaccaaaattgtacattgcatagttttgcaaacatagtttagcttagccatatgaaactttaggtgacggaaaatttataaaatttcagacgcctaaaatgtaacaaatcccttttagggaaaacaatattgcaaattaagaactctttaaaaactaatagcatggatcaatatatagccgaaatgttttctaatttacctgaagaaaattcggttactttctttttctctctgccttgccgaggtaactgcaaatacacacgagacaaatggtgcgagaaaatgagtaaaaaaaaaaaaagaaaaaaccggggtgttttgcgtaaaagtctcactgaagaacagttactgacaagctgacgaagaacgcgtcaggtcactggagagcatcgctacctcgccgcttgtccgcattttccgccttcagcgagcagccgccttcaatccaatccccaaaccctaattccccatttccgatctcgcagccgcgcgccgccgggagatctcagctctgatccattccatccacgccgccgtcgcgcgcgcgcgccagccgccatgtcgctgagccgaccgctcgccgccgccgccgccgccaccgtgcccgacgagctccatctggagatcatggtgcgcctccctgcgcttccccaggcgctcgcccgcgcctccgccgtgtgcccggagtggcgccgcgtcgtgcgcgacgcggccttcctccgccgccaccgcgagctccacggcggggtgcccgccacggcggggttcttccacaacaccgtcgtcttcggcggcgcgcccggcggcgcccgcttcgtctgcgccggcgccggccccctcgccctgtccgttccgccgtcggtaagccgccagggtgtcccctgctgccacacccacgtaaaccccggcgacgcatggacggtgctcgactgccgcggcggccgcgtcctgctcggctgctgcagattctcctgctacttcctcgtctacaaccccatcaccggcaagcgctgcctcgtcaaggcggcatcccataaacgactccatctccatcactccatccgatgcaacgccacgctgatctgcgacgacgacgacgccgacgccgacgggccgttccgcgtggccgccgtgtacaccaccgtcaccgacggcggccgcctgttcggcgcggcgttcttgtcgcgcaccggcaggtggaccacggcgccgcaggtgttcgtcgacctgccgcggggcatcgacctccgcggcgagccgtccgccgtggtggggagcacggcgtacctctcggcgtacagctacctcgtcctcgcgttcgacgtcgagcactggacgatggccacgttccagcggccgccgcgctgcggcaacgcccggctgatgaagacgcgcggcgacggcgtgctcggcctcgtcggggcgctggagctcaccgtccggctgtgggcgcgggaggccggaggctgggtgctgcgtagcaccgttgagctctccgacatggggcttcttcgtgatctcccatcggcaccgttgcccaggtctgaaaaaaaccaatgggttctttgatattttgttggaaatttcgtgaaattggcaaacttttagttgttttgttaccttgataaagaaatctcttttgctaaaaatttgggaacttttgaatatgtgctatgttataaacttattataactgtgaatctgaaattaagaaccactgtactgtatgtttttgtccattggcagacacaggaaatataccgtccattgtgtttagtgggatagagttaagggacttgaggtagttagctattggattagaattgggtgagccagcaataaaaaaataaatttgttgacaaaagaattagaatgaagtattagatcgaacgaaatatatacatgtgtgatatacctatatatattaattttatttcacaaatttttgggtattcttcctagaaatacccgggaacccctgtgtctgccactgtttttctctttgtttgtgtatatatgtatagctagtatagccccaaatcgagccaaagaaaaaaaaaagtatagtaaccccagattggttgagtttaacttcaatcatgtgatccgggtatctgacaatggcattgttgttgattgcctagctctgatgctcggttcccgctgttgccaccggtgaagatcatcggcgtcgctgaggagggcgacgcagtgttcctttggacgatgctcgggatctttatgttctgtccaggatccatggagcttaagaaggtctgtgaagaaactcgagatattgagatggtgcacccatacgcatccttctatgtcccaactcgcaactcccgcaggtatatatgtttatatattatccttgctttctaccattcaaacataatgttttatggattatttatacaaaattctccatttcatttctgaagcgcgcacaaagcagttaagaatttgtatttgtttgcattcaactgaacccatataatcatatcattactaatgctataatcttgaaatccattttaccttcagtatgttcacacaatttggattattgcagttaacttattggaaatgcctaaagtaactgttaaatatatatgttctgggatgtcaaaggaacatatagaaatgtacaggatttatcagaaatcaattaggaacataatatatagtgataatactagctttttgtatgaatcagtagcacatgtgaattattgttatttagctgaaccttttagctttctgtgcggttatgcttcaatcattgtccgttgagccatttttacattaatttagagattactataagatacatgtggccattctgtttcagaaatagttattttatttgctgtaaatatgtaacaaaacttagctcaatggtacttttgggactcagttaatctgatctaggaatatgaatgtacataaaactcccttgcaaataagaaaacatataaaaccgtatttgttaaagcatattgcgactgcaatatatatgaatattccattatttactgtttgtgggagttttaccctactgaaaaagtttgctgtagctcgagtaacatgtgtcgtctgatagaacatccttgacaaagtttctgcagaattaaatataactgtatagttttaattaaattgcttgttgagtgcaacatatatactgatcacactatttctcatcacttcttttcagaaggcagtgaagaaacagcaaaacagggttgacatgctacaacaaatgtcgctgaagattaatgatgaaggtgcaatggagtttttagggattggatgccttgtgattttttgcttcgttaaatttgaacctgtttgatacaaataatacatgtaatatgtttgttgcaatgactttgtactcgttgtactctcttagatgatttttgttgttcaatgactgcatgcgtaacttctgttgtgagactcatgtatgaaatcaaggtggatttttggacgcatgaaaatctggttattgcatctcatctagcttatttttcctattgatttccaattcagcctctatgatctatgttggttaaagtatatcaaagttatcttcatgatattttttttccactaccattcattacttcacttttttttttcactgcagactccttttttaaaaaaatcttgtggattatattgtttttaatggatggaggcaaaagattttggttcatctgtgaatatatagatactgaaccaacattgaacttcctacatgcatatggcttgatatatagagtgaacacgtatagtaattaattaccttcaaaaatatgcacagaaaagataactagcactggtggagaaaccatctttggtcggtcggccaaaatacacaatagtcccggttgcaataaaaaccgggactaaagatatctttagtcccggttcaaaaggatagagtttttttttatctttagtcccggttggtaacacca

SEQ ID NO: 33248 - DNA, 14986 bp, Oryza sativa
  unsure (1)..(14986): unsure at all n locations
cctgcagcccttctatctcctccctggccttatctcttcctccatatctcttcctcttcttcctcctctccttttgggttctctcctccttttcctctttctcctctaccagcgccggcgggcggagggcctggcggccggcggcgcggaggcccgggcggcctcgtgggcagcgcggtggccgggcggcgcagcggcccaggcggcctcgcgggcagcgcggtggccgagcggtgctgcggcccgggtggcgcggtggttgggggcggcgcggcgttgggcggtgcggtggcgggcggtgcggcgaagggccaggcggcctcgcggcgggcggcgctccggcggccggcggctggcggccggcgcggcagtggcaacgggctttttttttcttcttctttttagaatttgtgattcagatctgtgtatttgatttgtgtgtgatgtgaatgtgatgtatctatgatgaattttgtaaaatttgtgatgtatctgtgatgtatcgatttggggagttgaggatttggggataatttatttgggattttgggaaggggatggggtgaaatcaatataatgaagaaaagaaaataataatggagcaaccggatctagctagtctagctctaccaaccgggactaaaaaggctctatctttagtcccggttggtaacaccaaccgggactaaaaatggatttttactcccggttttttcacccgggactaaagatagtgatctttagtcccggattggtagtcccgatttgaaaaccgggactataggggggttacgaaccaggagtaaagcccctttctccaccagtgtagatttctcccatcagtacgtgaagttgtcaattgttcaaatttcgtacaacatagtacgtatatgtatcatgtttaattgttatttacgttttgtatattcattgcactgctcctttgtttgatgtggtgccaccctactgtttccctactatatcttgtgaaatatgatggctgatggcagcaacaagatgatgatggtgtaaacatggcgctgcaaaacagtagcatttatctgccacagctgtgttatcttggatagaaaagttgcagaggtttcgaaggatgccttccatccataactatatatatatgataaaccatgaaggtatgtttcaaaggcatggaacccatgcgcatgacaacgcttcctatttgatgttgtggtgtatagtgtgttccatatctccctttaatcaatttcacatatatacaacatgtctgtacattttatcaattataggttcccttgaattgtggaaagcaaggaagattgtgctagggcgagctgactgctcagacaagtcacaagtaagatcttcaagtccaagtttagctagagagatcccaaaaacgtttttttaatacgcaggagagctacttatcattatattaaggagaagaaagaagaggataagaacccttacaacacacacaatagaccttacacgagaccaaaagacaacttcaacctattacaagcaaacactatttactgttcggcatgaggacaagaatgcccttaggcccggccaaaccctattcatacaactcttctcttgcaaacagcaagtcttcagctatgttaggagaagtaccatcgaagacacaaccgtgttggcatgagggctaccaacaatcgactctaagtgtcgagaagatggaatgaaagctggttttatgttgttttgagagtgccccttgagttttttaggttcaaggtgcctagaaaaaaaagctgacaatttagataaactttgtgttgggaaaagttgttttattctacgttgtcttgccagaacatgaatagtggagcagagaatgagatgtcattctcatctcgagaaatagtccccttcagaggaatatatgtatatatacacacacatacatacatacatgtatggggtgctttcttttgtttgtgctttcttttgtttttccattctgtttctcatcgaatcatttctattaatgaaaatgaagctgtgccctttgctaaaaaaaagtttcccaacattcataaatctccaagcaattaaacggataatttttttaaggcataggcagcttccaaaacttcttgcaaattaaagtggtaagcaaccatatgcagaagaaccagtactatctggagcaaagtcctagagctaaataatgagaaccatccattattcacatttctcgtaataccaagtaatagtatgtcacattaattcttctgtttagcacaaattgtacaaaattaactaaacgatgaacagtcctagctaacaggtaatcacgtgcattatcagttcatcacagaaaccgagaggccaagacggtctgttactcatggacgtagatggaattgaaccaaactctggtgtacatgagaaagtttctcttttttaatatatcgttcctcttcgtctgttccaaatgaactctatagattcttctgttatttgtttgtccttctatctccaaatctaatttgaaattgctacatcaaccaactgtggcgttgtcttggtttaagaagtgtaactcatggcttctgcatatagctagaaatgaacacaaacattatacaaaatcggcagaggaaaagaaggtatgtgaaaaagaaaaagactgcctactctacatttgatagaaaattccctctaaaattttaggaatattgagccattaattggattgttttgattcgttggagaagttaggaataattcccctgtgccctcttcttcttccctacgccgttgccgccgccggagatcaacgagatcatcggagcgggaggtaaggtaaaggtgttgactattgaagggtccaaaatctgcaagacactgagggggcaaggagggatttttttgttgaatgaaggttattactccctccgtattttaatatatgacgccgttaacttttcgaacaacatttgactattcatcttattcaaaatttttatgtaaatataaaaatatttatgtcatgcttaaaaaatatttgataataacataaagtcacgataaaataaatgataattacataaattttttgaataagacgaatggtcaaacgttaataaaaagtcaatggcgtcatacattaaaatacgaatggagtatcaactagcaggaaaagaaacccatgtattaccatgcaaggacataatggaaagcaacggatgaaccaaagctaaagaattcttgaatggctgctagcttctccatcaaaagaggccaacagatgaaagcctagtacacgactcaagcgaaaatgttcagttaaattattgtcctcttaatttctgtcacggtgtcacttcacatcaaatcataaaacgcatactcttcaacgggtaatgcttttatatttccatatggatcgagatcgatcggcagtacaggttcattcattctccaaagtccagcgttcatcaatggccatcttcatcggatgcatctgttcacttgcactcttgctgctctgctcccatgtcttccagcttctctcagacgctcgccgccgtcttccaccgggcccgaggccgcttccggtcatcggcaacctcctcgacgtcgccggtgagctcccgcaccgctcgttggcgtgcgtcgccgagcggtacggcccgctggtgacgctccgcctgggcacgatgctcgccgtcgtggcctcctcgccggccacggcgcgcgacgtcctgcacaggcacggcgccagcatcaccgaccggggcacgccggacgcgtggagcaccgacgggcacgacggcaactccatcttcgcgttcccgacgcgccaccaccggtggcgcgcgctgcgccggctcggcgccgagcagctgttctcgccacggcgggtcgaggagcagcgcccgctgcgccgagacgccgtgcgcggcctcctccgccacgtggcggagctggctgcggcgtccggcggaggcggcgcggcggtggtcgacgtcgggagggcggcgttcgcggccatggcgagcctactgttcggggcgctgttctcggcgggcatcgacgccgcgacgtcgtgccggttccgcgacgcggcgcgggagttcgcgctgctgacgatgacgcccaacgtgtcggagttcttcccggtggtggccatggccgatctgcagggcctgcggcgaaggacggcgaggcacatcacgtggatgtaccaactgatcgacggccatgtcgaacggcggatgcgtggccgggaaacggccggtggctgcggcgccgcgcacggggagaaggagaaggacctgcttgatgtgatgctggacatgtcggagaaagaggagcagaatgacgacagcagcctcaccatgaaccggggtgtgataagagcatttatggccgtaagtatatgtatcctatatatctcagttttttaccagattatacagtttacttttaattatattttgactgtatgccatattttgaaattttagtataaatattctaaaatataaatcatatctaaaatttctttaatacataattaacatgtcataataaaataatatttatttatttttaataaaacgaatggttaaatatcatataaaaaggtagccacatcatctattttaaaaaaggagtataggtttgttaaggatgtttttccaattactttacaactttataatagttaatctgttcgattattgtatcttaacatattataaaaagttggataattcatcaccctttcagaacagaaaaaccacgcccaaaagtaacttttctcaccgcatgcacatatgttttacaaagaggcaaaaaaatgctactgagcaataaacaacgtgattgttatagaagatagtaataatcatggcatgacagtttgtggctacttttcattaattagacttcgtagtcactaaaacataatgggtggacggaagcccagtgaccacggctagagttatctctaacaaagttattttccaaaattttttacaactatttaggtacatgaaaaataaagattgaaggagcgaaaacactttagaacaaactatattttatgcataaggtgatttctataatcatctgcctaggtttttgttaggctttaaatattttctctgggttggtctgtttgcacgtgggtgtgttttcaatataagtttggtggtatttacacatttatttaaaggcaaattttacgggaggacatcacgtacggctcctaagtggttttagcttttggacactaaaagttgatctttgggaaagatactttcaaagtatggttatttactactagggacatcatgttggttaaaatattcatttttattaaataaaagagagataaatagtatgaaaggacaaatgtactagctagcgaaatgaccaaggccggtggcatatttgtcctttcgcactatttttgctctcctattcaatcgaaaatgaatattttgattaatgtacgtggtgttcagtagcaaataaccatatattttaagattgaattctgtaaagattgactttttggttaagatattcgatttatctaaattacttacattgcttaaccaatttcaggatttactaatggcgggcagtgaaacaagctcagctgtaatagagtgggcaatggccgagctactgcagaatcctcaaactatgacaaaattacaagaagagctcaaaaaggtcattggctcaaaaacttgcatagatgaagaagacatcgaccaacttccctatcttcaagcagtcatcaaggaaacacacaggctacatccagccataccactgctaatgtacaaagcagccgtcccagttgaaatacaagggtataaaatccccaaagaaaccactgtgatagtaaatacatgggcaattcatcagaattcagaggtttggattgaaccagacaagtttataccagagagattcctacaaaaggagatcagtttgtcatcaggtagtaccaacatggaacttattccattcagtgccggacgacgtttctgcctcggatatccggtagcaaatagaatgctgcatgttatgcttgcctcgctagttcatcagtttcagtggacactgcctgaagtagtgaagaagaacggtggcgtagacatggcagaaaagtttggaataacactgtctatggcgacccccctacatgctatagcaaagaatattgtgtaatgtgtaatttgtgtaatgtattcccgaataaaatgtgtcatttatcctaaaatataagacggatttataaaaagtatctgaaattaaatagggaatgattgtgattggtttaagacactactacaggattgattttcctggacgcccccccttttgtttacatgcggtccgtaagtggaactacacgaaaaaatagggggaccagcgctgggctgtcgcccgcacgggaaaatcgattttcccgtgtggacgtcctaatccaaccgcacgggataatcctccgtcctttccctctcacccacttcaaaattttcccatctctctcttcctttttcccttttattctccctcaaccactcccctctctctctctctaccttatctcttccttttactcctctcccagccacacacccggccggcttcccacctcctcccccacaccttcctggccggcttcccctcctcctccccctcccctcctcccattcccctctgttgggccggcgatggcggcggcctgggcgacggcggtggccgggcgcggcggcgagtagcgaggcggcagtagcggcggcggccaggcttcccctcctcttggtcgtcgtcctcgttgtgcgctcggctacgtcaaggcaaggcaaggcaacagacgtcgtgcgctccggcaaggcaaggcaaggttccgtcgtgcgctcgtcgtcctcctcctagtcatcacgtgcatcgtcaaggcagcggatctggcggcggtggcggccggcacaactatggcggcggcgggcgggctcaacagcgacgacgatggcgggctcggcggcggccgggtgggtgcggtccggcggccggcggcgattttcttgtttttttttatttttggttttttttccgtacgggtggtataacacgaccgcacgggataatcgattatcctgtgcggtcggcccacccgcacgtgaaaataatgattttcacagacacctgggtgcaaataggccggaccaccgcacgaaaaaatcttgtctgtagtagtgagatgaaaaaaagtaagttgagaaattaaatagtatataattgggattagttaagatgagaaaataggtggagaagtaattatatttttaaactaatagataatattattacttttatggctaccgctactgctatactactatgacgacaaacgaatactaccaatgccgccattgctgcaataacctaccattacctaccaccaccaccatcacaccactactaggacccatgatcaacctagtacaacaacaacaatttccactattatttgtgtagatattatagtaacacactgataaccttgaacttaaagtccatccaaataatgcaagtttaatttgcaatctcattccattaggcaacaagacaatattagtgtagttctttcgaagctagcatacggacagaagagagagcaccagccacagatggattgattgggctttagatgggctaatgacagtgaactactgtagacgaggccaatagcatggagtgagaactatagtactacatatagttaaggaacaaacagataacatcaggagcttttgtaaggttcatgtgtatcctaggtatatatatgtttgatttcaacataaagtgggaaatgatgagatgttattgtcttgtatttggttggaaggtcgttgggataggccttatttgattggagagaaaaggatggatgggatgattgaagggatttttctttgatgagccttgggtggacgcgcggatgggatgagtcatactcatatgtcctgcatttcatcatcacatgacaaacacccatccatcaccaatgggctcaggagcttaccccaattttttttcaaacaaatgtgatttaatatgtttggtatatgtgtacccagccggttagttatcaaaacaatcatttgtaagtacaaaattatctttttcaagattattatcattctttttcccttagatgttttataatttttctataataatgatttttgtttgagctaataacacatactagcacttcaatatttttgtcattggataattcttgcttcagtaactctgcatctctcgctgaaatcctgcgtccgctactgaatcggagccaagcctgtgcggcccagctcgtcacaacgcttgaagatgatgaacctcgtgacgcgaaactcgtacgtcacgaggagaaggctgctggaggcgtaggttgaggcgtcaaggtcggaggcagcagcgatcgacatgtcatggtccagtaaacataaattgatggatggatgtgaggtatcgtactatcctacaaaaccaaaataacagaaacgatactgatcttatcctactatagaaagggtttttgcgtgtggaccgaaaagcatcttcctgtgcggaaggccggcacgcccgcccgagaaggtctgcgataatcaaattttcgcatgcgattgacccaaccgcacgggaagatgtattatcccgtgcggcactatatacaataacctaggcgtttgggagtatctcgtcctatctcaaccggtagcaataccggattatcaaatggtacgcgttctacatatcagggttgtcattagtcgcacgaattaagaaatcacattatgatataaataagaaagtagaatgcacacattcacataaaatatgtaatagacatatacacatacacacatatatatataattattgtcttggaatttacaataattcaaaaccaaatacaatttatgtctctaaattgttttttcacgtaaattctttctcccactctcttaggcgtttgaaagcgtcattctttgcaaggtcgctctccggatcgtagaattcgcccaaatggttacaaacatcgtggcggatgtaacgacaaatatctgcacacaagttgagaatggttttttttgtcgaacaggtttgctacccatggaattgacatgatctgtttaagaaaaatacatattgaaagttagggaaattaaattattgaatatgttaatgtgtacacgatattttctagactcatatctgcaaactctattgtgtacctcccattaatttgaagcatctcgcacatgtagtatccacataagttagtgcctggtggttgcttgcaacactgtgttgaaaattctgtatacgtcaatatttcaatctaacaagtataaaaaatgttactatagcggacataccattcattaccggccatcgtgtcttcacgagaagcttactcttactggcatcctttactcgtccgctttggtctttgtaatacttgtgtgctctatgtagccaaaaattttgtttgagtcaattgtgagtacaagagccaatagttattgcgtagtgtataacaatacttacaagttcaacaacacaaggaattccgtgaatgtcttctcggcataatgtgccggatcaagcacgacgaccaagtggtcccacggatatactagaaatagtatgtagtggtcgctgcagagaattacaggtgatgttgtattatggaaacagtagtatggaagtaacacttacggcaaagtggaagggaccattagggcatttttgtcttggtgcgtgagcatcgctttccccaagtacattgctacctagaccctctttttcttgtgcaattgattgatgaacgcttttttctcctccgctgttctcacctagtattctaattttcgtaatattcgattaattattatactattcatttttacacaatcctacgaaatcttagatagtatcctgatactacgatcccaccaaatattatttaaaataaggtggattgaaaataatgtgaacaaatatgcttaagtttacataaagaccaattatatttatcaaaattaatattatatgctttgatttatacaatataaatatgtactttcgataatctgatagtatcttgatcgtatggtactattccgatactatgatactacaaatcggaaaacaatcatacctagtatctcgatactgattagcttgctctgtaggcataatagggcagtttgcaacaaagccaacaagggatcaattgtggctcgcgcttgggctggctggccgtatcacgcgtgagcaagaggaaggtaacaacctcaaagttgtgaatttaaagttggaaaattaaaaattttaaatattttttttatctttggatgatttttcttgtttctttaaatattatagttgccagtgccaaaccaaatgaatgcaattaagatttagaaattaaaatttataaagtgaaatcctcttaagaaaatccttttacagttaccgctaccaccactactacgacaacaaacgaatactaccaatgccaccattactaacagagcctaccattactttcgacggggatacccatgaaccgttttctgagagtattggggtacattgatacgaggatctacatgatacgacatcaagcacacaaaaaagcaaggattataccggttcagacatctcgtaaggtaatagctctaatccagtttatatgggattatagagaaaactacagagtataaaagagaacaactgaatttcgagattactgacgagatccttgttaagaagtactcgtgacgagatctatcacgagcaggcttcaagttcttcagattgcttgtggtggcgagtgtcttatactaagattagatgccctgtacctcccgggggggtattgtcgacgtttgatgtcgcgattccggtatttgcatagtatatggatcgttggtactagggtatatgcgagactgaggtaaaagagacggagacgaggatttttatataggttcgggcccctgaattgtcagttaataaccttacatcctgttagccaaagacggtcgttgctcttattcatcataatcacaccagtacaatatttggggtagcctatctaattgttgtcgacatggtggtctgaaggtctgacttgtagtcgataacagggtagtcttccttctcgagttcgtgcccggcgagatcaaagacagcgctagatccctatagccggcctctgtaggtaccggatagggtcgatccaggcatatctctgatgtcgatatccggcggcttgtcttggcgtatgtaagcttgtatgttgatcttctgtcttgatctatgttccgtgtcgtctatggtgggtatgtcccctctcctcatagggggtcttgtatttatacccataggtgtccctttgttcaagtagaactagggaaaccaatatggatacaatccgagtagtccttgtcgtttccatgtagaactctggttgtctttccttatccggaactcctcctatatctgcaggttgtctccgtatagaacatggtatgtggtgggtcctgccgagatttagtcaactactattaggtatgtggtatccataaccctgacagtagcccccgactttaatgcaaatgagcgagttcatattctcaactgcagaccttggagtaactgttatcgagctcacgtgaccgttctcggtgagttcagagataatgttagacttcctttattagcctcgtacgggcacctaaagggtttgtctgagtcaatctccgacgtcaaccaagaaagtacagagcatacaattaagtctcccgtcttgctgtaatcgagaatttggattgaagtcaagaaattttatctcggcgggtacaccatcttttcattccgtattccttgccgagatccaccaacctttctcgaatgatcgagaaggcgtaaaatctgcaacgaagtcttgtcaacatttgtcgtactcgccttagtcgattttggtgtagaacaatagatacatgaagtcttcgataatgtcaaatagaattttcctgaaatcaatactcagataagaatattagatagaaatagccccccgagcgaacgctcaaagggtgacatgttataatatgtatggaaaactgaaaatgaattaaacttacagaccaatgttttgtatatgagcgtctactcttttatcgacttcgatcagtcagtttgttcagttatacacttctccctagcccgcagccttgtcgtcggagaatcgttcttggaggataaggctcttggacctttgacctgcctcgtttgaacaagcactgatcctagcccccagccgtgaagttggaaaacccaatttccgattacacggcttggttaatacgcacgacgagaactcttacacgaccagatcttacatggtctttcgtctctaaaggatccgacaaggccttatccactctgggcgtccccagccgaagttcccttaggttcctcagaggccttgtcaagacggcgtaaagggacattaggataggtttcaatgctaggtgtctttgtggtaagggatctctaggtaaaacacttggcgatattgtgtacttgatatcaactttgttgaagtagaggtaatgggagaatcgctacacctctggtcaagaaccaggtagtagtcgtaactcaaccactagaagtaaatgtacgagagatcgctacgattgactggttgagaaccagtgagtaggtgtctctcgatcatttgaagtcgtggtaagaggaccgctgcattattgctgtagtcgtatctcgaccatctgaggttgcggtgtgagagattgctacgtactggttcgaggaccagcgaacgtgtagaatcatatctcaaacaccaatggagattgcggtgcgagagattgctacgtactggttcgaggaccagcgaacgtgtagaatcatatctcgaacaccaatggagattgcggtgcgagagattgctacgtactggttcgaggaccagcgagcgagtacaatcatctctcgaacaccaatggagcttgcggtgcgggagattcctacgtactggttcaagaaccagcgagcgagtagaatcatctctcgaacaccaatggaagttgcggtgcgagagattgccacgtactggttcgagaaccagcgagcgagtagaatcatctcccgaacaccaatggaggtttgcggtgcgggagattgctacgtactggttcgaggaccagcgagcgagtagaatcatctcccgaacaccattggaggtttgcggtgcgggagattgctacgtactggttcgaggaccagcgaacgtgtagaatcatctctcgaacacgaaccagcgagcgagtagaatcatctctcgaacaccaatggaggctgcggtgcgggagattgctacgtactggttccagaaccagcgagcgagtagaatcatctcctgaacaccaatagaagtttgcggtgcgagagattgctacgtactggttcgagaaccagcgagcgagtagaatcatctcccgaacaccaatggaagtttgtggtgcaggagattgctacgtactggttcgagaaccagctagcgagtagaatcatctcccgaacaccaatggaagtttgctacgtactggttcgagaaccagcgagtgagtagaatcatctctcgaacatcaatggaagcgctatagttggtttattacatgtgcatctcatgtggccaacatgacttacacacccaacttgtagcatatccggatgtccgttcgcaatcatgtcgggtgatcaagccgacagcgttcgcgaggaattatccgttaacaaccttttctcgagtagtccagccatggccggtgctgtgagataggttgtcggtcttcgttggcaggttgggcgcgacgactctgcattcgtcgagatcgttctcgataatgcggtgtacttgaccacaacctactcgagtgctcaattgttcctgaaaaatattttctagaaggcaagacatatagcagataatatcgagtatgtattcgaaaaactgcatggatcttctagtattatcaggatataacgagcagatgtaaatatcaggtattatgtaaaccgtaaacaaacatgattcatacagaagagaatagagcaagcccccagcgttagaccgtagtcgatttaacatcggggacactcacgcaatagatattatataaaaacatgctctaggtaaacataataaattataaatctgacaatgctgtataagtctaaaaaaataggtacgataaatttatataaaatattgcgtacctgtgtagatatatgccggatatatatatgaaattagtagattaattagattaatctaatctactaattaccttgttagtggtctactacacactgcagaagacacatgtatgcagtaaacttagacttgattgtttgttggtcttgtggagcatgatgacccgtcatatgctcgcacgcgtgtgcatatgcacgtgacgtgattagggaaataccctctgttgatcatctccgattagaacacagtaatacaaaggcataggtactcgaacgagtccccgtgcagtatgtagcattgcactgtgctcggctcggacacggcgtcgtgttcggcctgggctgctgatgcttttgcaccagccataccagccgatgtcgtgggcggagaacttgatcagcaactctgcacgaaggaagatggagcactgattgatcccgatccagaacaggctcatatcaaatcgattccgtatgcagcgaatattgttgattctctgcggcgacgatttcctgnnnnnnnnnnnnnnnnnnnnnnnnnnnnnnnnnnnnnnnnnnnnnnnnnnnnnnnnnnnnnnnnnnnnnnnnn

SEQ ID NO: 33249 - DNA, 734 bp, Oryza sativa
ccaaagacaaggatggagatttaaaatggtttgcttttattttaattgattaaatgaactttgtaactttaaaattatgtcttgagctctgaaaattcgtggaaaaatccagagagtacattagggcacagagaatattacaaaatattttcggccatgatttttaaaggaaatttttaattccctcactatgtcacttgattaaattgatttaatttttaatataatttctggaaatgcattattaattgatttttaatcccgaccgaaaattggggcgttataatgtttcattggtcgtaattatccaactaaaatgcgactgaatggtgggttgtgggtgcatggttttgctagtcgcacctatagcaattaaggaccagttcacgggaaaccctggaagacatacaacgcttaccacaagcgggagtgggtaattgcttgatctgtagtatagctcgaccctgttgatgaccaaatttggtaaatcatgcatcaaattcaaagctaaagtcgaagcggatttgataggagatcgtttctcataaacagagtacgtgtcggctacgggggcacgtcggctaacgtctgcatcggctgacattggatcggacaaagaactgagcttctataatatgatcaaagttgtttgcacttgattttggcccaaagttttttacataagatcaagtgaacacaacttttgggcaaaatgtatatgctcaatcagctat

SEQ ID NO: 33250 - DNA, 586 bp, Oryza sativa
  unsure (1)..(586): unsure at all n locations
gagcggaacaagggttttcatcaaaagaaatccggagcagtttcattcgatttgttgtggattggatgatggaaaaactagcaagcagcaagcgtaggctatgttgccgtagcgcgccctacggagttgtacaaagtcagcaaccattttggggcgcaagcataggcaacacaggactgatgacggggtggggcgcgcagtgaactggttttctaaaaagattggaagatccggccaaagaaggtgatagccctgttcatttgttcccatggttcgatccttcccagtaaaacgcggcgtgttcgaatgatgatcgcttttacgcgagaaannnnnnnnnnnnnnnnnnnnnnnnnnnnnnnnnnnnnnnnnnnnnnnnnnnnnnnnnnnnnnnnnnnnnnnnnnnnnnnnnaatcggggagtgcaatagagaacttgagatccgatgcgaacaatcactcgaaggagcgaagcgcgggcgcactcactctaacggcgtacctttcgcatgatgggtcagcgaggaaatgggaacagcggcttaaccattaggtgtaagccctttccagaggtggaagatttacgt

SEQ ID NO: 33251 - DNA, 1191 bp, Oryza sativa
caatagatgttctgaagcttaattatcatcattacattgtagaatcaggatgttaagggagagatcaagacagtccttggtgaagatctcgtaaatgacgggcgatttctgcccgcagtgagctataaacaaacatgaataccaactctatggaacaaattaagagtttttggttctctcaactggcatcgtttaattccattgtactgatcagctacacttaacagaaaaaatatagaggcctgtttagatgggactaaaacttttaagtccctatcacatcggatgtttgaaaattaattataaatattaaacgtagactattaataaaactcatccatgatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctgaattggttgcttgaggcacggcatagcgtggctctgactgtgaatggccgtctttgcatcaagctgcaggtggcatcactaggcaaggaagccatcgagaacacctgcaggcaaggaaatccagattactctttgatctctctagctcagatgcagtggtttcctgaaacctccaaagcctattgcttgagacagataggtaatagaaaggacattcaggaaatattcttcatgtattctctgtagtttgcacaccagagtctatgactacaagtctgcaaactcttagggcaacgatgaatttgtggacgaagttatgttttagctagcagtgtttcaatggcatccaagcaagggtggaactagagtatatgagaggggtgcctaggaagtaggaacccgattaagaaattttttaactatacattacttattttcactatatgtgtacccttttaaataaaaacttagagaaccgcatcagttaaactcgatttaaaatatagtaaattaagcgagtggcacgccctccatttcattccagctatgccctgcatccacgtgctaaaggtatatatgaacctatttattgtcatgtgtgtaatgtatcagtagca

SEQ ID NO: 33252 - DNA, 6927 bp, Oryza sativa
cagttccaggaggaagtgcatggccggtgacttctccattgttgcctagttggcttcttgaactgaactcttgtttgttgcttcttcactttcttggtggttttggtgagaggaaaaatccatgtaggaaggttatataggaaaccttgttgatgtatgttgttttgtagcgtatggcttcaacagaatcaatctgaaataactatgcaagtgacgagatgtttcccagttagaacatttgtatggaaggaagactagaggacggctgcaagatggctgctttgtctgacagattcaagagtctactctggttggtcttgccttgcctccgtttggttcttgcaattttcttttacaaaattggaacttgcctggaaaggaggggagtcagagagtttgattctctctttcaattacaaacagtagtctacttgatgatgctctatgttatgatgcagtagttttcagaaactattggctccttaactgtgtacatgttggggaacagactgaaaatggtcagtggttaaatattcaaggttaatgtctgaatatctgacgaatattgaatgaaagaaataaattattcaaaagttgttgaatgaaatccacccaaaaggaaattgtatgaactgggtactaattcttgggccgggctgtaccggtccgaactgggtatttcaagttggaatgcacaaacttatcagatcaactctgactggagatgggttgtcagtggaggccattttgggtacttagggtgaaaacggtctgaaatttacatggactcatcatgggccaggcaaggctagcaatccatttcttttaggtcatgtagtatatgttaatctgaacttttattaagtcccaagtaggagaatcagtctctgaaaatttttcaggtagaataagcatggaggttgcaccgaaatttcagggaagcctataaatgctgtcggaaagaagaacaagactcaagaccttataagcattttcaatagagactcaagacttgagaggaagtgtagaaggatgcaaactaactcattcgtatctttggtttaaatgcttcttcctttaatttaatgtcaaccgtactactgtagatcgactggaagttcatacttatcaattttgattctggtttgataaagacttgttctttgctaaaatgttaggaattaataccatgcacatgtgcatctgttttttattgaatcatatgtgtctaattatcaaagaagccatatgtttcttgaagaacttgagaaggtaaaacctgccctgccaatgactgaacaagtcaagatcctataagctgacaaagtaaaatttgagtttttaccgtcatcttccgtttcattttttcttccctcttaaatttccgcgatgcatttgcgcatatatttcgtgtggtgtcatccagtatgcacctcttgtttacatgtcaatcacaatctttctcaatcagctcatccttttcaaagaaatgtcaagttcattgcatggacattgcctgaacaaaaaacgagaaagaattcatcggtgctttgcgataccaacgtgacatagtgcctgattgcctgtgactcaccgaggttcaggaattcagtgataacctatataccagtggcacagcacttatttcaagcctctcatatttttcacaaaaaaaaaattgtctacatgcaagtgtaatctaatgcttgctgtaacttttttcaccacaaacaaattttgatgtttggaagtctttcggacagctgtaaagtttctattggcgggaactaacttagatgagtagttaactactgtttacttcatcagataagatatattagcaatttagcatagtagaggctaacaaactatctaaccaaagtgccgaatccactatcatgcttaaagtgactagctttagtttacctgaagtttgaagcccacattgtctgcatcaggataagaaaagccggtacggttggtgaccatgctgctgatgcacagtcatctcaagcagcaaaaactgccagcatcatctgcactatgtcaccacccaatttgcaagcaattgtgtggcacatcctccttttaggtggtcttgatccattcctgctttatttctaaccttgtcatttctttgccaatttatatgtgcccttgattcctcgtttgctcatctgctcttttttcgatatgtatctatcttgttgtatcttcttttctcatgacgagcgattcggttttttgcggctttcgatctatgctaccctagatacctgccaagaaagggcacatacaggttgattgattagccaatactgaattcattacaagagcttttagcctctcattgcctatgaaaatgctcacctacttttgtagatataaaaataaacccatcatatgagctaatgaagcacttcaagaaaaagtcaatttttatagcagattagagattgggctacagctagcctaaacacatgattgtggaggatgtttcagagtcctctatgactccatgctccatgacaaatgagctataaaatagctcaattctgaagctccatatgaccccctcatggatgcagaagaatagtagaaaagtacttcaagatggagagagttcctgcagttcatctggcagtggtgctcctggccttctgctgcctcatccatgcatcatcaagtgctgaaactccactcccacctggtaatcttctcggttcctcgcctccgtatcttcttcgtggcatattgttttttcagaaattcatagtaaaacataatgagatctgaacattctgactgaatattgatgtttgagtcacaaccagccctcaaggtgatgcagcgttttgaagcaactccagtctctagcagaggagatgatcaggtgatccgggtccagctctcttttccatctcataactttgattaaatcaagttttttttttgaaaaaaaaagagagagatcagcttacactttttttagaacctatatattcagataagtaataactgttcatgttcaccatgttttcaagtagtactagtagctacttttcagaacatgttctgtttagctgcaattgcaaaactgtctgctcaatctcaaccatgatccataaggctgccgccgtcatcgccggagaaccggaggccggcgaggtcaacggcaggatggaactggagctcaccgattacccgggctccggcgccaacgatcggcactcgccatgggggcaggagaggagaaactgagcagcagcagcaaaaaatcttcagagaaaacttcatccatggtcactttcttcagagagaaaattcagactttgtacctgtaccatatcatgtatacttaattatctctactattttctacacaactgttacagtgtttctacaccctgtgtaacatgaaagagaggatttgggagttaattaacgactgataatcagtcgccggcaccataatattataacaattaattataacatttctagtaagttttttagtcaaagttgttatttgtttaattaactttctaggcgtgtttgttctactgtaatttttctgttctagtaatatctgaatctttgctttgatcgattcaattatatgttgcgtgtggtgaaggataaaagtattaatgcaatctgatgttctcatctagaacatttttgccagttcgttgatttcggtttgatttattggagacgactaggctgaagatttcgtgttaggcagcgtggagtgacctgtcacaaagctgaggctgacgaatggcgttacgatttccttctgatttgtgatctacactcttgattaactataagtagttgagaaatacaaggacctgatttttctttttttttaaaaaaaacatttgcttcaggtaaaatgcatctatttcaaatctaaattgtttagaatttttttttactttgaaaatagagtgcgtgtcacctaaacgatctcgtactttcatttctggtgatagaagtggaggagacttctctttttttaaaaaaaaaaatctcactaaatgatttacttacattacacgctagtgacatgaaacctttgtaaatcactaaatcttatgaaatccgataaaacctaaataatacctcgagaagcatcaccgatcattaaaaataactccctctataccataacatttaacgttggttagtttattttttaaccatcaccaacaaaaagaaccaaagaagtagtacaaggttaattttgacttcacgatattggatcaaacctagtgcaatgcaaaagcgaaggttctcgtcggtaaccctacagctttggctaatcagctaaattggccttttcaattcagcataatcagccataaaaaggtgtccacaaagatcaaatacactaccaatagctggtacttattcagcacaataagctaactgatgggcttgtgctaaatatcagcctcagccacagcaaaccgatgaggtccgaaaacatttaccagcataacataaattacttctcactcgaaatttagtcgaaaaagagaggaaattaaaatacaactcgagatttagtcgaaaagacaggaaattaaaaatacagtatacatttgattcgcttcgatccagcgtgtcacgcggaatccgcccgttgcctttgccggctgcgaaaaccacgagcgggtgtaacgccgtcaacccgagaccccgagaccatcgatcccgcgccgtccgatcctgatcgcgcggctcccgtgccgcacgacggcagacggccgccgtgctgtggccgttgcaccgcgtcggcttccgatttattgataataataatccagatttaatttaatattttattgtttaccacacagctgctcctcctcgggcttgactcgtctcgtctcgactccacgaacgaacgaaacacgccttttccccaacgaccaaccaaagtttgggtgaagaaaaaaaatatcgccgcgtttttatcccccacgagacgagtcgagacgaccaaaagcctaactaatcgggggcaagacgaggaggagagcggattctcgtcggcttcggcgaccggaagaggagaggagaccgaccccgcgccgtgttccgccgccgccgccgccgccgacgacgacgacggcaagtaggtgcgtgcgatccccttccccttctctttgcgcggagcccgtcgccgagcggcgcggcggtggggagtccgttgatgtgtgtggtgccgcccgatttgggggtgatgtgatgtggtgtggtggctgctcttctacggtggaatcggggagagattcgcgttgttatggcgctgattcggtagggattgggtgggttgttcgtatgatccgcgctcagaaggggaattttgctgtggagagttgggggggggggggttggttgtagctagggtttcggtcggggacgggctctagtctctagagagttttagagtagtccaatacagtaaacggagtggtttttatttttcaggaattttcgctttactgcccgattcgaactatgcccatttttagccatcctcttgtgcgagtttaccccgtattgaccaatggcgttgtttgccttgttggtttcttgcaggaatttgattctcctggggaattaacttgttaggagaaaaggaatttgggatgggcgaccatgtggtggtgaatgtggaaggcttgggaaacgatggaggggctgtggagaagccatctgaggccgtgaacagctcagtggtggctgctgcgtcgctttctacgactgttgatacggtcgaggagggcggtggagaggaggagccgctcatccaggcggcggagtgccgtatatgccaggaggaggatagcatcaagaacctcgagaagccttgtgcttgcagtggcagcctcaaggtccagctcctcctcttttgatgttatttccatcttggatatggttcttatgttcctgaaattattgtaggcagcttgttgttcatgcagtgcatgtagttactggggctaagaataggctagttggggtagtgcttttcctagtttccattttggcttcattatggtttttcaattctattttcatgttggataagttgatggttttcttgcacataaattgatctaccatgttagataaagttgatttatcacattagattccctgataggttatactacctccatttcaggttataagactttctagtattgcctacattcatataaatgttaatgagaggtaggcggacatatatcgtctagagttcatagacgatatatatatatatatatatatatatatatatatatatatatatatatgaatgtgggcaatgctagaaagtcttataacctgaaacggaggaagtagttgtttaattgccttgtatatgtatgttcaggatagtatcactgccatatcatatgatggggataaaattgttcacccctatggcagcatagtttactgggatgctatctatctacctgtagaggatgctaacctttaaacatgctgtgtacaaaaaaattggtttatccaataactatgcagtatcgggcatggcatgtatgtacctttaagcatgctcgtgtgactgtgtcctcactttctcctgaatctagctgcaaatggcaagttggattgttctcatatactttttaatgaagaaccaacctttgatctcatagggaagtgatgtggatatggatattgcatatcatctgtttgtcacaatcccttgtggagaacactttgcaaagacaagttgagtcagcactccgttaaacaaagcagctatgaattccattttacaatctttatgggataagacataccagtgttttgtgcaatggtttttgaagcaatagttgggtcaccacattgctactttatggtatgatgctacct

SEQ ID NO: 33253 - DNA, 2428 bp, Oryza sativa
atgtgtgtttgacatgaacttagaggctgcttctgtgtagtcaactaacttataatgtgtgttgtccttggcttgtataccatatgagaaagtacttgtatgttttatctatgtaattattttgtattctggaattgacaattttactttcttcatgtacagtatgctcatagagcttgtgtgcaacgctggtgcaatgagaaaggagacattacatgtgaaatctgtcatgaggtcagtaagatttcttctctactactccattactacgcattgctttctagttcttatctagaggctaagatagcacctattttgatatgtgtgcatccaaattgcagtatatttgtttcttcttaggacttcatttgtcaaatgttctgatctgaccttgacctgatgatttgacttgttctttctgcaatctcacgtcctcaccaatacaatattgctgttgcgatagctgaattcctctttaatgccatatgcacctttttcttgatgtgtgctgcttgctcttcttctttcacataggcctcactccatacaggatcatggcttttgtgtgacaaccttgaactcatttagtgttgtctatctgccattacaccgttaccatttgaagttgcttggggagcgagagctaaagcagctcatttttattttaatcaatattagttgatttgaagtaatctgagtgacggggacaggtcgtgataaattgggtagatttgagtttttccatgggtgcttagttgtggccttccaatttagtattagttcgatcttttcctttcctttcatgagcttaaaaccagcatttagttttaggagaatgtaggggagaccgggagagccctactatgctggtacattgcatgcttttgtgattgattaactgtttatgtttcaaatatgtttatactcgtagaatacctgtagcttctttcagtcttctgtagattttccaatgtgtttccgttcctgtgtattaatttcgttgaggcttgtattttcttctgcagcaatataagcatggatacacagctccacctcgtgttgaaccagacgataccatcatagatatcgggtaagttatttctgtacttattttgcttaaatttaccagtttgtccatttgattatattgtgttcaagtgcctttgaaatttgaaaatttagaacatttctaagtcaatactgttggcttgcagtggtgattgggcacgtgacccaagaattattgctgtagcggctgcacaacgtcgtcttcttgaaactgagtatgatgaatatgctggtactgatgctagtggtgctgcattctgccgttctgctgcacttatagtaagtactaaacaacaattcaaggtcctgttgtgcttaataagctaagctaattcatagattgctacttccagagtccagacaatttgtccagtcaccagtatagcctatcgccctatcgatctgttttataattgaagaaccatgcttagagataccttgcatttctctcatagttctgtttaatgaatggaagtataatatttttagttggtttacaaataggcaatcaagctagcctccttctctagtcaatcctttgtatgacttctctagccaaatggcttgtctcgaatttctggaattctcaagattgaacattctaaaatccttggtgcttttccagctaatggccttgttgctattgaggcatgctttgtctatctcagacaatgaaggagatgatgatgcttctaccatgttctcggttagtcttgtgttccttccccactttttttatcttattggttctttctgagctcaatgttgacttaaaaatctttttttacatgacttaaaatctattaatgttcttcaatgtccaacagctctttctacttcgagctgctggatttctgctgccatgctatatcatggcttggatattcagtattttgcatcgccggcgacaaagacaggtacttctaattctgtatggatctcattgattgtcaataaaatcattattgggctattcttatggaggaatgaaatgattggtggaccatctgatcctaactttgacacattaaccacttggttggtttaacgaatgggatgggttgttgtgtcactcttatcatgtttagcagaaaaacgaaaaatgacaccacctcaccagaatcacgtgatgatccctatccaacttgatgtagtattatggaatggaagttttaggccccgtttggtagggctccaaactccaaactccaactcctaactctaaactcccactccagtgagagctggctccagtgggagctccaaacactttttcactccagtgtttggctagtattcagctccagatctgaaaaaaaaatttaaaaaagaaaaaaacaaatgcccaaaccctaactgc

SEQ ID NO: 33254 - DNA, 10956 bp, Oryza sativa
  unsure (1)..(10956): unsure at all n locations
tgccatggcgactcgtgaggattacaggaaggggagagagaggtgagaggtggaggtgagatgggggtagctcagtggcatttctgtgtaaataagttaaaaaattaaagggtagtgggtcttttggggtggagtgnagctgtggagcagcaaaaacccagctccacccccgtagttcattttgtaggagtagctctgctaactccgctcccaaaaatagaggatctagactgtttggcacagctcgactctaggtaagtttgttgggagctggagctgtgccaaacggggccttacttgccgtaattactctagtgggcattgcagtataactatcatcgatgcaacatctaaactctttcgtacttgtatttttggcaggaagcggctgcaattgctgcagcagaggtggcattcatcctgcaatcagcccaaggccatgcccttcagttcaccatcgctccagactcccccgccactccacagcatgagccacagcagcagcagccgcagccgcagccgcagcaatagctagttacttcagtagcgtctctcaactactgactcgcacatgcagaagaagaggatacctcagctagtggccgctttgttgtttcctgttgcaactggcccagggacgctaagaacctggcctcgccttgtgtggccgggtagaaaccttgtaaaacgccagagattcatttgttgcaagcgaccgcagcttaagccccgctacccttcgatttgtctctgtgtaactcaagcattgatttattgtaaatttgtcgtctgttggagtccatttttttagttcctttgccaagtgttttactgccatgtacagtattattacatgggagcttttatctttcaaagaattaatctgagtgagtgtgaaactgttaggctacgtttgctgagaggttaagcccctgtttgggatgcttctggcttctgcccccccgaccgaatctagcttctcagcccaaagtggatctctctcccgaacaagataatcaggttacatgacctaaaggcgggtttggggaactcagatcctgcatttggcagctagtatggtcattatgttgctgttgtgctaaattaggacgcatcagttgttacttggtgctcgtttaacttattccataattttgaaatgttttcatcggttaaattaatcctctttggctggtaataaactaccctcattttctaatttttcctaatcagatgggtatgattgtagtatctatttgctaaattaaattagacaagtttgatatggttgtagtcacagctatggcaagattcttttctaacaaactagattccacacgttattgactaacaaaacgtgataagattttcttatacttactaaggtgtgacaatatttatgggtaaaagtgtgacgggaaccaactacatgcttactccatcccacaattcatttgttttaaagttgtctcgtttgtccagaaacaagttcgttcttagcaatcggagtttgtgaaattaagaaataatatgtatcgaaagtagaaaaggtggaaaatgattatattaggatttgacagagcagtggcattctagctttttttattgttatgtataggatatatggaaaataaacttttttttcaagacaaaaggagtactttctacatacttcatcagtcccataaaaaactatttttatgaaaccaaggaatgtgatatatcatagtaatatgaatttagatattgtctagatttttggtattaagatatctcatatcttgtatttttatttgtttatatagaagaaaatagtactccctccattccataaaaaactaaataaaataggatacgacgttctctattacaacaaatagactctagctgtgtttagttcctttcaaacttctaaaaattccatcatatcaaatgtttggacacatgcatgtagcattaaatttggactaaaaaacaattgcacagtttgcttgcaaattgcgagaggaatcttttgagcctcgtcatgatttgacaatgtagtgctatagtaaacatttgctaatgacgaattaattaagcttaatagattcgtctcgtagtttaccggtgaaatctgtaatttatttgttattagtctacgtttaatactttaaatataaatatatgtttatatacttaaaaaaaatttgaaaagagctaaacacggtctcttctctatatagatttagtgtcctacagaacgtcgtttttttttatgggtggagagattgagagcaaaaggtagtcaacgtgtaagctacatcacacgctccaccctcgcgtctcgccacaagaatcgggtaggcaggaaaaagcggaccgtgaccgcggcagcagcagcaggaggcagggatcgggatctggggccccaaaagccgcacgtttcgccccccaccgacgtatctacgtgcttccccgtcgaccacccccatgggccgtggccctccgcatccgcatcgcgctttgcgctttgctctttgcgtgggccccgcaccacgtcaccccgtcgcatcgcggcagcccacgtggcagtccacgcccccaatcggccattgacgtctgggaatttgaagcctctcgagtctccactcggtgggtttagagcaagcttaatacggagtagtgtagtcagttactccctccgtatcataataatataaagaattttgagtttttctttcaatgtttgaacactcgtcttattcaaaagaatttaaaattattatttattttatttatgacttactttattatctacaatattttaagcataacttttcgttttttatatttccaaaaaaaatttgaataagacgagtggtcaaacgttgcaaataaaaactcaaaatcccttatattgtgggacggagggagtactaacttctaatttctagttaatctaataatcaattcatataatagttagctataaatatatattatatcattaataattagttccacatatcatacacacggtgttttgttttagagttcgtactgtagctggctacaaatatgtaacccgtttctgttctatctcctctcttatctcctccacgtaagtttatagccgacttattatttattattgtacgtactcttaaaactaaaagggagaatagctaatatggtccctaaagtttcgctcctggatcattttagttcttaatctttcatattgtaatatagtccttgatcccaccaaaatcaccacatggacatgccatgtcaccttcctatgcaaaatctatatgatttgtccaatttacccttacgcataggtaaataaaaaacaaaagaaaaaagttaaaaaaatatatatggtacatgtaagagcaaaaatatacctcaaaagggtgaaaaaagaagtatttttttcctatggttatgtctaattcactcttatatttatttttctatgatatatgtaagagtatattggacaattcattatagatttgcatgaatgatgacatggcatatccatatgatgattttggtgaacccaatgactattctaggccttatgacaaaggttaatgatttctttggaccatttaaaaggttagggactaaactgatcctacaaagaaacttagtgctattctcccaaactaaaaaaaagagtttagaaaaataacgagaatttgttagaccacctccgtggccgctcttctcgcgcgtgcggcatgggtggctgccagtgccgcggggtcacgtcgcgtcgctctcaatcccgagatcgcggcgggttcggcttggcgattggagaagaagaaaagaaatggcgccgggtgcgtggaatatttacggctgagtccctggtttgtttcatattgttaaccgtgacctttggctaatactagtttttttctttctttctttgtttcgagttctcttgctcaggagtgggcataaaaaaaaaccaagctgaaagaccaaatcgaaaagacctgaccaagaccgagaaattcaatcctagatagtgaaagacggaattttattcggtttgtctccccagctaaccgaatagaccgaattaacatgaaaatgctcaatgcaaactacaatccactaagttcaataggattaaactctaatttttcatattcctactctttctaggcatgcaaccccataagagtctttattcagacgtgcttgtgaatttcttttttgtgatttttgtgttgaaagatgctatgatttttttccatgtatgaaactgctcctgaatttcgggtaggaatgagaccgaatttgctagttttgatattttttgcgttgaaatttggtcttcactttttaatgaccgataatgaccgaatagactgaaagaccaagacctaaattttcggtctgaccaaatacccacccttactcttgcgtggattcaggtggacaacttcgcattgcagcaaccgtattcaagctcttgtgccaaagaatttcgatggaaaaaacaccaactctatggatatagtttcggtgaaaaatctagaataacatcgtctaatcctaatcttggtgaaatcttgttcctgccttctcacctttttatatttaagggtttactcgcttccttacagttccgaaccatttcaaattttggtaataccaaaatttggtgagacaatgaactataaacatgtcactgccaacataatcctgttaatttttggtaattatgaaacttctactctcaaaactacttttggccaatgctcccacccttttgtctaatgctcaaacatatatttttgtggggaggattaattcctccatagagttgccttagttgaatatatattgcctcattaattggtcattgatgaggtggcatttaggcagatgaaaacaaaaaagggaaaggatgaaaaccccaatttccagccaatgaatgctcttgctggacgccccacttaattatgaggagtgacgaaacactgcaagctgatctttgtttcctgattgatccatatccaatggcgctggagtcgattccgcttgtgtatccatccatttgactcccaaacaaaaaatagatagatcaactccacttgtgtatccatccatttggcttccaaacaaaagatagatcggtgtagacgtgactaagctcgacaatgatgacacgattgttgcgggatcaaagctttcgtgttgctttgtgataagctcggcaatgacaacctacgtttgggctctgtttattaccggtcatttggagggatgcatggtgtgtgcggaggtgggtgtgccgcgtttgttcagacagccatgagattgaccatactttgctttgtcgagttgtttatttttttttcttgtaacccatcggaattttactgttttggtttgtctactatataaaaacctctttcctctcataaaaaccatccaccctcaaaaattcatttctaaaaaaaagattgtaaaaaaaaaagaaaaccaaacagcctactagatccaaatctcccactaaaccgaataaaaaaaacagttacactgctagttaaaaaaagaagaagaaagataaacaacggatctcccaaggtcttcaacgtaaaaccgccaaaccgggccccacaacaacgtcacaattccacatcccaccgtcactgacaccccggccccacccccagtcaaccacccctcccttccctcccccaaacaccacggaagacgaaacaaaccaaaaccaaaaccaaaccaaccaaccaacttgaaacctcccatctccgatccccacgtcgccatctccccctccctcctcctcctcctccgcctccttccccgccataaaacccaacccccaccaccactccatcgccaccaccaccaccgcgccaacccttcgccgccgccgccgacgaggacgacgacgacgatcgaaatggcctcctccaccaccgcctcctcccagctcgccctcgccctcggcatccccggcctcggcggcctcctcatccccaccgacgccgccgccaccaccaccaccaccgccgagggcaacgatctccacgccgacgcctcccaccccgtcctccgcctcgccggcgccgtccagcactacgagtggggcggccgtcgcgggtcctccctcgtcgcgcgcctcgccggcgagggcgatgatggtgatgagaggccgtacgcggagctgtggatggggacgcacccggcggcgccgtcgtcgctggcggcgtcgggggagtcgctgagggagtggctggggaggcgcggccccgccgcgctcctcggccgcgacgtggcggcgaggtggggcggcgacctcccgttcctcttcaaggtgctctcggtcgccagggcgctctccatccaggcccaccccgacgccgccctcgccagggcgctccacgcgctccgccccgccacgtaccgcgacgacaaccacaagcccgagatggccgtcgccgtcaccgacttccgcgccctctgcggcttcgtctccgtccaggttggttttccaccacccgcatttcgctgattaatcactagttctaattgcttcttgatgcactttgagatcgaatttttgatgataccattagttctgatgttgttgttgcgcatgaattttgttagtttggttggttgaaattgtttatgagatgttgccagcagatcccatggatgattcctaatgggtaggtgggtgtgaggggcggagttgacttatgtcgaaatcgaaatgtcaagtggggatctggctgctgatgaatttggcaacgaactaatgattaatgattaatgggatctgtaattatcgaacgggcaagtacttactgacagcccaacaacctgttaatccttcgctaaaatatcgtcatctataatagtagtatataatataccttcaaactttttattggtttcaagaaaatgcagagaagatgaggttagaatttcattttgtttttttttttagaaaatcacacgcctttcatgaggtactgtggtccagtgcttcacaaacagttgatgctgtccaagtatccagcaagctgcaatggattatcccccaacgccaaaggcatcattttattgttggccccatgtccatgtatagtgtagattctgtccaaatcacatccagcgatgcgtttacaagtatggctgcttaggtaggtgggagccgtttcgtggacagcaattggaagtatggcttgcttactagcttaggtaggcagcaggcatttcgtggacagaaaaaaagggtgttgttcaacagccgtagccaactgcttattattctgaacctcatatgttgcagtaatatttccctatttgaattgcatatgcatcaccgatggacaaataaacaagggggggggggtaatatgctcatatttggttcttgtacaatgtttactctgaaattcagattctggttggttagcatgtgacttaagtaattctagatgtacaatgtgtactctgaaattcagattctggttggtcaccatgtgacttaagtaattctagatgcactccagcttcattgactggtgtttggctagatgtatcacatctttattgaccgatatttagctagacgcaatgtgtgactagtttcagagtaggaaacaaggtataatgaagtatatagaatacactttcaatataattcttttgtttaaatccttccaatttttcggaaaatagattacaaatgctatagaatctcattgttaacaatatgggctacatagtaccttggagcttttaggactctaagcattgattacctgtaaaattaagtactgacctattatactgcaacccaggagctcaaggatgtcttgaggactgtacctgaggttcgagagttagttggcaaagaagaggctgtgaagcttatgggtgccaaagagcatgatggaggcatcggagtaaggtcatatctgcaatcagcttttactaatttaatgacagcaagcaaagaaacagtttctgaagcagtctcaaagctaaagagtcggctgaatattgagagtaaggtaaactattctcttaattattcttgacagatgtattatttatttcacttgcctataatctgtgtcagctgggatgtcaatatcagtttgttccttcgtcgtacgctacgttttgcaaaatgtttgagcttctatctgtcttcttgttcatttctaaatgacaaaggaagactttttaggaaaagcatagttgttgctgtccaacttttttttttttgggaatattgctgtccaactttagtgccatataatccaattgtgtggttaagatggagtgtgatttgacctcatgtacttggggctacaagacattgtgtgtgggatactacctcttgaactcataggctttgcagcaccttgtatgacagattctggtagcattgggctggtttaatttacaacatggtgaaatgagggtcttaaataataaaaaaaagtaaggcaatggttctgattgtgagctacctcacatttctgctttctgaaacccagttcctagctctgtattcagaatttcagatatggcagcctcatatctgaggtaggatcagcagttcagcaacatgttacatgcttacacaaagatattgccaaacctgatattcctttttgaggagattcaagcctgatattctgcaattgaactgttttgctgttaatgttcttttcaggttagaaccttgacaaagaaggagcagctagtgttgtcactggagatgcagtaccctgaagatgttggtgttttagcagcattcttctttaactatgtcaagctcaaccccggtgaagcactctatattggtgctaatgaaccacatgcatatctttcgggagagtgcgtcgaatgtatggccacatctgacaatgtagttcgtgctggtctgacccctaaatacagagacgtccaaactctttgctcgatgctgacatacaagcaggtttgtttatctgatttcttatttatataagcatcacctatattctgttgatattcgctgttatctgattatcgtctattgacaattagtgtttctaactcttctgatgctacactaatcaagtaatcatcattgattatgttactactactggtatggtagaattgcttgctcacttcataattaagaaaggcgtatggtactactactgttatggaaaaactgcttgttcacttagtgattaaacaaggcatatgtttctagaattgcttgttcacttcaaaattaagcaaggaaaatacttccttcaaacatgtggagcttgattacacgaacaaactcagccagaatgttcaaatatactccagaaaatcttgtgctctttattccgtattgtaatataacttacgatcttccttatgcagaactacccggagattctgcgaggagttccagtgcaagcatatgtaacgcgctacatacccccatctgaggagtttgaagtcgatcgctgcctgctgccctccggtgaatcggtcaccatgtcaccggtgcctggcccatccatcttccttgtcatgacaggggaaggcaagattgaggcagattccatgcttgatgaaggaaaggcaaaggaaggcgatgttttcttcgtgccggcgcacaccgaggtcaggatccttgcttctggtcctgggagcatgcagctttacagggctggggtgaacagcagattcttcagctgacttcaataacaccgcaaatcttcagggattaaaggttattgcgagagtaattggtaggaaaacgggtgtcttactgtcgtcctttcattttatcataaggtagctagttaagccatcatagtgtataggcaaatggagataaagtctctctctttcatacccttaatcctgtttatttttttccccaatatgtaatttacatttttcagtacgctggaagcaaatgaaatctgtagatgagcttctagtttcgattattcattcatcatgtacatgcgaaaattgaagtttgctttggatatagaataactaatatgattccttcgatccttggctagcggcagaatattattgttcgtgattacatgcgaaagggatggtgttggactgttgagaggaatggctagctgcagagcctctgcctaaaacgagagatgattgaacaacattagctataaaagaactgcaaccttagctattccagtcatactaactttagacgtagattatcaccggaattatgactcttattataaaagcaattgattaagatgttgagttagctgggaatacatattctttcttgattcttgaattaaatttctgatgactgaaatttctgctgttttttatgagtagaaatgctacctttcatcaaaaaattttttaaaaaaattgattgccttaatgtttttattttatatagttttcctcaaaaaattaagaattgattgatttaatgtttttatgagtagaaatgctgcttttcataaaaaaaattttaaaaaatgattgccttaatgttttttattttatatagttttcctcaaaaattaagaattgattgacttaatgtttttatattatatagttttcaatacttctaacttagaattgatgaggagtaaaatgaaaaatgtttctgctcttcataaaaaaatttgatttactcaatgtttttatattatactcccttcgtctaaaaaaaccaacctacataaggatgagacactacatagtacaatgaatctgaagctagtgtcccatcgttttctaggttgatttttttttagacggatggggtatagttttccgtactagtatattatatagttttccatactagtatcttagttatatagaaagtgaagaggcaaagtatggtaggagtttataatagatagcgagaatgtacattacgttagc

SEQ ID NO: 33255 - DNA, 14228 bp, Oryza sativa
  unsure (1)..(14228): unsure at all n locations
atatactccctatttctttgttaacagtgaaatttggtaagcccggagttgtcatcggcttagagtcagcatcggcttcgaagtcctgggattagccgatgagagttgtcaagtcgtcagttatcggattcttgctatattcggttaaggaaattgatctactaaaggaagcttatccagaatagaccgagttcaaagagaatgcggcatgacaagttatctattaattagaatactttgttagtttttagttgttggatttttgctatattcggttaaggaaattgatctactaaaggaagcttatccagaagagaccgagttcaaagagaatgtggcatgacaagttatctattaatcaggaatagtttgttagtttccttttatctttagaaaagtgtgtttagtgtcctataaggactttatctttccttttatctttaggaaagtttctttcttatccgacaaggacttgtatcaacccatgggtataaatatgtacacccggggtctatgtaatctatcttcacgatcaatacaattcggcgcatcgccaccttttgccttttctactttattttatcgtccgacgggacttggcacctgacgcggggctgcatcggtgttcgatctccggctaaggggtaagtccaatgttctgccagcccgggcaattgtatcgtttacgtcggcgtcgttcaaggctgcatcagtacattcgacctcttggattgctctggtttgaatgatatatttgcctacctatttatcatatatctctgttaatctagtcttagcatatcaatttagctctatcggctgcctctcgttttagggtttctgtcggtatcggctaaatcgcattgctagaatagattagcttagacatctaccatcctgaaaactcagtcaacggcttgattgtctagatattatgtttcttttcatacttagtgctgcatcagttaagtttgatctactaagttgtgcttagaaccataatctccagcctgcttcttgattgccaataagggtttcatcggggtttcagccggtgagttatctggacgttgcatcggctcataaggattgcatatacatataagttggatttagccgatgacaacaaaggtttcactgtttaatctaatcctgtggatttcatgacatcggatctccagccgatgtgtgctttaactttcggatcgatgcttatttatcatatcattatttgccaattggtttatactagattatattgttattttattacatcatcatcagccgattgcctttatatcattatctacattggacatatagccgattgcttaaaccctatagctatcggtatcggctatcggctggaactactccatcggcttgtcagccgatcgactgttttgatctactatttgcatatcttgtcagttgcagcatcaaactgactggcacgcccgcatctcaccaatctttggacctgcacaggagctaagcagatctcccaggccggtgtgttcgatttttttgtcaacattcttaaaatataataacttttacctatgaatctgaacaagtgcatgtttcaccggtggagaacccatctttacatacggttcgcaacatcttgtagttccagttatgtaaccgagactacaaatccgggactaaagatgtccatagtcccgggtggaataactgagactaaagatctttagtcccgtttggtaacaccaaccgggactaaagatggtagcgccacgtgctgacactatcctaaacacttttttctttctttttctccattgttttttaccgtttgcatattgatttcgtactgaactcagcaacaaaatcatccacaatcacaaaaatatcacaatatcatccataaattcgcatacatcttaaatttatatatccaaatacatcacaaaccaacaaattcgtatcacagatcaacatcaaaaacatcacaaatcaagaaattcatccacacaacaaatttctcagccgagccaggcgccgctgtcgctgccgccgtgccaccgcggaggggagggtgccgcacgggccgtgccgccgcgtggcccgcgtcgccgcggaggggaggagagggcgccgggtgggccgccgcgccgccgcaaaggggagggcgccgcccgtcggcaccgcggaggggaaggcgccgcctgccggcgccgtggaggggagggcgcgcgccgcagacgatggagatggggaggggagaagagggaggagagggggaggaggaggagataaggaggatacaggagggtgaagaagatagagagatagaattgaagaagataaggatgagggagagaaagagataaagaattttcggctctctcccccgtgaatttttatctctgtacctcccacgcacgttttttactgctcgcgcgctttttttaatatttagtcctggttggtataaacaatcgggactaaagatattggggggcctgtcacggcctgacaatgaatgaaccaggactaaagatcatatattcccgttacacttcaaaccgggactaaaacatgctttttagtggtaactctagaaaaccatctaattaggaaaagaatataaaaaaaccccaaaatgctgtctacttaaaaatgtggctgaactttcatttttttatcccatggaatggataagtaagttgctactctggaaaaaagaaggttacaatagcaacaatcctcctcgagagcagtccttaggccatccacacaagggaaaaaacagagtggaaagatagagaggacaacaaggtagaccgaaccgagcgaccgaggtaggcgagagttggtagagggcggtgggtagtttccatggcggctaggtagaggatcatcatctgacggtaccggcggccggcagccgacaagtgggggccagatcctcgacgcgtaattgatgaagattgctggcctagcgaggaaccataaagggcgatcaggtgcaacagaagcccgaggtgtgggttgatgatgaagttgcaggtgctgaccatggaggttggaaaagattggccacgactttgaagcagagggggacaatcaagtaaccaaagagataataaaaatggaaatgaatcccaagcgaaacctaactgtcatatgctagtaggaattcagacaatattatcatctaactgtagattgaccatgctatgagtctaactctgagcagaataattgtacgcttgagatttttaactggatgtgcatgttaattttggtaaatagtgagtactgtgttttacgtaaatttaatacgttatattaatttgaatggaagggaaattctcttttatacatattgtacaccttcctttgttttacatacactcctttttttttgcttcactatattttaagattgatgtggctagttatatttttttagtgatttgattgtaacccgtttactgaaagttttaaaaaattttattgctaatgaaaagcccatcaggattatgttctcaaatagtgatccaaccatatggaagtgtgtatgtataaaattgttaataaaattgataataagagcatctgagatgttttgatactttgttgccatcttgtctggcatgatgaattcaatggacattccaaaagatatgattttttacattttgggagtcaggctatgctaagaatatctcatatcttatttgagtacggattttcaaaaactttttaaactaattgcatcatgccgatctcattcgtctattttatctggagttgatctcgaggattattaatcgtgagtaaagaatagttaattagaaataaaccctaaaaacaaattggtaaaataaatataaattaaaaataaagattaggtgtggatagtaataaataaaatattatcgcgaccatatttggatcaattaaatttcattgcgatggaataagaattaaccctaattaaagctcaaataaattatataaaaataaaatatgagtaatattaatctaatctagggtgaattcattagttgagataatacacatattgagtaaacttcatttatgcaagatttagaaattatagaatcaaattcatataggaaataaactaaaattgggaaaaataggaaaaagacactattcattagcctctaggtgttcgacgaggttccctagccccttcccctcccctgccatgcgcgcctcgcgccccgagccgtcgccgtcgccgcctgccgccgtgccgctgtcgcctgccgcgccgcgcgccgctcggccgtcgccgtcgcgcctcgcgcctcgtcccgccgcgcgccattgccgtcgccatcgccgcgccgcgtagccgtcgtgtcgccgctgctgccgtcgtgtcatctcgagccccgcgccgccgctgccgcgctgacgccgcctcgcgccgcgcaccactgctgcgcccgcgcccgcacctcgcgccgcgcgccgccgctgcccgcccgtcgcgtcgcccgtcacgtcgcccgtcccgtcgccgctcgtccgtcgccgttgcgccttgcgccccgcgccgctgccgtctgccgcaccacgcgccgcgcgccgtcgcccgtcgcgtcgcccgtcccgtcgccgctcgtccgtcgccgtcgcgtcgctcgtccgtcgccgtcgtcgctcgtccgcgcgccgcacgccgccgcccgtcgcgtcccgccccgagccccatgccgagcgcccccacccgaagccccgcgccgccgtcatgtcttcccctccccttatctctttcccttcccctatataagccccgctattcccctcttctcctccgtctccaccccctcatctctaccactcctccacgccatcgcgccgccgtctccacgccgccacgccgtcgcttaaagccgccgcgcccccgccacgaagccgccgcgccgcgccttgcgccaacaccgccaccgtcgctgtcgccgccgttgccgtcgccgtcgtcggtaagccgccgcccaacctttccccccctcgcgtccatcgtcgccgccgcccgggagagcaagagccgagagagagagatagagccgggagagggagaggaaaagagtgccgagagggagaggaaggaaagaaaaaggaagagagaaaaagaaagaaaggaaagaaaagaaaaggaaaagagagaaaaagagaaaaaagaaaagaaagagaaaagagaaaaaggaaaaatttaagagatttagaatatttaacatattagaaattaattataggattaatgagaataccgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaatcaattaacggtagaaaattcggatttagttactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgcaaaatagtttaaatcgaaattgggtttgtcatagttcgcagatagtaaaattaataaaaaggaatcgactttcgcatgtgacttttatttggatttatttggatttttatttgaattctaaccgaattcaaatcaattcttgcacgtaactatagagcccgagggagttgcggatccaagcgaaggccaagacccgcaagactttgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgacgacataatttgtgaaaggaaaataaagtaaaacaactgttttcgactggggcggctggaggacttgggtggtgtctggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggaagggatattgcatgatgaattttatgctgttggagccacttcctgagaggcgggaaggtggacgtcctcagaaaaccatgacgaatcaatggtgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagccttggaggatccctatgcctactatcaggagggagatgaagacgatggcgtccagtaggtcttagtacggtcgttgcccgtggcaatggcatgccgctgcctgaattccgctgccttatctatttctgcttttggatgtattccggacctctcggtccgatgatttaagactatgcctgcgggcctatgatgtaataattcgtatttaatactcgtgtatgtgcacttgatattccagctatgaattcgtgtgtaccaaactacttgatccagggaaatggtactgtttacacgattgattcctgttataaaaacgggggtccacagagctggtatcagagccatacgactgtaggaaaagaccaaaaggcgccccaccccttttctaagttggccaagggagatattcccatttagtaatactttcaaaaataaaaacgctatgtttacaaaactcggtacaattttcatcttactcttaactattttatttacaaaacaagttttactctcaactgactttgggtttttcttaaaattagatggcagattcggattcacccgctacctgggagttgagcttacctcaatcagaggggtatgtcattgagctgcatcggatgttgaggcgtctgcgataccctggattcccgtcataccgagtgagacagtgtggctcagtttgggaggctcgggttgagattcacccccgagtcccttccgagttggactacagcttccagacacgtcaccaccgagacctgccagagactgcgatgcaggatgccgcccgggaggccttcctccgactcagctctatccaccgagctgagttagtgagtaccgagtttgctcatcacctgttccgggaggagggcaactcagtttgcacagttcaggacacgccctgctgctacaacccgatggtgactcggttgtcacgatgggctgaggcagtagatgactactacgaggaggctctgttggagattgacgaccaccagagacgtgtgggggagttagagactgaggtgaccgacctcacagcacagcagcttcagttggaggaggagcaccaggcttggggcagtgagatagactcactgaaggcacagctccaggtccacggcgaccagttccagcagttatctgaccagtacaacgatcaccgcgggatgatggatactcttgaggagcagctgagagagagtcaggagcacgtcagccagctggaggagcagcttcgagcagccaagatcagcactacaggggcttctacttccacagcagtaggccgtgaccgctactttttcctcaccccgccatacccaccggcgttccacgctcttctgggagaggctagtatgctagctaccgagtcagcgccctacctagtggaccctacagcgacacagccacctgttccggagttggtgcacactccactgatccctacaccttctccgcagctgggttccagtttggagactccgatccaggtcgactccgagacagaggggaccgacaccgagccagagatcgagccagacatcactgatccttcagaggatgaggctcctgttccccgcatcaccttccttggaggccctcgcaccctcagcactgctcgcaagagcacacgacctccgggcaagaggcccaagccagatccagaggccactacttctgggccgtggggactcaggtttgcgcgagccagcgaccaccctctacctgccccgggatcctgcggatggctggaggactagactgacggactccttgcagcttcgatctcgtatcagatggtttttggatagtatgcaagaccccctcccttacctagattgacgagtagtttgatgattggtttgatgtatcgtttggatgaaccttatttggactgcgtatgtatgcagtcaattgcatcatgatttatgtaccatttgtgaaactctgtgatgttatgatatctattgttgttgtattataaatgagtttattccaccatgcttgcgaaacaaagtccatatcaacacaaccccccttaatgggataaagccataggagctagttagaaaattaggatacttactccatcaacctacacagatggcaagccgacgtcgggcaacaaccagcaatgacgaaactcagacacccgacttaaacactctggccggagttatggccacccaaactcaacttctgcaagccatcgcaaacaaccaaggcaaccgcggagggtcaagctttggagagttcatgagaaccaagccgcccacgttcgctactgccgacgagcccatggaagcaaaagactggctacgcatcatagaaaagaaactgactctagtcagggtacgcgaagccgacaaggtgatcttcgcagtgaaccagctggaaagacccgctggtgattggtgggatacctacaaggaagcccgagaagacggtgctggagaacccacctgggaggagttcactgcggcgtttcgcgagaatttcgtacctgctgcagtgatgcgcatgaagaagaacgagtttagaagactgcggcaagggaatacaacagtgcaggagtatctaaacaagttcactcagttggctcgctacgcaattggagacctggcagatgaagaagaaaagatcgacaagttcatagaaggactgaatgatgaattgcgtggacctatgatcgggcaggatcacgagagtttccagagcctgatcaacaaggtcgtcaggctagagaacgatcaaaggacggtggaacacaaccgcaagaggaggcttgctatgagtcacccacctcagacagtgcctcagcgacttaagggagcccctccgtccggatggaagccccctgtcatggtgaccaaccgtcccgctgcacttagcaacttcaacaggccagttgcacttcagaaccgcacccctacaccaactttggctgcccctggagccaagaagaatgtggactgcttcaactgtggggaatacgggcactacgctaacaactgccctcatccacgcaaaacccctgtccgaactggcgcgaatgcaatgactgttcgcggcactactacccctgctatcgggcgaggtctattcaagactccgcaatctaacaggaccgccactggatttgggcgcggacaagtgaaccatgtccgagctgaagaggcccaggaagatcagggcgtactaatgggtatgttctctatcaattccaccccggttaaagttctcttcgattccggtgcatcgcattcatttatatctctgaaggctagtcaaaagcacaacttgaccctcgtgggacttagaaagcctatgatagtacactcacctgggggcgagataactatgagtcatgcttgcatagatgtaccaattcgccttagggatgtggtatttccctctaatcttatggtgctaataccccaaactcttgatgtcattttgggtatggattggttagcaaagcatagaggagtaattgactgtagacgtagagaggttaccctgaccacaccctggggatcggatatgagagcaccatggatcaagacctaggctaaccgaacgtgctgggggtatattcaccatgctacccctaaagggaatgcctgtagtacagcgatttcctgatgtgtttccagaagatttacctggaatgccaccagatcgtgacgtagagttcattattgacctgatacccggaactgcccccatatccaagagaccatatcggatgccggtcaatgagttagaagaacttaaaaggcaaatcagagagttgcaagagaagggatttgtacgccccagttcgtcaccttggggagccccagtgttgtttgttaaaaagaaagacggtagcatgagaatgtgtgtagactaccgatcactgaacgaagtaactatcaaaaacaagtatccactaccacggattgatgacctcttcgaccaacttaagggagctaaggtgttttcaaagatagacctttgatcaggataccaccaactgaagattaggaccgaggatatccccaaaaccgcgttttcaacacgctatgggttgtatgaattcacagtaatgtcgtttggtctaaccaatgccccggcatacttcatgaatcttatgaacaaagtattcatggattacttggataagtttgtggtggtattcatcgatgacattctgatctactccaaagatgaagaagaacatgcggaacacttaagattggttctccagaaactccgaaagcacaagttatacgcaaaattcagcaagtgcgaattttggttgaaggaagtcgcttttctgggtcacgtaatctcagccggtggagtagcagtggaccctgctaaagtggaggctgtcacggaatggaaagcacccaaatctgtgactgaaattcggagttttctaggcttggctggatactaccgaaggttcattgaagggttctctaagatagcccgaccaatgacacaactactcaagaagaaaaagaagtttgtgtggtcagaacagtgtcaggaaagctttgagcagctcaaggaaaagctgacctcagcgcctattttagttcttcccgacatcaggaaagactttgttatatattgtgatgcgtcaaggcaaggactaggaggagtactgatgcaggacagaaaagtggtggcctatgcgtcgcgacaattgcgaccacatgaggaaaactaccctacccatgacctagaactcgcagctgtggttcatgcgctaaagatttggagacattatctaattggaaaccattgcgatatctacactgaccacaagagtctaaagtatatcttcacccagtcagatctcaacttgaggcaaaggcgatggttagaattaatcaaggactatgatttagaggttcactatcacccaggcaaagcaaacgttgtggccgacgctctgagtcgtaagagccattgcaatcatctgagaatggaagggatggtccctgagcttagggaggaaatagctcagctgaacctacatatagtaccccgtggacagataaacaccctggacattcaacctcttttgagaacccaaatagaagaagcccagaaggacaacgaggaagtccgagagttgaaggaacgcttggctgcaggacgtgcaaaggaattttcaaccgacgaaaaagatgttctatggtataaaaagagaatttacgtacctgaacagggtggactgaggggattaattttaaaggaagctcacgaatcggcatattcattgcaccccggaagtacgaagatgtaccaagatctgaaggaaggatactggtggcccaacatgaagagagatgtggccgaatacgtagcactctgcgacgtatgccagaaggtgaaggctgaacaccagaggccagcaggtttgttgcaacctctcaggattcccgaatggaaatgggatgagataggtatggattttattgttggattgcccaaaaccgcaacaggatatgattccatttnnnnnnnnnnnnnnnnnnnnnnnnngacagcgagattcattcccgttaagacaaattatagcagtgctaagctagccgagttatacatgaccaggatagtatgtcttcatggtgtaccaaagaaaattatatctgatcggggcacacaatttacctcacatttctgggagaaagtccatgaagccctaggaagttatctcgcatttagcacagcttatcatccacagacagatggccagacggagagaaccaaccaggtcctagaagacatgctgagggcttgtgctctggattttagcaaggactgggagagatgtttgccctacgccgaattctcctacaacaacagctttcaagcaagcctaaagatgtcacccaacgaggcattgtttggtcgacgatgtcgtaccccgctaatgtggtccgagactggagaacgggcggtatttggacctgatattattcaagaagccgaagaaaaggttcgcttgatccgtgaccgtctaaaagtagcacaatcacgacaaaagagttacgccgacactcgaagaagaaacctggaatttaaggagggagattacgtttatctaaaggtttctccgatgaggggaaacaaaaaggtttaaggtcaagggaaaactggcaccaagatatgtggggccattccagatcaccgccaggcgaggagaagttgcatatcagttacaattaccgaagaatatcgcggaggtgcacccagtcttccatgtatcccaattaaagaaatgcttacgagtgccggaagaacaagctccgctggaagagattcacattagcaatgatctcacatatccagaacacccgattcggatattggatgaagcagaaaagaggactaggagcaaagtgtggcgtatgtacaaggtacaatggagtaatcacactgaggctgaagccacctgggaaagcgaagaattcttgaggacggagtacccgcatctattcgaaaactggtaagaaatctcgggacgagatttgtttaaggggggtaggtttgtaacaccctgaaaattcgaccgacaaaacaaaaactctaaaaatacggattttcaaaaactttttaaactaattgcatcatgccgatctcattcgtctattttatctggagttgatctcgaggattattaatcgtgagtaaagaatagttaattagaaataaaccctaaaaacaaattggtaaaataaatataaattaaaaataaagattaggtgtggatagtaataaataaaatattatcgcgaccatatttggatcaattaaatttcattgcgatggaataagaattaacccctaattaaagctcaaataaattatataaaaataaaatatgagttatattaatctaatctaaggtgaattcattagttgagataatacccatattgagtaaacctcctttatgccagaattagaaatt

SEQ ID NO: 33256 - DNA, 9094 bp, Oryza sativa
cccccccccccccaacatactctagctccgcccctgaattcagctaaacacgtgcgaacggaattgtttttttttaccaaaaccatgtagagggtggacatttgcaacaaaatgatttatggggtgtaatgtcaaacttcaagtatcttttgtggtggttattgtaattttccttttttatatgaacttttagcacgtaagcatgcatgaactttctatgcttacctgttcactactaaataaatgtgtacatgcatgatttatcacattggagcgtcctaagaataactaatatcatgaatagtacaagcatacacaacatttcctgatctagttcaccacgagcaaaattctgataagcccctaaaaacgcgtgggacatacgttctcaatcctgttcacatgatccaaagaccataattaagcggcccagctgaagtacaccgagtaacatatctatgctaattgcatgagtttgccatctcatacacagcgatttcaactaattgtgacaggaatttgttcgatcatgcctgatgtatttattagctgtgtttttgtggtgaccatgcatccatgatcagctgccagaaaacatatgtatatgatgtgttcttaactgaataatatatgcatagtagtggtgtgagacagggatgttgattccatccccatgtttggacgaatttggcatgagaaagcaacatctgcattagagcgtgactttgtacatatgtttggcaacatacagccagaaatgtgttcatttagtatattttgtctacttcatcatatgaaatggctggtacatagcatgatcagttttggttatataaggatttcaataagagtgaacgggtaaacacatgtctatgttatcttatattaaggttatcttagattaaggttagcgcattgcaaagttatattagatgttggaggaaactaaaaaatggtgatctataaagaccgtgtgttattattttggatagactagcatgataacccatgagaaacctgacctccctaatattgaatatattttgagtgtattgaaggcgtgaccatcaaccaatcaacaaggaggagagaggccatcttaatgaacaagaatgattaaaagttgtctgagttcacaagtcatcgaagattataatggtggatcaaagattataaatgaagatggggtgggcactaaatagttttgggtgaatatattgaggtaggaatataatataatataatataagattgaaatttgattccaaaataacgataacagttttttattaatgagcagcacagaactaaatattgtaacaaccgatatgaatggccaccacttctatcttaatgcttatcagtcatgctatcacatgcagccgcagttgtatatcattagcttctcgtcttaagtgaaactgttaccagatcgttagtttgagaatgtattttaactcactctgtatttatatatccaattatccactattatggattggggcatcaaaggcctccgcatttgtcgtgtgcctttatgtacatactagtatagatcttgtggttctcctaccatctctcgctttatccaccggcagaattgagcaactgaaaaatttgctatgggacatccaaaaaacgtgtaattagctaggagacactgcaaaaacgcttatttgctataggacaccaccaaaaactggtaattagctactggacacctataggattattttattatatccggagaaattgcagagagaaacaattgtgtaagtacgattctacccttcgatttttttctttttattttttatctatccttttctactccttcttccttattcttctctctctattctttctcgctttctctctttgctcttcaagcgagcccgagggagcgccggtgaccgcgcgacgaggcgcgggctagtgtgggcacctcggttggaacggcgttgcgcattgctgaagtatgatggcctgtactcgggcgccagtggcgccgggatgtactagcggcgaccgagcatgggctccagcacaaggaggcggagccgggtggggctaaggaggaggacgcgcccgccacgtgagccgatgacatgccactcggcgtcatcgcccaaggcaaacaccccgccgggattacgcgccgtggcaccacggcggcggctccgacggcagtccctggtgctgtcgacgccgacagggatggagcggttgttcgcccaggcgccatggttgtggttgtggaagaacccgacaagggagcccctggcgcgccgccgtggaggtcgttgaattggcagaggaagcggcggctagtgagcatgcggcggaaccgactgctgacgagggagacgtggtggaggcaggtcaagtgcggcggtagcagtaacacggcgagtgtcactagccacccctccacgttctcgctcgactcggccacgcccaccaccgccccgccacgccgccctcatccgccgcgtcgccgctggggcgtctcgaaggagaacgcggcgtctcgccgtcctcgtgtgggtatgccatggcgtgttccggctggtcgacgtggcgctgcgtgggagagagagagggggcttaaatttgagcttacatgtggggcccacgtttggattcatttgagcaagggcaaacttgtctttaatgattgtttttctatccaatttctccggatataataaaataattttgcgggtgtccagtaactaattaccagtttttggtggtgtcctatagcaaattagtgtttttgcggtgactcccagctaattacacgttttttggatgtcccatggcaaactttgcctaaaatactccctcaatttcaaaatgtttgacgccgttgactttttatcacatgtttgaccgttcgtcttattcaaaaaatttaagtaattattaatttttttcctatcatttgattcattgttaaatatatttttatgtaggcatataattttacatatttcacaaaagtttttgaataagacgaacggttaaacatgcgctaaaaagtcaacggtgtcaaacatttcgaaacggagggagtattaatcatgcatgcctgatgaattacacgttgccattttgtagtgactatgattcctcaatgagctttgagctagtgaaagacatgctcctgtagaaaaactaatacaaatcacaaatggtgtatttttcgttattaaaacgaatgatatttatcttccgttgctgctgggaatacaaaataacttccacaacaagctctcagttttatctggattgaaaaggcctattttgatattttcaactgtcagaaagaaattcaaagaaacatattgaatggccaaaagactagactttctatcagctaaaaaaatatacagtagcaaattggaattgcaatttctgacaataattagtatagcgtaatggttaggcctgtgggaacttgctaattgaaatattcactgttatcttcattgtctcgtcgatctcactgcacatacacatgcaagatacttcgatgtgcacaagtgtttggtcagtaattccccatacacaaatcttaatgaacacaaagaaatttggatttgatgtgtactgtagtatgtaaacagatgtgctttcctagcgatagtagctagtatactgatcatgttccttctgcaactgacgcataagttccatccatccagctagacttggtaaaaattaaagacaatagataagcatgcggcatacatgtgaacctgactgcacagaattggagatgtatatatatatatatatatatattacacatagagtaacttgaggagatgctaagctagagaggggaaatatttatgctaacggagtattatagtgaaaatttgagatttgtttttgtaaaataaacattctaagtagtttggtagtgctattgaaaaagtagcatagccagacagttggtgagaatacacatcaatttttgtaattgaagagtgatgtttaaatgagaggaaatatgctgggaaagttgaagcggacacaactgtaaaagatgttagttaaaccttaatcgactacaagattaaaaaacactagtgccgatggctagcgagaatgaagttatagtcttttagaccagttagagatgttggtgaatgctgaagctaccataattataagtgtcagtagtaatgttgattgaaccttaaaaaaccacaacattaaatcaacattggtgctggcggatagtgaaaatacaacttagtcttttatacaattgtgttggtgaaagcgaaaggaatcacaataactagtgtgaattgaaatgttgtttcaatcttaatcaataacaagatagattaaattaatagtggtgctagtgggagagagaatttagtttaattgagagtggtagtagtgggagaagagaatttagttttgagccaacaaatggcataacattttgatattatttccgtaaataaatccaccacgatgattagagtcagatgatgcaccttcccctatggaatagaaaccacctcttttaagcatgtaggtagggatggcaatgggtcgggtcgggtacgggtagagcaaaaccatgcccgacccgatacccgacattgcccgcccaaaccctacccactagagttagcgggcaaaactccatacccataaccatgcccagcgggcgcgggtatgttcagtgggtatccaatggatctcacataaataataacttgaaagatatgtaatttaacaaagagaaataaaatcaataatttaccaaattgtcggttatcaacaataatttgaattacatcacaattaattatatcccttcggaaatattttttccttgataataataccctccacgattttactacggttaattaagatggtattataaatagatttgaacccttcgatcaaataagattaacagttcagattactttctactaccagtagagagcaccgtaatgcgcctctaattaattaatagtgcagtaatgcagtggttaggcctgcctgtgggagctgccaatagaatgggatagctattctactgtcatcatcctttggctgtgtttagatagtggaaaagttgggagttggtagtttgagaaaaaaagttgctagtttatgtgtgtaggaaagttttgatgtgatatgatgtgatggaaataaactaaacatggcctttgtctcgttaatttacctgtgcactcacgaaattcctattccacgcatatgcaccagaagtgccgtgtctttctattccctcgtgcgtcccaccagctatatgcatttccttttttttttctttttttggatctggaaataaaattagccccatcaactacgccatatggtatacatgtatttcccttgcgcatgattcccagatctagagaaacaatgatgagttttttttccaggtaagtgtatgtgtttcatttatttggtatacatgacatttttttaacaaaaagcaacaactcaaatttgaaaaaaaaaaaggtccaaataaaaccttcatctcaaaattcaaaactttgaactcaggttttcactttcaactcaaaatttgaaactttcaactgaaatttaaaaactttcaaataaatatttaaaacttttaactcaagatttaaaactttctatccagatttaaaactttcaactcaaattttcatctcaaaattgagaacttctatatcgaaattcaaaactttcaattcaaatttaaaaaacttttaagtcaaaattcaaacttttatctcaaaattgaaaactttcaactatctttttttaagttgttaactaagttatttatgtatttttaaaaattagagctaagcatcatcattagcgttaatagtgatttgcgtgagtgactgggacgtacgggcgctttatgcagcccggcacacgtccactagaaacccccgtacactcatgctagatagtacttcaatatgcatgagtttaagctgatcagcaatttcaatcatgcagaaactaatgccggcgaacacaaagaaatgtggattatttttctgcacactgtaaacgaatatgctttcctattgaagagagaaaaggtagcatccttgtcgtattctttttcgactaacacatataagttccacgcatgcatacagccggtacctaagtaaagacaataggtgtgcctgaatctgatcgctctgaagcttcgagcagctacagcttcagttctaggatctagagcttcccaaaacatttcaatttttcgtccaaattacaagagctttagttctatggtctagaaaatgaatttgaagacattagttggtttcccccgattatttggatatattcttatcagctttattttaaccagctgtttatctgaatataaagttaccagaacaaccccttggttggtgacgaggaaagtgccaagaaaaaaagaaacatatgtatggaacaaaaactgctgatcaactgatcaagaaatatgaactcgaaatccaaaacatatgtagtactagagattttaacggagtttagcatcggaatattattggtaggaactataagaaaaactttgtatatagtgagtaatggaaggcagagaaaatggttaatgatttgttggagtctgaaatcaactacaaatccaaaatagattagtaaaaactgctaatacaccacgaatagatgagtaaaaactgctaatacaccatgagctactatgcgttgccattgtattgtattgtgttgcatgtcatgcatatcaataaaattgtacttctcttcgtaagttccactgactacttctcttcatgcatgtgacaacaaacactcgtgttaaacataccgtgtgacagttaaaagtgaaccggggaggcaggggatgtaaaaacaacatgagctagctatatatatatatttcatcaccatatcaagggcgtgcggactcattcacaacgtgtgaccgagataactatctccaatataatagcgttttttcacttgtagtttctctgtgtagttatcctaacggtggctagcttccaccttattagcgcacttcatacgaggagaacaacaaagccgagataacatgtttcgaaagaaaacatgtaattaatatgattgaaagagaggagcgggtggatgacatgtgaatgcatatataattaaaatatccattacccattagaaggggatcagctgaaaagcattatagcattaagatatttggctgaaacaattcagtattttatatgtgctactaacatagcgcgactagataagtgaaatgcgagaaaaaaacaaatatggaaaatgaggttttggaggaagccaaagaaagacaggtgaaatgcgagcaaaagaacaaatatggaaaatgaggttttagaggaagccaaagaaatatatttaacaggatgatatgatggggattgggcggaggcagggctggggaggagggatacttgttataataatagcattactactcccatattcttgtcaaaaactaattataaggaattttttgtgatagattggatccaacagatcttaacccctacatatctagtgctatatgtgaggagattttttatgggattttgactgggtttggcatcgggattattggtaatattgtttgcccaacaataaaagagtactgttctaacagtatgaaacatcacaggatatgtactgaaacattcgaaataacactacgtgcaacatttccaaatcaattgcagaacatcgaaaagtacttactagaaaatccaaataatactgtatgcaactaaaaaatctatgataacaaatcggggacgactccgcgtcgaacgtccgatattccaccaaatatcggacacccgtctgtctgcgcgcctgtcatgcctcctgctgatgcagcatgcatcttccgtctatcatgcacctctgtatgccacatgcagcctaccacatatattctagtatatgcgcctgtcacaccacctcttccttttcctctttccttctcacgtactccctccgtccaaaaaatggaaaccctggtttccgtgtccaacgttcgaccgtccgcttatttaaaaaaattataaaaaaaattaaaagacaagtcacgcataaaatattaatcatgttttatcatctaaccacaatggaaaaacgaattaataaaaaattttctaataagccgaccattaaaagttggacacggaaacccagggtttgcctttttttggacggagggagtatagtatactagcacttttttctccttcttttctttcaccaaaatttaatcaaaattttcttttaaaatatacatctagtttatgatctaattataccattaagtttgttatatttgaatttttttataaaaaatctcatacagttatatttttattaaaaatatatgtataaaaatcaattgttgttcacaatttatataaaattgtttcacctcactaatgaaatgcgttccagagaaatgcaacatataaaatatattgactgtaacaatgacaaccattgtatgaaacattaaatacgaactggtgatacataacaaaatcatatgaatatacaaaatatttataaatacttaattacttgaaatattttctttatctcatccatgaagcacagcgttgtaattgttgaaaaaaaaaaccctgctgaaacataaaaaaggattatgtgcaacatttgtacatgaagtagtgagacacccggaattacttattgaaacatttatataataccatatgcaacattaaaaaaaattaaacgtgcaacatagtctaattttaaatgaaacattctcttctcaccgagtgaaacatcgagttttaatggttgaaacatataaatatatgttatcgaaatataatcatgtgatatcttgttttgaagatttaattacaacgaatacttcgatataattagagcttggatcggataaatagttttgaagaaaaataattttaaagaccacgtttcatttacacatcggtgtgaccgtatatatgtgcttgcttgcatgttgtgcatg

SEQ ID NO: 33257 - DNA, 347 bp, Oryza sativa
caatgctgcagtgcctatcgtgagcgagcgatggcaaagaacagaacacccacgactgacaagctcaacgctcagctgcccctacataatcgccgctgctcccgatcgatgtgctgcaccatctcaatcgtatgatggtagagagatttgtgccgcggagctgcgcgattcgcgagctcatcaataccacggtggccactgcacagctccccgacgatggaaatgaaacccaatggcaacagctcttgctacgtgatagtgatttaaccccaatgacggcatctctcctcaggcgaaggtgaggaacgaaaccccaactcctcatggtcgcctccagcgacgcatat

SEQ ID NO: 33258 - DNA, 11778 bp, Oryza sativa
  unsure (1)..(11778): unsure at all n locations
ggggtctgaatctcatgaaaatgaagataaagatgaagattaagtgttttacgtaaaacgaggtggtaataacatgtgattaatttagtatcttcacaagaaaatcatgtacataattaatgacaactacttaagagtctaagagcaagtttaatagtatagccaaccattagctccaactcacctatagttaatttaatagtcaattcatataatggttacctataaacatatactacgctattaatatctggtctcacctatcatacacacatcgcgtcttatagtccgtgctgtaactgacaacaaatctgtagttcgctactcttgtctatcatcttttatcttctcgacatgtatttatagttggtatatattccgctattgtatccgctctaggatattaagagacataacttggtacataaattggcgttgcgaaattgcgcccctagtaagtactagtagtctatttttaccctctagaacacaacggaagcatgatgaagatcattgatgaaggatcagtgataaagctcttcacagacaaactggacgtcaccaattcaccaatctgcccgaactctgaaaccgtaagcttggaaggcgttaggaactactgcatgggcctgatcagttcatcagcacattcgtgccttcttctatcctccatcagtccatctatccaattgaagggagaagaacctacaagaaaatctccggacgatcgatagtcctgcgcgccaatccgcatctctgattctttaggctgagttcgggagcctcctgatacggcgcataattaataaagtattagttaaaaggactttaaaaatagattaacataatattttagacagtggttgcgcttatacgtggtgagtttgttcttctccaatgacacattcacaaacgacgctgagatggagtagatgtggcatagaaggcgcggcggatgaattgtctgctcctagacaccaccgaattgaagtggatgctgttagttgagagatgttgttctttggccacatttctagttaaccttttcttcaactaggaaggattaatcacgcgggcatgcatcgtagattgtgtttgagaaacttatataggagaaatattaaccgaaacatataaaatatcatttggcttgtctggattatctgagaacatttagaaaaaaaacccttggtaattggtatattttatctaattaaaggcactcgatttttgatccagtggctaagactattcatatttcactcgatatgggcatatgtatcttacattgttagtttaattataaagagagatcnattagataanaatcaaatgtgtagcttataaaaaaacactatagttgtttcaatattgattgtttatcttatagtttagtagctaccaaaataaagaagaggatggcggtgtttttttgcatgtgagagggaggaggagatggagggactttatttttctaaataatttaagtgaaaaccgattataatatgtttctttttttctcaaaatttcttttattgcttttataacttttaagacatgacacatgttgacttaatgttttgcaaaaaatatatttaattgacgaaaataatgaatccatcgagttaatatgaattgttttctaatttttaagacgtaacacattattagttgaaagtactctgggatgtttaatcaatttttatcatgtaaacttatttatgacataatgcatatagtcaactttttttaaaaaaaaatttcattcttatttggtttccatgaaaaaaattggagtctacttcaagtgatgtattttaatttatggtaaaatatggataatgatgaacttgaattatttatttagtacaaataaaacaacaattgaaacaaactaaaaatcatatactccctccgtcctagaagataagaagtttctagggttggatacgattattaagaaagtaggtagaagtgagtggtggagagttgtgattggatgagtagttgaggtaggtggcaaaagtgaatggtggatagttgtgattggttggaaaaagaatattggtggagaagttgttatattttgggacaaatcccaagggctaaaagttattatattttgggacggagggagtacaacttttaaaattatagtcgttaagctatctgattattgatttttttatatgatgtgtatgtgtggggatgttcatgtgaacacatatattatgtgtgaagggttggaagtgggccttttcgctttttatactgttaagatatcagttgaaaataataaggacaccgtgtttaacttaaaataatcaatggttaggttttgtacaagttaaattatagtcaacgggtgcattaaattctaatttatgattttaatcataaatagcataattacacaaatataacgtataatttggtctgatagaaaaaaatttcataaagaaaaaaaggaagaggggacatctccttttcaaaaagagaaaaaaatcaatcttatcctgcggcttggagtggtgggcctattaattttagtaaaaattaaaaggctagttatttcttttttctcatcttttctaagattttatctaatttattaaagcgccacgtagtatcataggagtatttatatgagcgtcatgtggtggcttagaagtgtttataggaagtttaatggacttttattatataatagatagatagattgattgattgatattgtcgatataattcagcgacacatgtttgtagaattatttaaggtgacatagtatatgttgtcaacttttttatattttaaaaatatttcattgttatatttggttgccatgtaaaaaaatagcccatagaacaacatagatcttgaattatttatttaattataaataaaacaacaacaaaaataagccatgtaactattgaaattggaagattaggaaaaggtagagaatatgagaggagggagtacgtaacgtacgtactaattggaggagggtaacataccagcgaggaggggaggttgggaccggtaccgtgaagagggggattttatttatttttattactaaggccctgtttgattcatcttaagattattataatctagcttattaggagtaagctgaaataaacaagtagattattatagcagattattgtaatctataagccagattattataatctaataagctgctctaaaagagcttttttcagattatcgagtggctaaagacccactactcctacatacttgagaaaaattacccacctatgccatcaaccgaacagatagctgggggcattatagactttagcctttcaaacccaataatccatgcctccaataatccagacaaacaaacaactcacagcttattctatatcagcttattataatccagcttatagcaatctggtttaataatctagattataataatcataagctgaaacaaacagggcctaaatctaatggttgaaaatattggacccaccaatttaaagaaaaatcaacggttgtattttagagtgccacttgacggcttatgagcgtttgtaggagtgacacatggcggtttaggagcgtgtatgaactaattggaggagggtaacataccagcgaggagggaggtggggaccggtaccgtgaagagggggattttatttatttttattactaaatctaatggttgaaaatattggacccactaatttaaagaaaaatcaacggttgtattttagagtgccacttggcggcttatgagcgtttgtaagagtgacacatggtggtttaggagcgtttgtaggaagtttaatggacttttagtatataatagaagatagatagatatatagtagcagatttttttttaataatggattaaaccaatctctgcacccaaggcaaatgtacacaacatatagtactagatagaaaatgaactaaatatatagtactagatagaaaatgaactagtaaacgggtttttatatgctgctagcgggtttgccgacatacatacattagccgtcataggttacaggagcaagacacaaatgatgttcgcggcgcctctggaaaaggtaaccacaggtaattctaatctatcactaggaagttcatcccgttttcattggacactgaaaattcagtctgcgcctgcgtgcatctattaactggcagtatattatatatttatgtcatattttattagacatctttggtgccttctaatctactccttctagatatagagtaatgtctacatttattgtactatgatgtgttatatcctagtacgtacgaggttagtttttttttttttggacggatggagtatactgattctaccgtgcgatcctgatgaatgttcaacaaacaatattgcatcatggtgcatataaagtgcaaaacacgatctcatgtagtttgcgaacatcatgaacatgaaatttatcaaatctcaagtttggcaaattttgtctgccttgaataaaactattatagatatctagtgcacctgtttgcaccggctcgtgcgactgtcgttccttcttactctctccgtccaaaaaaaacttaacttctaggctttgaactttgtcccacaaaaaaccaacttctaccatctacctaccgtcagcacgtaaaagaataagttttattccttcaatagtttttacctacctatcatcattactacttttttcaataatgaggagcattttgatcattttcactctccaataattttgcattgggatgcttgggactgagggagtagctttttagctagaggcgttattgttggagggtctttatcgcggttcaagtgttgctacagttgagtatgtagatgacaattgtttgtggctgtagctcgccgcggaatgatattaatttgctgtcgtcatggctttttctttttttttcccaccttaataaatataggttatgttcatcctatgcagaggagaggattggtcttagattaagtgtattactatcttgttgtaatagtctgggatataaaattcctttatcgtaaaaaaacatttgcaccgttgcgcagattaataagatccttttcacaaaagagctatgaaaataaaaatgttgtacataccataagcttgccaaatgaaaaaaagaaacagctcaagcaaggagggggctatgttttctaagagattatgcaaaccaactcctggaagacttactgtaaagtatttgccatactgcccatatgggtggtttcaaacaaaaaaggcaaaggacaactgttcttagtttggtttgttgtaaaaaagtaagaaagtaaaaaaaaacttcaagtgctttctgaatccttattgtgaatgagcttcatggaaccaattgcgtgttgccacgttaacattgagcgaactcatgttgactgctgagcaaatctggtaattgcatatctcagctaggtcatgcaagatgaacccaaacaatcgttcttccatataagaaaaaaatagtcttatacaatgagagcatattgaaactcttcctattcaggattaaagaaacataccaaagtacattaaaagcttgaagggtacgtggaaaataaaccattgcatcagaaatagtgcccattgaaacattaaagaatctagcttttcagaagttcaggcatatatagcataggtgtaaagtcaaacaaataaatagtaatttgacaaaagaaagatacttgagatgggaatttatcttacaacataaacagatatccacagggaattgcatgagctagtgtaaatcctaatggcctaagctgaagacctggacaaaccaatcacaacagggagcaaagatcacctgatcaacattagtcaatcccgatataaaaataaattagtgttgaactgacgtcggaaaactaacatggtttttttcctcaacaaacttgctggagtaattaggaaggatcaatcgaacaaaccaacgtaatgcagataatcgtcattttgacaaacggtcagcagctatatataaaatcaagttgttgggggtcaaaacatcggcaaggtaattcagcatcaccgaggatgagaaacatagattagtagttgtatgcacttactgctttactgaatcaaagggctggttagcacgctgcttgagcacgaaatcctcctacatgaacaccatgtaatccaaacttgagatgaatgcaaagaaatactgggaaaaacgtagggaaatcatcaaatatgctccctgacaaacttgtgtccggcaacaatgacgacgccagtggccaggaatcggaagggatggagaagtgaatagattgaactacaggatgagtgagatatcattttctaaaaaaaaggatgggtgagatataagcctttattgggtcgtcggtttctggtgatcgatgatcatggtttctggtgagggaggcgaagaggatgcttttcatgacttaatgtcagccatcaagacttctcgttggttggcgtcggcatttgccgcttttcatgatacgtacgtcgaggaagcgagcagcctggaggagtcactagtaaaaaaaacctcatatagatcagcactataggtgccgaaatagctaaaaccggcacctataatgcttttccctcctccatggactcaaaacacgtaaaaccaacacctttaagcaactataggtgccggttctcaagaagaaccgacacctatagtataggtgccggttttttttaaaaaacaacacctttaatataatataagtgtcggttttctaaaaagaaaccagcacctatccaaattgagccgatccaggccgacgcatcggcctcatcctatattagtctcgtccttatcagcctcatcgatctcttagtctctctctcgcctctctcgatctctctggtctctctcgttctctctcgcccctctctctctctcgcctctttgtgtagcgcacggcggcggtcgggcggcgtcccggcggaggcgtcagtggcggcggtgccctcccctccaccggatccggcggggggagacggcgggagacgggaggcagcggcgccctcccctccgcttgatccggtgggagggaaggcggcgggcgacggcgagcgcccttcgctccgctggattcggcgggaggggaggcggcgtgcgatggtgggcggaaccaaggagagggaacgcatgcagctgttgagccgggtggggaaggtgacacagaatcgtcggggagatggcgcggatgagatgggcccgcccggaggaatgcccgtcgcctgcatgcacgcgggagagttaacgttttggcctatcgggtttttctgtgaatagcgtccaggatgttccactgaggggacacgcaggaccatcgatatttgatcaaacggatatggatcaacctgatgtaggcacacggaggaccatccagatacgattgaatgggtgtgatcaacttgatgacgtggagcaaccacagtgcaggaaattagtaagtggggataatttgtatagatatataggatttcaggcgaacattgggtgatgagccacaacctatacatggcctctaaggccaaataaacgtacatatcttaattagtgctagctcttgaatatggagaaattatgtgattaattaagaccttctaattatctgacaatgagtactatatcatgcaatttaatgcaactattttaaacacaagacatagcttcaggctttcagccaacgaggttttaccttatccctgttttatttttgtcatttcagctcagtacacagattagagatgtagaatcagccaagtacaagtggtccaatacttttatgtgttcatttgttagaattaatgaatcttttttggtatcataaaggcagcgagagatatatatgagaacagatgacatgtatatatatatctcacagtttgcttcttttgttctaggttttagtttcgccattaattctcacaaaccaacatgtgtttcttttatttttttggactcatgcagtcatgctggatgtaggtttgggaagcattgggagattggtacgtgccatcttggctcgagtgatgccaccactccgcgacgactactcctgtagatagtgctgaaatcggagggattgattgtacgattgcacaccaataagtaagccaaccagagggggtaattcgttgtagtactccaaaaccaaaacttatagatgaattaaaagattcccttgaatcgatgaagatcggtctgaccggagttgatgcaggtctgaccacctagaagccaccagtctaactggtgtagtagctccggtttgatcgtcaatcaccggtctaaccgccgttcactcgccgaaacctaagtaaacacaaatcgaaattctcccaaagtagattgaactttattgtttctattcgtgtttataaaatgcaacaacaacaatacggctgtcatttttttttctaaagtaaaatatcattggcagtgcgaacaaatatgaaagtacatctgaagcaaaattcaacgatactatttttatatcactaaattttatattgttaagctaattgctagttaaaattatttgaaatgaattgcatgctgtttgggtcaccttttattaccaacactttggaccaccatttattacctagtgcaaagtgaaaatactgtgcaaattattgtggtctaaagtaaaaaattggtgataaaattttgtaataaatggtgaaccaaattgtagttcactctgaaatttatagactttgactcttgaaattgcgtgggcaccttgtattttctagtggaaggagtagtattatagttctttttttttgaaatttccccaaaatttctttattatttcaaatttgaattggatcgaaataatttcgatttgctagcggaatatattcctagaaaggccaggtatcacggctcaccgtggaaaccggtcggtatttaccgaaatggtgatccttgactatttatgaaaactattatttgcagttctactgacacattacacatggcctctcaaaaaaggaggacatattacacacatgacaatcgatgcataggttcatatgtaccttcacatatgccatggtcttatagtactgaacaaaatagtatttgaacacagatagctataacataacgtggtctagaaattacaaaagatgaacaaagattatctcaatatcttgtctatcacaaatttctttgaagcaacaggtttgggaggtatcaggaactagtgcatctgagctagagagatcagagaacattcttgccctccaattcttgcggttcttggcactctgctcacactggaaacaactgtcaccgcgcattcatgatcactgacgtgaaagaggaaaggattgcacggctaagtgagaagatccaccgatgaaaagacttgcgtgttttcgactcatccatcggcattggagctacaaagagtaagcttgatggcaaacgtagcaacagccaggacataattaatttagatggagttgttcagaacatggttcagaacttcagattgcccacttgacattggtaccatggatccctcccaaaatggtttattatcaatttaattttctcctcatttggttgaaatttgttggaaactcattcaaagttcaaaatcgagtgagatatcaacatcacgtatggacttaaatttcaaaaactgatattgtgaacctggtatagagttgactcaatggatatagtcaatgtgagagaagcatgaaataattctctcttggatagtctctatatctctctatttgtgctatgtatgtagtagtattttctcaataaataactgtaaaatcaatcataagcaacactttaaaatatcctatatatattgttatcacaatttttttgctattaccaattgaagtaaaacttctcgtccataggttaattttttctgatggatctatcatggcatgactaatgcgagccacagagctactaaccaataatttcatccctctggcacatgcacatgccacttatagataaaaaagaagaacatataattaatttgcaaaaaagatatcttgtacattagtgcatatacatttaataactggttgctaacatacataacttggtccataaattggccttgcaaaattgcacccattgttgacttaaaccgggagacgtttatccaactgggagaaggccttgctacgtctcaaaagctagctaaagaggtgagcgacttcctccacttttaacctgattcaattcttcataaactattaatgtaggactattcccgacaccactaataagtactagctagtagttgtatttttaccgtctagaacacacaatggaagcatgatgaagatcattggtgaaggatctatcagggataaagctcttgacagatattctttcaaaaaaaaaaagctcttcacagataaactgcacgcatcaccaattcactaatgtttccgaactctgaaacagtaggattggaaggcgctgggaactgctgcatggacctcatcagttcatcagggcatccttggcttcttctgtcccccaaatttccagttgaagggcgaagaacctacaagaaaatctctggacgatagcttcaggtcccgtcctgccaatctgcatgcatctctgattctttaccagaacgcgtatgttttgaccatccaaagttcctatgcatttgatgtgtttttgaggacagtcatgaatatgaacatgcatgtaaagtgcaaagcatgtcctaatgtagtaacatcatgaacacatgaaatttagcaaatcaggttgtcaatttttggctgccttgaataaaattattatatctagtgcaccgctacaatgatggcgtgtgcacctgttgttccctgtttttggagggccgttatcgtggttcgtattgctatagtgtggatgaaaatcacttgtggttgtagctcgctatggcataatatttttatatttttaattagattaattttatcatcttgatgtattgtctgagatataaaactttctttatcttaaaaaaatatacactgttctgcaggtttaataagctacttttcaaaaagagctatgcagatccagtgatcaactggtattaacaatttgtaaccacaataatgtacatagcttaattagtgctcttgaatattgagaaatgatgtgactaattaagataccttcttactttatatatatgacaaggagtgctatatcgtgaaattgaatgcaactattttcagacaatttcatgatatggtttgtacgcaaggcgtagcttcagactttcggtcaatgaggttatgccttatcccaattttcattttacactctagcatacaaagtagagatgctgaatcagcctagtacaagtggtccaatacttttatgtgctcatttgctagaatgaatctttttggttggtgatcataaacatagagagaggccaatatatatgagcacgcatgtgtatccactgtttgcttatttgttctatgtttcaatttctccaccatcagaaaccaacacatctggttcttctatcttttggactcatgacgtatgtaggtctagaatgcattgggagattggtatgtgcagtttaggatgtcgactgatgccgacactccgtgacaactactcccattgatagtggaagtcagaggcacaattttaaagaattctatcagataataggatcaactgcattg

SEQ ID NO: 33259 - DNA, 9776 bp, Oryza sativa
agtggatcccccataacctacttatccgacattggtcgtgcaattgatatgttccctttgctaaaatctttcgaagacatgaataatctttttagggactgcgcctactctagaagagtctgggatttggtttcataaaaaaaaatccatctaccacgctgaggcagactcctctataaagaactcgatattcaaactaatctcgtcaagaccatcacagcaagcaaaaagaagtcttggagctctactcgcttcctggtgcaacatctagctagagaggaatagaaggactttccatggtgcaaattgcgatgagatggaaatagtcggccacattttagaggacttagaccaatgagctttagcttttaaacctccgtaaaagcggtgttattttccccatgtaacctctcaaaagttgtaacctcctctattctcccttttcccagaaccttttgtacttctgaacttttacttctcaatatatccggcagagctcctgccgtcgtcaatttcaaaagaaaaaaaaatattgagcactaaatccctttaggtccaccgaatcaaaattaggaaatacaaagctgccgcaaaagctggatagaggcaaataatttctattttgaatggtagaagtagaggattcataattgataaacggagatgtgaactgtgttagctcaaaaacatatccctaagatatagtaacgaaacatagatgatcatcttacaggtgaaaatcatctagaacttaatgtctttagtgctctactttctacccaatgtgacataagtgtcgcatgcatgcctaaatcatcctgcacctgcatagtgtcctgaaacaccaatcaggtttgtagatattatgaatcttaagcaattctcatcactataaaaacgtgaacctacatttcttcaaagaatcagatgaacacctactctcttgattctttaatagaacaatacaatttctaatggtaaggtaataatatatcctagtttgtctgatccataaattggctgcggctcaatggctcccctagtattagctctgtacacgtttacgcacacgttgtaaggataaggaagatcatttgatgaaggatcaacgatgaagttcttcgcagatgaactatcaccaattccctgatccgtcttaaaccataggcttgggaggcaccaggaaatactccatctgcttgacaaatagctcgtgtttttcttggctcattctatcatggtagttactctccatcggagaagaacctgcacgaaaatcttcagatgatccaccgagtgcgaaaactgattgccatagtgttcatggcaaccgctcatttggcgaaattgtatctgtgattcttcacctgtgcatttcacgcatgtggtgaatttcaatgtgcttacgtttttatgttgttccaatatttttcttctcacactccatacacaaagatgaacatttctagttgctgcagagatatacttccattggctaaaaacaaattatacttagtttgcacccctagacatgcattcaaggtcatttctagttgatgcagagactaggggatatacttccatttgctaaaaataaattatatttagttgcaccctagacattcaagtccagctagagccataacttggtccataaattgcccatagcccaattctgccccttgtatttattgtgcctttacgttttggagcagggagccctgaaacaacactcaggtatagcaccatttttttacaaatcggtccttttggaaaacttatttcagaactagaccctgctaaaatacttcaaccataaataggccacgctggcgcggaggttagatggatcagcaccagggacgttggcgctgaccccatgctaatgcggcggctgagccgattccctcaccagcgtggcagggctcaacgccaattactctaatgctgagctcttggacttagccactcgcgacggggccgccaaacatagctcctgtgttgagtggtgtcacaccctgaagttctcctcctaagcctaaaattgaatttataaatcaccctaagaaaatgccggtgcaaatcaagagaaaaccttaataaattaatgcaaataataataggaattggcatgtggaatttttcttgagttctacatgtcgaaatacgctaacaagatttttagtggaattttcagagctctcaaaataattttaaccaattaaaattgagcacatgcaattttaatcccaggaaaaatcctttttccttctttttcctttttctttcttttcttttctctttttcctttgaatgggccgccggcccattcctcctttttctccccctcctcccgctgggccggccgaaggccaaggcccagctaggccgcgcgggccggtcggccgcctcctctcacccgggtcgccgacaggtggggcccacctatcggacccgtctcccacctcgcgccgcgccgccgcgcccacgcctccgcctcctccgggccacatcggccacgcccgcgcatgcgccgcaccttccgcgcccactcccctctctctcccacccgcgcctgcgcccgagatggccgggattcgattttcgaatcccgcctctctctcctcccccactccccgcgttggccggcggaatcctgcccctaccggccacatccgggattcccctcccctatttaagctccgccgtcgccccctctctctttttccccatttcgccgaactccctcgtgccccccatcgctcccgcgccgtgcaaccacccgccgccgccgcttccgttactccggtcgccgctagccgccgctagggtcgccgccgcaccgcgccgtcgctgccgtcgggttcgcgaggccaaactccacctcgtccgccccttccccgtcgggattcgtcgccggaattcgcatcccctcgcgctccggtgagttctacctctaccgccgccttcggccatggatgccggccgccgtggttcatctccctctctctaatctctctctcctccttccttagggcaccccgaagcccgtccgccggttgccgtcgtcctcccgtggctcgccgtcgccgttcgccgtcgtcttcctccgcgccggccactctcggtgaggcatccctctctcctctattcccctccctctccttcctagccgccgcttagcgccgccgccttcacgtcgcctttgcgccgccgcctccgccgccggttgccgtcgccggcaacgcgtgcgcgcgcgccgtcgccatcgccgtggccggtcggccggccttgagccgagccgagccgggtcgccgccgcccgtccgatcagccccgggggcgatctgggccgtcggtcccgtggaccggcggtggaccacccgcgtggtcccggtccacggtggaccgcccccccttgagccgctgccgagtggggcccgcgtgccggcgccccttttccctctctcccgagccgctgaccggtgggccccgcatgtcggcgccgcgccccccttgatgacgtcagctctgggaattattgcgcaataaattatttaaggactttctgttatagtaataaacatagtgaatcttctaaaattcataactaattcatccgagctccgtttaagcccattcaagtctcagtaaatcaagaaaaatgcgtagaatccattaaaaatggttttgttctctgtttcagtagtcttatagcctgtttgtattgtttgctttgtatgtcgcctagattccggttcttccgacgctccggtgtacttcgagatagtcgccgaggttcttccagcagcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatgggaaaatctcatttaaaatatagactgtaggttcatatgataatgttggtttagtaccaccgctttggtgttggttaattaaaatgaatcacatagagggctatggatgcatggttttgcttgttgcacccatagcaattaaggaccgattcgcgggaaaccctggaagaatttatcgtgcttaccacaagccagcgtgggcaacggctgggcttgtagtgtagcttttctctagctgacgcatccaggcaagggtgggcgtgatggagtttggataggtcctgcgacggcctatgcggcttccggattcacgtaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtcttttgaaattggatagtataggtggatggttgggcctgtcgcaacgtggtatagcgttggacagtggatgattaatattgattaattattacgactgttttcttctttaaaacttctatttataaatgctcgctttatgcaaatgaaccactctagctctcctttgataattccctgcatcatacccctattccggtatgacttgctgagtacagtgggtagtactcagtcttgctctattttccccaaccccagagttcgagtgtgtgtcagatggaggtttctccgaggagtaggcttcgtccgtgccgtcgaggatgcctgtggagtggtgttcccgttgcagttctagtcaaggcttaggtcctgttgtctttcgtttttccactgcttttatgtaagacttttatgatgtttgtaagacgtggatctgaatgtcaacattgtcgtttgtgtaccccggccggtcctggacggggattttaatgcacattctgcttggaattctatttgggaatttctgggcgtgacaagtggctcggaggcgatgggtgttaagccactaatctccatgccaattactctgacgctaagccctaggagttagccgctcatgaccgggccgcccaacacaactcctgtgttaaggcagcccggaggcgctgagcccgcaaacctccacgccagcgtaattggtgctcaccctaaagacctcggcgcaagctaacttggcactgagatttgggacttagcagctcgcccgcccaacacagctcctgtgttggactttgtcttgagggttcagcgccaatacacgtgttgctgaggggaatcggctcggccgccatgtggacaggggggttagcgccatcgtgcttggcgctgaccaacgcggttggcgctgagcccacgacctatttatggttataatttgcaaggtctagtttgaaaataagttttccaaaagggtctatttgtaaaaaaagagggtatagagcactataaaaaagtgaacctacacttctcaaaaggatccgatgaacactacattctctcgattcttcagcattacaatttccaatatatgctaaggtatcatcctagtttgccttgtccataattaaattgggcatggctcaattgtgcccatagtattagttttaaacgtttatgctctagagcacataatgaaaggataaggaagatctatgaagaatcaccacatgtacatcacaattcgccaatatatatattctatctgaaatcgtaggcttggggtgcgttggaaactactccatcagtttgaagagagaaaaggggtattcttggctcgttctgtcctggaagcctgctttggatgggagaagagcctgcatggaaatttccccgagatggatcgactgcaaaaactggctgccatactgatcatatggacatagaatcgcttcaggtcatggtcgagtaatatgcatcttcgatatgttatgtaccttgtcaaccttgtgcatttcttgcatttgggatcatcgaatgtccaatatatgcatcgattgatcttccaatgatattcggtacgcttccgataaagttaatcacagccatcattaggatgttcgtctcgccccattggacatccagagagttcggggctgtgatcatctcttaattggcagaacacttacagggtttacaatttcgaaatggggatttttgctggggcctccgaaattaccgaagtttcgggaatttggtacttttttttgctgaaattatatgaaaatttgacaaattttgaatgaatttgaataaactttgaccaaattcataaaaaattggaaaaaaaacgaatgttcagtaaacaatttaatttgcatcatgaacaaatgcatgtattaaagtggaaattgcagaccacaacctgctgctgttacatggatcatcaattcttgatatccacaattaaagatggccatgcttatcattaattgttggtaaaatacatagaccaaatgatatacttccattatctaaaaataaatcacacttcattaatttgcaccctagacataaaggtcagagagatacaaccttgtccataaatcaacaatggtcagattgtgtccctcgtagtactagtagtagataatttttacttcttggataattaaggaagattataggactaaggaatcattgttgagctgtatgtgcatcaccaattcatcacaagtctgtctgaaatcgtaggcttgggaggccctgggaactcctgcatgagccacagcagtagtatgaagaattcttggctcctcctgtcctgactgaacctcctgccacgcacaagaatctacaagaaaatttccagaaaacaccatggatgcaaacaatggtttgtataatgtgcaacattaaccccctgaaggcttcatcagtcgatttccagatgactaggtagccatcggctcctgcctatttcagggtgacagttgttcctgtgcatccaatgtgcatgcatgtcctgcgacagttgttctgtatatgtgatacactgctacatatgcgtttacgagtgcaaagcacaacttggtgtagttacttacatcatgaacatgcaatttggaaaaacagggtttgacaatttggctgccttgttgaacttagttttctagggctctcgttcctcttactccctccgtctcaaacatactttgatcattaatttatttcatattatgctatcaaacaactataaaattaatatcacacaaaagtatttaaaatacaaatcaagtgatataaaatatataatacttagcatagatattgctagtataattattagtcaaaatttactttcctagaaacaagggcaccctgtaatttgggggcggatggagtaaataacaattaacctgatgggtcaatcatagcatgcatataatgctagccacagagctactaacacattattacacgtgccaatcacacgaataggtgaaagaaaaacatataatttattttcacaaaaaagaaacatatacataattaatagcagctaaggcacatatataacttggtccataaattggcctttgcccaattgtgtccctgactagtagttgtacgtttatgctctagagcacacaatgcaaatacaatgaagatcttctcaggaaggaccatagatgaaactcttcacagataaactgcacccaattcatcagtcaaattaaaattaatcgtagtcttgaaaggcaccggggactgctgcatgggcctgaaaaatgcatctaggtattcttgcttccttctgtcctgtctagttccagaccaaagggagaagaaccagaaaatctccagatgaagaacctgatttagaaactagttgccaaagtgcggatggcgaaagcttctgccccagttctgcgccaacctgcatctccgattctgcagatttctttttctttttttttttgaggtgaacgacggcaagagctctgccggaatttcattagagtagagaaaaacagttcagagaatacaggggaagacatcgaaggaaaagaagggagaaaccggaaaaaaacaaagggaatccgaaaaagaaaagacaattaggggggttggaaagcagtgtgtctgagatcaaattcctcctttactattctcgcaacgcgatcctctgtgtaagagatgttttgaaaaattcttctgtttctttccaaccaaacgttccaccaagtggcgagaagagatcctttaaccctgaatttgaaaggtttggggtgtagttgattgagatcagcccaccaagctgcgttgtcatctgcaggctgtgcccccgagatgttttgccattggcacaccataagccaaacttttctgaagaaggggcaaacatttaagagatggttagtgtcttcaaacgcctctccacacaggctacaaatccaattgcaaggccagtgccggcgcaaaagattttgggccgtgagagttttttggtgaaggattagccatccaaagaagcgcatctttggttcagctgggcacctccaaatggaatgaaaatgaatcgaagagaaggacccttggaattgaaataaataagcactgtttgcagagtaggatcccgattcattcaggttccaaatgatgctgtcattggtttgcggcagaagctgaacattttgcagcaatatcccaagctagacaagatcgttgatttcttcaattgtagtcatttgccgaaaggaaaggagccaagaattgtttgtcaattccgttttaaccgatctctgtttgcgcttagctaggttgaaacacaagggtgcaatgtcttttggacatgcattttgcagccacttatcatgccaaaaatttattttttctccattacccacagttatcgtagtggcagcttgatagagtcttttgtcgcagtcatcgcaaggtaaatccattccaacccaaggcttgttgtcctctttccatttgaaccagagccatttgaaccagagcgcgagaaaatttctcaaggtctgtgtaacaccctgaaaattcgaccgacaaaatcaaaactctaaaaatacggattttcaaaaactttttaaactaattgcatcatgccgatcttattcgtctattttatctggatttgatctcgaagattattaatcgtgagtaaagaatagttaattaggaataaaccttaaaaacaaattggtaaaataaatacaaattaaaataaaggttaggtgggggtagaaataaataaaatattatcgcgaccatatttggattaattaaatttaaatgcgatggaataagaattaaccctaattaaaactcaaataaattatataaaaataaaatatgagtaatattaatctaggataaattcattagttaagatggcacaaatattgagtatacttcatttatgcaaaatttgggaattatagaatcaaatttaaataataaatgggccaaaaatcgggaaaaataggaaactacactgttcattagcctctaggtgctcgacatggtccccctagccccgccccctcccgtgccgcacgcgccgcccacccgcgcgccgcccgctcgcgagccgctcgcccgcgccccgctcgcccgccgcgccg

SEQ ID NO: 33260 - DNA, 17123 bp, Oryza sativa
cgccgccgccccttcccctgtcctcctcccctctctacaaatacccctcccctctctccattcttccccaccccatctcacccttcctcccctctcccctctccactgcgccgccgttcccgtgccgccgcgccgccgttcccgcgccgccgtgccgtcactcctgtgccaccgtgccgccgctgctgtgccaccgtacgccaccgtcgccaccgccgtcgtcgccactgccaccgtcggtgagccgccctccttccccccctctcgcgtccaccgccgccaccgctcgggtaggagggagagccgagagagagagaaagagagaaggagccgagagagagagaggaaaagagagccgagagggagaggaagagagaaaagaaagaaaaagaaaagaagagaaaagaaaaaaagggagaaaaagaaaaaggaaaaataaatagaaagatttggaagaaaattagggaggttaatagtttaggaaatttaaaataattagaatttaattacagaataatcatggtcctagaattgcaaaatttaattattcttggtaatttctaaaagaaatcagttcacagtagtaatttagatataattaacaattagatgaagttttatagactattatagatcatttctggataatctttataagtaatcgattcacggtagaaattcggatttaatcgctaggaattttagacgtatattatatttaatcgtttagtcatagactaaattaaaacgtataatattataagataattttaggattacgtcagatatttagctcgtaatagaaatttctagcctattatatggatataatgctcgggaagagtaaattaaaaacttatgacaacaaaataattatacccgcaaaatagtttaaatcgaaattgggtttgccgtagttcgcagatagtaaagttaataaaaaggaatcgactttcgcattcgactttcatttggatttatttggatttttatttgaattctaaccgaattcaaatcaaattttgcacgtaactatagagcccgagggagttgcggatccaagcgaaggccaagacccgcaagactttgagcaaggcaagtcatcactattccttgaacatgttgatcccaattgcgaaattgttttatttacaaataaaattgcatgcaataatgaacatcccacttgtgattatgccatgccttgattattgtttacccttaaatctttgtaaccatgtttacgtatgagtcccgagtcaactatgacaattgcttagaaatgctattctagaatcatgcatactcatatttatcaaatgctatatgcttgggcaattacctttgggaaggtaattgagatgcggcatgtggagatatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatggagttaagcatgaaacgacccccgtacagccgcacttcttgtatgggtatagacctagcggattagatagccgagtggaggcagtatccctgcatagatggttcacccttgagtgaggcaggtgcgctacggtgggacagccgttgaggtagggccgagaggcgtgccctacatcggtgtcgccattggtaggactgccatgagtgtgtgtgagagagaacttaacttgaaccataatttaatatgtgtgagacttctctttcccgggagcgccagaactcctctcactgctagaaacatggacgcctagagtgcatgaggattgaagttcatggagcgggtactgccaatgcgaggttatcgaaaagctttgccgtgacgcgtctcatgtgttgggacgaggctcatgtgttgggcagtcgcggagtgtgggtaaagtgtatatccactgcagtgtgagtaaaccaaatctattcgaatagccgtgctcgcggttattgagcaccgggacatgtattacacttggctagactctaaattcttaacttgtgggggatgggatactgcatgatgaattttatgctgatggagtcacatcccgaaaggagggaaggtggacatcctcagaaaaccgtgacgattcaatgacgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcaccattgctgtggtggcttgctaagtacggttggtactcacccttgcaaatataaaattaatcagaagcgggagatgaagcctcggaggatccctatgcctactaccaggagggagatgaagatgatggcgctcagtaggtcttagtacggtcgttgcctgtggcaatggcatgccgctacctgaattccgctgccttatctatttctgcttttggatgtattccggaccgcacagtccgatgatttaagactgtgcctgcgggcttatgatgtaataattcgtactagactctcgtgtatgtgcacttgatatttcagctatgagtttgtgtgtaccagactacttgatccagggaaatggtactgtttacacgattgattcctgttataaaaacgggggtccacagtctggaattccaaggactcctaaaatttttggtctacagactgtaccccaatttaccaacctacttcccggatttgttttgtctgggtcttctcccttccataagaaggatctgcggtaacgatctattctgctgattacccatttgggagcttgaagggcagttagatgaaaggtcggcaatgcactcaacactgattgcacaagaattcttctcccttctgacatgaagtagcgttctttccagccagggagacgcgatccaatcttttcaattagaggcaagaaatccactttcctaagctttcgaaaatgtaaaggtaagcctaggtagcggcaggggaaggatttcaaagttccagggaaaggagtaatgacatgtgtcaagtcggtggtgtcgcaacggataggatagatttcagtcttgttcaggtttgtgtggaggcctaaagcttgggcaaataaattaagaacccttttaactgcatcaatctcaatagggtcgggcttgacaaacaaagcgacgtcatcagcgtatagagagcatcgaaacctgctaaaacgccctccaattggagtgagcagggaggcctcttccgcaacttgaaagagtttgtgcaggggctccatagcgagatttcatagtgcacatttgacatactgagagttcctgtgtgtgccccaatgcttctgtacattcttcaggacagtgaattccaatgcacatgaataatacttgatgagtcatgttatcatcctcgaacgacatgttcaccaagcatatgccatacatgctcgtttcgtcttattagaaaaactagtacagatatgcaaaatacaagtcatgcttaatttacattttaattaataaaacaagtcacgataaaataaatgatgcttatggttttggttagaaaattttccttttaccactaatagcaaccatattctcattttcaccatccaaaactttgcactcctcttttatcattttttcattggggtgttgtttacacccaaatttggcacctagggataaaatagggaaaattgccaaagtttggaagtctgccggttttcctctatgagggctggtctgaccgctgtgtataggccggtcagaccggcggtgtgtggccggtctgaccggcagactccgagtccgggtctgttttcgtcgggtcgggtttccttgctcgggaaggcatgtttcgggtttcctttggattctatcccgagttgaacatggaggagggcctgtagagggcaagaccaacccctatataagggggtaaggccaagaccaacccctatataagggggtaaggccagttcattgtaacaaccaatctacaatcaatcaatcgaatcgtttttcatattgcttttagttttctcttattttgtccatctttatcgatttgcgccgtaaatcgtccgccgccgctgcgagagtgtgacacctctttgtaggtttgtcctgaaaaccttccgttttgcccacgagacaggtagttatctagaataggctccgctagccggtttagttatcaaaacccatattggtttagcttttgctagattgaggtggttggtgactctaggatcaccgcaaggcgtttaggtgctgcgatcgtgcttgtcaacttgtcacaaaaagttgccaacatgtgcattttaattttattgcaatgaaatcaatggcagttaacctctgatttgaatactaaaagaccattatgtcctttagatgttcctaaacaaaacaacacttaaaattctagcaaacaccataaaatatcagaaaaataaaccgtggatacttaaatatattaaacattcagaaaaatttaggcaggggaattaagtagttttatttttttcgataaaatgcaccatgggttctgaataatttggttcttaaaatgttcctcaaaataagtatatttgggaattatctggttttatttgttggaaaaatgcaccacggcctagaataatttggttcttaaaagttccacaacataagaataacatggaaattatgtacatgcccataaataatcttgaagaatattgggagcttacgattcttatatgcatggatttggaaatatttttcatctaaatatttcatttaagctactgtagaaaccttttgaaatttgcagtaagttttcaaggagtggcaaaagagtgtaaaatcttgatggtgagaaagggagaatattgtttcaaggaatgacaaaaataattttttcctatttttctaataaaatgaatggtcgaatgcatgtccaaaagttaaagcatcatatttttaaaaacagaggtagtctatatggttttagtcaataaacacatatattattccaattcacctcttcaatgcatagagtagagccatagagtacaacacaagtactagtggttcaatacttggggatgctcaattattattcggtcagagatcatatattagcaatgagcatggttgcatctcaccatttgcttctatcgttcctaggtatcagtttcatcatgctcagagactaactatttctcgcgccggtggatgtgctctctccttcatgtaaccccacaatatccaaaattgggctcgtggatacaaacagaaatgctgcgagacaaacactggacaagaaaatatctgtgtcttatgaacaatcacgaccaatttcacaaaataggagagcaactggagcaaagcacagcgaacagttacgtccatgctgtcgggtgaggaggcaatcatcttctcattgtgattggagtgtggtctacatcatttgatggctcaaaaacagcatacacttgattcaacaccttcttaagagtttgcttggaccttcttcctttgtacgtacttttaggcttatcatcattgaatttgtctctattgtcttatttcttggctctcccaagcttgggtcagtacgaatggatgtgatcaagctctctatactcaaagcaatgaactcaacctctgctttttctaaacctgacattgttcatagctcgagacaacttgttaatagccaaagccaagtcctcctccttgaattgctcaagttgatcatccgacatgatattaatagtagaaagagtagtagaatttgatggagtactaatatccaaagaagtcgaaggagaaaccaaaacactagatttagaattaactttacaagaaagaatattcaagtccagtgtccaaacccaccacctggtcaagtgaagcccagtctgttgcgtggaaccaccctgacgacacttttgcagagaggaccctatcttatatcgcagccattaatattgatcataacgttttgtactagagaggaccatgttttgatggaaatttagcagaaaaagacttactgtggatcgtaaaggactagggatgggaagcctagttcaattggaaatgttttgctctggagagaaaaacacgatgttgtttgcctgttgcattatcaaccagtgattgattggaaattggaaatgtttttgattttgttcaggagtatttggtctttaagtaagactgctttttctaatgacaaatcgattaactctaatccattttaaatatttttgttctatttaacgagtatatatcttaatggtgcacagtctagcactaccaatccacagtagtgctcatagcccaaattggtacacttgttttgtttggaaatttcgaaatgagacatgtagaactgtagagtacaagtactgagtggtgcaatacttgcagttgcaggtgcttaattacaacatagaatccttttggtcagagatcgtaaatgcatctatcatatatgaaaaattgatcatggtttatgcatctcactatttgcttctatcattcctaggttgatcacttccatataattcttggtgacaaactattatttgctccgatggatgtaaaaaacctgtaggcatcataagcattgggaggtcaatctgtgcgatgggtcactctgagggatgcctgccacaccaaaattgggcccatgtttacggttgagcaaaaatgctctcaaacagacactgtacaagcaatggcagaatcagcgaggaaaatcagcaaagattcaacaggatggaagagcacctggtgcaaagtgggatccacaactatatcatcaacctaggcttcttgatttagatcagcttggtgctctctaagaaactattagagtttgtgtcaaatatgtgtatgtagtcggttatagtttaggacttggagttgtactaggtataggattatagtaagagtcagactctatcctaggatctctcataaatagagaggcatgcctgctgtaaccgcatggcgacttagcatagcgagagggagcggctgccggcggcgaccggccgtgagtcgttgtaactctaatacactgtgtatgctggatcggggagaagcgcccgtaatcagtgccccggagatgtaggcctcggctgcactccgttatcaaatatcgtgcctcggtgtcgtcttcatgtttagatctcctatggtgtttcttccgcgttttgtttctaatgtgatttcggggccggttttataacagaaacttcctaatcatctgaagaaactttgatcagtgatctgctgtctatcatatataaaaagggatttatctcagtgaaaaaaattagtgtaaatttccctcagggaacaattttatatgacttttacaacacattattttagtcagtaagcttatgtcttcttttacaccgcaatttacagggaagaactatagagatagagtacaaaaagatgcagtggttcaatatttgcagcttctccattgctggtttgaatctttttagtaactcaattcttaggtttccatgtctaacgtttgactgttcatcttatttaaaaaaaatatgaaaaaaatttaaaaagataagtcatgcataaagtattattcatgttttatcatctaacaataatgaaaatactaatcataaaaaaatttcatataagacggacggtcaaacggtctttttgggatagagggagtacattctaaaccctgtggaagagaacatatatgagctatagtgagcatttttgtatatgttaacatagttttaagacattcagtaaagggacctatattgacattcagcttttttttatctttaaaatctgatggatgtaagaacctctgtagcaagtcacatttctagtaatggaaatggagtcatccttgcccttgctctaaaaaaaaaaagaggtgatcaagacacctaattacttgacatgcttccgtgaccgactatctgcgtcgtcagaaaagtgctatatcatgcaatttaatgtaacttgtaattgatgcagagaactatctcctatgacttccatgagagagagttccagacttccaatcaattagcttacgctttatgttccaattttttgtgaattctataatgaaattggggattcaacaactgattgatctacccctaaaatataaagggacccaaatataaatgtgtacaaaagagatgcaaaaatactaaactacccctaatatcttaacacccccactcaaatacaatgtgtatacaatcatattgcatttggagtgtaaactaaacatgagaacacaaactaaatattagcctatctccaaagtcttgatgatgtcgtcgaagtgtgccaattcttggatgataaagaagaaaagatgtatccccttctcaatgaagcgcaccttggagccttcacaaactgtttttcggccctcggtaccttgaagccttcacgaaccgttcttcggctcttcattgattcgaagatgttgttgatgatgatgatgacaatggaccttcacaaactgttcttcggaccttcacggattgatgatgatgccaactttgatgggaagctagtgatgtgatgaaccaactccgatggggagttggtgatgatgatgcgatgatgatgaggaccagctccgacagtgagctagagaagtgatagaataccatgacctcgatgaattgaaaatatgtaatggacttggatggaatgtagatgactaactaccaaaagacgctagcaaatgacataggatgtgatattagcagcagaatagatgctatagcactacaacactgtggcagatggcagcgacaagcaagcacaataactgaatgtctatgtgatggagcacaagctcgaagacatgaaaacaaatcatcaattttgacagattctgcaactaaaattaagtggtaatcaatggagctaacatagcaggagattagtactaaacgaactactcaagacgtacaaaaggttgtgacattgccacgaagaagttggcgactgtgattggaatgcagcagctgagcagcagattagcaacaaagagctatcggtgatgacggattgcacaaaaggggaaaggggaacaggaccaagataggaaaaattaaatgatccatagatgggtttctagctttctgctgctttgctcacgaaggactctcccgaagcctcatgcggctgggcgacaagcagacaaccccaacggccacgctgctgaggatgacgaccagcgtagttggggacgacgaaccgcgtgacggagaacgtccatgtggacaaccaacgacaagcttaccccagcaatggagatgagcagcgacgacctcggtgcaaggacgcccggccaaaactgcagccgttgcggacgacggcggcggcttgccgccgatggctaggacaagtcccgtgacctgaagaacggtggggacgagcggcgtggataagcgacgcgacgggcgtggcagcgagagtggatggtggagaagcgggcacggcgccgcgacggacggcggctgcgaccggcgaacgggaacgcggtgacggcgatgagccgcgcgcgggcttgctgctaggagacgaagatgacgactgactgctgctgctggatgaagacgccgagcgatggtggacgaggatgaatgacgacaacgatggctcgccggcgatttggcagctagggtttggggagaggctctgatatcatgtgaattctagaatgaaattggggattcaacaactcattgatctacccctaaaggggaaatataaatgtgtacaaaagagatgcgaaaatactaaactacccctaatatcttaactttttttttcttctcacactccatacacaaagatagtcatttctagttgatgcagagactaggggatatacttccattggctaaaaacgaattatacttagtttgcaacctagatattaaaggccagctagagccataacctagtccataaattggccatggcccaattatgccctttttggagcagatcaccttgaaacagcactcaggtgtactaccaaattataaatcttgagcaattagcagcactataaaaaggtgaacctacacttctcgatcaaaaggatcagacgaacactttgctccctcgaggcctcgattcttcagcattacagtttccaatgccaaggtatcatcctactttgtcctgtccatataattgaattggtcatggctcaattgtgcccatattattagttttgcacgtatctgctctcgagcacacaatgaaaggataaggaagagctatgaaggatcatcaatgaagctcttcacagatgaaccacatgtacatcaccaattcaccaatatattctatctgaaaccgtaggcttgggatgcatcagaaactactccatcagtttgaaagcaagggaaggtattcttggctcgttctgtcccagaagccaagctttggatgggagaagagcctgcatgaaaagttctgcaagatggaccaaatggaaaaactgtctgccagagtgatcgtatgtaaatagaatcgcttcaggtcatagtcgggtaacgcgcatcttcgatatcttctgtaccttgtcaccttgcgcatttctcacatttgggatcattgagtgtccattgtatgtatcgatcgatattccagtgatcttcagtacgcctgcgacaaagctaatcacagccatcattaggatgttcttctcgcaccattggacgtctagagagttcggggctgtgcttatctcttaattggcagggcacttacagggtttacaatttcgaaatggttttttttttgctagggcgtccgatatttcgggaattttggtattttttgccaaaattatttgaatatttgacaaattttgaatgaattttaataaactttgaccaaattcacaaaaaaatgggggaaaaacggatgttcagtaaacaatttaatttgcataatgaacaaatgcatgtagttaagtgcaaattgcagaacacaaccagctgctattacatacatcatcaattcttgatatccactccccacaaaaaaaaaattcttgatatccacaattaaagatggccatgcttatcattaattgttggtgcaatacatagaccaaatgatatactcccattatctaaaaataaatcacacttcatttgcacccttgtccattgtccataaatcaacaatggccagattgtgtccttcgtagtactagtagtagacaatttttacttcttggataattaaggacgattatatgactaaggaatcattgttgagctgtatgtgcctcaccaattcatcacaagtctgtctgaaatcgtaggcttgggaggccctgggaactcctgcatgagccagatcagtagtttgaggaattcttggctcctcctgtcctgactgaaccgactaccacgcacaagaatctacaagaaaatttccagaaaacaccatggatgcaaacagtggtttgtatgatgtgcaaaattaacccctgaaggcttcatcactcgatttctggatgactaggtagccatcggctcctgcccatttcagggatcaagagttcctgtgcgtccaatgtgcatgttagttggtcaggaaagcaagtgtccaatcctgttacagttgttcagtacatgtgatacactgataacatttttttaagataatgatacaccgataacatatgcttgtaaaagtgcaaaacacaacttggtgtagttacttacatcatgaacatgcaatttgtcaattaaaaccagatttgacattcaggaatgcaagtgtccaatcaagtaacaattaaccagatggatcaatcatggcatgcatataatgcaagccacagggctactaacacattacacatgtcaatcacacgaataggtgaaacaaatgtaatttattttcacaaaaaatgaaacatgcaaggaattaataatagctaataagacacacatataactttgtccaatattgtgtccctggctactagttgtatgtttacgctctggtgcacgcaatgggagtatgacgaagatcttctcatgaaaacgaccatagatgaaactcttcacacagataaactgcagccaattcatcggtcaaaatcgtagtcttggaaggcaccgggaactactgcttgggcctgaacaatgcatctggcattcttgcttccttctgtcctgtttagttctggatcaacgggataagaaccagaaggtctccagttgatgcactggatgtggaaacaggttgccacagtgggtgtggcgaaagcttctgcggttctgccccagttccgtgccaacctgcatatccaattctgcagttctcatcgtgcaaatttcacacattgagagttcctgccaatgctcctgtacgttcttcagggcagtgatccagttttgatgcacgtgatgagccgtgccatcttctctaatgacatgttcaccaagtatgcccaacgctctcatttcgtcttatgcaaaagcactagtatagatattaaaatacaagtcatgcttaattgacattctaattaatgataaaacaagtcacaataaaataaatgatggttatggttttgtatagtaatttttccttttgcattgccaataattgcaaccgtattcaccatccaaaatttgcatgcacttctctcttttaccacttttctgttaagttaggtgcattgttgttttgctattgtcatcaaagcagtggcagttgacctttaacatgaatactaaaagatcattatgccctttagatgttcctaagcaaagcgacacttaaaattttagcaaataccataaaatatctgaaaaaaataaactgcagatacttaaatatattaaacattcagaaaaaaaataggcaggggaattatgattaatagtttgttctttgattatcattttgcccacgcggtttggtctttaatcaagtttgcttcgaatattagtttacctaatagtacaactcatatgtttgggcattggataagaagacaaccgcacaatttgagatctttggtcttattaaggacaactaccactatttggtctatttggctttgcagaaatgatgtggtttttcaaaggaaaaacatatcttctcctttacaggttattttttttattacacattggctctgctcatgggctatccttcagaaggtcaatttgcggggtactatcattgcggcttgtcaacaattggagctagtggccatggagttttctaccccggcacatgggtggcgttctaggctacggttagagggctcctgaagttctttttgttccttctattttggatgatgagtttatcttttgtttcttttttgttggctgtgtgcactctttgcgtgcaaaagccggaggtgctctcagaataattgtatcacttgatgaaatttactgagatcaataatgcttccattatcttaaaaaaagaagaggacaagtactgagtggtgcaatacttgcagttgcaggtgtttaattacaacattgaatctttttggttagagattgtaaatgcatcgatcatatatgaacaattgatcatagtttatgcattctcactattggcttctatcattcctaggttgatcactttcatataatgcttggagacaaactatttttttgctctgatggatgtaaaaaccctgtaggcatggtaagcattgggaggtcagtctgtgcaactggatttttcatattttggtccttttaaaaaacttatttcgcaaatagacccctagaaaaacttatcccaaaaatagtccttttgggggcgccagagtggacggtgccagcctctctggcgccgtccccctgccgacgtggcggggcgatgctgaggtggctagggagtgcgccagagtggctggcgcctccccccccccccggaaatttttttatttttgttttatttgtttgatatttttttcacgcttagggacacacaagaaccaaccatagaaaaattgaactcaaatggacgtaatatgtgacctgtagaatttttcctctcctctcctctctctccgaactagtgcaaaggagagatgtgcaacttttttatttttatttaatttttttatatttttttcacacttaggaactcacaggaatcaaccatgtaaaaaataaactcaaacggacgaaatatgtggcatgtggaattttccaaagttctaccgaaaaacttctctcctcgaaaacacaatcttgcaagtggaatttggaggttttaatatttctgaacccggcagagcgggggagaattggatataactttttctgtagatgtccgtgcatatattatttgcctgattccaagtccgtatgagaaagttacgcctattttaatagatgacatattttgttcgtttgagtttattttttatacggttggttcctatgttctcctaagtgtgaaaaaaatatcaaaaaaatgaaataaaaataaaaaaaattgcatctctatatactgtttaacttatatatgtcatttcatgtggttatattttgaattatattaagtaatttcatatagtggtagagtgcattatgtttaacatgctgatcaaagggttttactaaaggaattatggtctaattttagtgaaggtgcaaagtagactaagtggtatgctagctattttcagacttagctaagtggtagttcgagtttaaattttttttgtggttggttgtatcgtgatcctaagtgtgaaaaaacatccgaaaaaataaaataaaaatgacaccgttgcaactccatatagagaaacaggaatggaggcggcggcgctagcatggctggcgccctcctcctgccacgtcggttcgcgtgcgccacagtggcagaaggacggcgccagcctctctggcgccgtcccgttggatgacggcgccagccactctggcgccaaaaaaggaccatttctgggataagttttttcaggggtctagttgtgaaataagtttttcaaaaggaccaaaatgtgaaaaatccaggtctgtgcaactggtcactctgagagatacctgtgacaccaaaattgggcgtgtggttcggattgagcagaaatgctctcaaacagatactgtacaagcaatctcagaatcagtaaggaaaatcagcaatgattcaactggatggaaaagcatctggcccaaagcgggatgcatgattaaattatcttggtgctctctaagaatttctaatcatctgaagaacttcgatcagtgatctgttgtctatcacatacaaaaagggatatcccagtgcaaaaaattagtgtaaatttccctcaaagagcaattttatgacttgtacaagacattattttagtcagtaagcttatgtcttcttttacactgcaatttacaaggaagagctatagagacagagtactgaaagatgcagtggttcaatatttgcagcttctcaattactggtttgaatcttttaagtattggattctaaatcctgcggaagagaacatatatgagctatattgagcatttttgtgtatgtcagcatactgttaagacattcagtataggggcctatgctgtcatgatcaatgggccttgtaagggacattgtgtgtgttgggccagctattgggccatctctataagaaccgagccaacagcacgggtgtgttataaaccctgtgtggttggtgaagtggggtatcgaagaagagaaatgataacaaactactaccaacctctctgctcctgaattctccttcttcctcctctgttcttccatgtttcctgtgacgattccccaaatctagagccacgaaccctaggatcgtcacattttggtatctttcgatctggcgcgcaagaaatcccagcccaccttgacggagaggatgtcgattgctgaaggagaagttgtcaatctgaaccagaaggtggtggatctcagcacgaacctcgaccgcatcctgggatcgctaaagggtgtggaggcttggattccaagcgtcgacgctggaatgcaaggcctccggcggtcggtggaaggaatcaaggcgcgggtcatcaagctggaggcccagtcgtcgacggcgacgcctccgccaaatgggcaccgcgtggacaacaagtaccagggtgaagcgactgcggcagagtctgcccaggagcgaaccctggtcaagagtaagatccaaatccctcaatctgcagttaatttcgaagttggggagagttcagagtgggggattgggaattctcaatttggaacacaggggcctagattacctaaaactgaattccctaagtttgatggagataaccctaagttgtggaagaaaaaatctgaaaaatactttgacatgtatcaagttccttatgcaacttgggcctcctttgctacccttcacttcgtaggaaatgctgctctgtggttacaaacttatgaggaattacatgctgtagaaagttggtcggagttgtgtgtagcagttaatgggaagtttggtagggataggtatcaacaattcttagagaaacttgataacttgaaacaagagggaactatagaggagtattacagtaggttcgaggagttgatgcataaggtactggtgtataataggggttatgatgagaccttctttgtgactaagttccttgggggtttaaaaactgagattaaggcagcaattaagctgcacaggcctggtactgttgatgctgcgttgtctcttgctaaaacgcaggaagagctattgatggaggtgaatttgaaggcatatcacaagaccactataaaggagtcgttcaagaataatttcaaggtgccaagtctagctaagggcatccttggccctccacctgatgagatcaagaaaactgaagaaaggcctaaatgggaagaacaatatgactcattgaatgcagctagaagagcta

SEQ ID NO: 33261 - DNA, 2936 bp, Oryza sativa
gtttgtgctagtttttgtggacgacattttgatctatagcaagaccttggctgaacatgtctgccatctgaaatcagtactgacagtgcttcaacaacatcagctctacatcaaaagaagtaaatgctctttttcacaaccttctctggaatatttgggacatataattggtgctattggggttgccactgatcctcagaaggttcaagctataagggactggccagtacctaaaaatcttaagcaattgagagggtttttgggcctggcagggtattatagaaagttcatcagaaattatggggtcatcactaagcctttgatagagttacttaaaaagggtaccttctttttctggtctacactggaacatactgcctttcaagaagtgaagcagtgtcttcagcaagcaccagttttggccatgcctgacttcaaccaacaatttgttattgagactgatgctagtgacaagggtattggggcagttctcatgcaggctggccatcctattgcttttctgagtaaggctttgggacctaaagcacaagggttttctacatatgagaaggaatgtttggctattctcatggctgtggataaatggcatcaatatttgcaatatgctgagtttgctatcctaactgaccacagaagcttgactcatctgtgtgatcagaaattgtcaacacctatgcagcaaaaggccttcctgaaattgttagggttgcagtatgtcatttagtataagaaaggggtggagaataaagcagctgatgctctatcaagacagggtgagtatgatgaacttggtgccctttctgttggtcaacctagatggatggaagttgtggtcgatggttatcaccatgatcctgctacaaaacagttattggttgaattaagtttacatcctgatggggtcaacaatttcacattggttaatggcattatcaaattcaagggtagaatctggctagggaaacacgtggaagcccagcaagctgtcttactctccctgcacaatagtggcgttggaggccactttggtatagctgccacttaccaacgaatcaagagcatgtttgcctggcctggactaaaaagggatgtcaaggcttatgttcagtcttgtgcaatctgtcaacaagcaaaagtagaacattgtaagagcccaggattgttgcaaccccttccagttccactttaggcttggactgtcattagtcttgacttcattgaagggcttcctaagtctgggggctttgatacaattatggtggtggttgataagttcaccaaataagctacgttcattcccttatctcatccctttactaccttaaaagtggctcagttgttcatccagcacatctatgatgtttttggcatgccgcaggccatcatctctgacagggacaggatctttacaagtgctttatggcaggaactctttcgactctcggatgtcaagttgaatatgagctcgtcttaccaccctcagacggatggccaaacggagcgtttgaatcaatgtttggaagcttatttgcattgtgctgtttattcttcccccggtaagtggtcttcttggcttgcttaggcccagcactggtacaatacttgtcagcatagcgctcttggtatgtctccctatgaagctctgtttgcccgtaagccaactagcttcggtgtgattgatatgggtcaaagtactatcccggatgtgcaacagttgcttgtcaatcgggcgaaattgaacgagttgcttcaccatcatctggttcgagctcaacagcgcatgaaagcacaagctgacaagcatcgttcaaaacgccagtttgcccctggtgatatgggttacttgcgacttcaaccatatgttcagctaaccatggccaaacgttcttgtcacaaattgagtttcaggtactttggaccttataaagtcctggaacggattggagcagtggcttatcgattggcattgccggctgggagcttgattcacctagtggttcacatctcttgacttaagaaggcagtgcaacctgatacaccagtcagttcagatctacccctgacttgttctactgatgaagttgaagtctatcctaaagccattgtacgtcgtcagttgatcaagcgtggtggttcttccattaccttgctggttctggtacgatggtcagggctctcctgatactcttgccacctgggaaaatttgcccgactctatggcgtcgttttccatctgcgctggcttgggggcaagccagtccttaagggggagggaatgtcatgatcaatgggccttgtaagggacattgtttgtgttgggccaactattgggccgtcttgtaagaaccgagccaccaacacgggtgtgttataaaccctgcgtggttggtgaagtggggtatcgaagaagagatatgataacaaactactaccaacctctctgctcctgaattctccttcttcctcctctgttcttccatgtttcctgtgacgattccccaaatctagagccacgaaccctaggatcgtcacatatgtcttgtgccaactttatctgagtgaaattatcccaatcctttcttttcacactgcagagtactgccaagtacaagtgattcaatgcccttgttgagcacaaagagtgatttagtacttgcaggtgctcatttgctagattaactcttttttgtcagagatgatagatgcaataaaagacacataatagttatatttttttagataatggattttcattaatccggcctctatatccacgaaggaatacatagccaaacataatagttatatgaacatgtatgtgcatctcattatattgtctcactatttctcgtctttcattctatctttctcttcgccaagctcagaaagaaagaacactgtttcgttttaggctg

SEQ ID NO: 33262 - DNA, 4470 bp, Oryza sativa
  unsure (1)..(4470): unsure at all n locations
tagtggatcccccgttttgctcagaaagaaagaacactgtttctttttaggctgaatgtaggcttgagaagcattgggagattgatatagttagtctgcttcaacatgtcaagggtggttggcacaatttgtggaatggagaaatttcaagtggcggcggtcggcaggtactccaatttccgattgcaattatctattaaaggaactgagacacaactgtagctaggcaagaagtatatattaagaagattacatagtttctaatgtttatcattatcagaaagagagccatccttgaacaatacagaaaaaggccagcttaattgaaagataggtctgcatctccagaacatagttgtccatctttctgttgaaaaatggaaataataggcttctttccagatcacatacattcctaactgatagaacatatttgctttgcagatcatgtagatctttgtctaccaactcgcagctgtgctcctcaaccatatcgatacaggctgacacactgagtacttgaatccacatttgcctcattggccctgtacatttacacaagtatgaaatgctcaacagttaacacccactaaccctaataaaactgggaaaaagataaatcttttgcaaataactgaagatgcaagcagcctggccctgcataagctggataggagcagatgatttcaacaataaggttttatttgtggaagtgatgccttactcattctgcagattcccctggaacagcaatcaggcacatattattaatcttaggaaattcatagaactactgtaattgaggtgaatctgcactgcagcaaagggcaaaaagatgaacaccttgttctctcgaatttttaggattacagtttccaatgctaccgtatcatcctagctctaaccaagcaaacggcttaaaatttgggctttcactgtcacaaatacagaaatataaacagaatgctctcaaaacaatccacagcatccgaaatcgtgaacacaagttaagcagtaggatcgatgaggaaaatcaggaaggattttgccaaatgtggaaggtgactactagtgacttatgaggaaaatattgatctatatgcttcctaattttttctttttgcggggaacttcctgattatctgataagcttcagaaattgatcagtgtctacaacatgcagcaagagttttcttgtgcaatttagcttagttctttaatctctcaaggcatttttcatattacttctagaattgcactgttgtacaatatatggttttagtcagtaagctatgtgttatcccaatattcacccttggatggacaaagtagagcaagcgattcaatacttggaaatgtgctcagttacttaatttaattttttgctagtcagagatcatatatatgaaccactgagtatgtttgtgtgcctcgcaatttgcttctatcattcttgggtctcagtttcaaatttcatcatgcctggttatgaaagaactacttctctctgttgctcgatgtgagattggtaggcatcgggaggtcagtttgtccactgatgcttccattaactccatggattatctttgaaatagagaaggttcgagtgaagtttgcgacacattcaggaagcaggaatcaaagtgatgccacattcacgaaatcgaacaaacaaggatagagtcatctttaagctcaatccagtggcggatacaaatatatctaggcatctacactcacacactagaaacaagcatgcaatgcactaacaacactgcaaggcgcttaaggcgtccagatctgtatgaacctcatgattaattagttgatggcgaatgccggagcataaaaaatggaaaaaaaaaagggaaatacatattgttctttgtcttcagacatcttatatcaaacagtattatataagttggcataacaacattttcgtcctttgcatatatttattaattaagaaaatgtatagcaatgtgagtgacagcctaaaagttgttgcaaagctgtttcatagacaaagatcatcaaacataaaaaggagagctcacattgagatgatcgagcaactcgtatgaaacaaaaaccagttgcttcctttcaaactgctgagagttcttgaatcgtgattgtcaaagtggatgctagcttggtcagtcctgaatatctccgttgtcatattattacatttgttgtctaagcgcttcaccaattaagctgtgctgccatctatctgctgcctcaaattaccacttgtgaatggaaggtgctgggaacttttgcctgcaagctactggactttcatatagtttcattcgtagagtttcctttcccactgttttagaatatacatcacatcagaaatttgtatccctcttgtttcgtatatgaagaacaggactcaatgttagtgatatgccctagaggcaatcatagagatgattgtatcacatactatgtttatatatttatccaactttgttccttgaaatagataactcattattggttaatgaatatgtgattctttcatgagactctttatgttgtgtgttgctatttttaaaggatcccttatcaaatatcatatgtggaacaaatatgtttagatgatcagcacatgtattaattgatgatcatgtctcatagattatggtataaagataccaaattaataatgtggacacatgttagtgaacatgttggatagacccgacatgagacactgcaagagccatatgtgttgtgtcatcagtgatcagcgtgggaatacggcgaggagaacgcacgaggaggagaaggtcaagccagtgcgatcgactacttcctctacatcgacgcgcgctacttcgcgagaattccttcgacttcttagcgccttcttctactgcgcagcacgtcgaatggtaacgctctatgatctaattaatacttgcatggttcctggtttacgcgatagaaaattttgatttatactatcatagcctacgcgtatcccaacactcaaactatccgttttcggattttgggatgagcacaaatgagaaaccacaaaatggctgtcaagatatatattggcctatccaacctaaaagattaatttgattggagggcaccaccctcacatttttgcgttatgctccttcatcatcaatttgcgatcttagatacctattactgaactccccatcgtgcaacccatgaaaaatcgttctaggtttctcatggttcatgccccctactcggaccaaacttatcgctgacggtccacctatgatcttatagtgggggtgcctacaaaaagcattatttgtagcagtattggacactgatagaatataaagtgaattgcccacctttcctcaccagcttagattttttggttggtcggtgcatgcaactcaatatcatatcagagccataggtcacgagttcgaatcctagctagcgcactattaaataaaaaattgcagcccacttcttttccatgctaaaggctgaggggggtctctcgtgagggggattcacttctattgcacggtagagacttgagagggcctcacttttgggttgaactggttggtgtatgtaagtcaatagacgccttggtcaacctagcaaatcccttatgtgtggcttgaaccaatagtgatactattctcactaccagttcattattgatctaggccagaattaaatgtgaactggtcatcatgggccggcagggatggcctttttctttaatggtagtggatgcaccacataagtataacatttttttatatatttatcgataaattttcttctaaaaatttctcaaacgtaaatacggtgtaatcgtagtatagttacattctaacttgcatataattttagtgtaatttgtatgtaactttcaggtaattttcagataaatgtatagacagtcccgatgtataatactacttcaaacactaccacaggtacagtttgattttactcaaagaagacgattattgtcagaccgcctaaaccttggacaatggcatgtgctgaaagtgatacgctagtatcagagtttaagggcttctgggtatataattaaccacaagttaaggttatttcgttgcttcatttgtagactgcagaaatatacgtgctgttttgtattccttgaaagttgaaatcaatgagacgaatgtgcaattacgacttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33263 - DNA, 5878 bp, Oryza sativa
  unsure (1)..(5878): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcttcagagaagttgtttgtagcatctaacacttgtgataatttgaacgatgtgaactctgaactacatgcttctcttccccaggccaatgcttcttcatctgtctgcatattcatatcaccctgcaagctcacttcacctaaattcagaattgaaacaattctttcagtaaaaccgctgccgtctaattttctcggaggtgttctaccatgctttctatcggtagtagaattaatctaaaccatttttctaatcaaatacaccatatctatttgtactaacctatcaactatatagaataatttttccgacgagcggtacaactcataaatcaaatgttgagatacttctagtgcgataatactggtagtagagcaccgctcattttcttgcacaattgcgtggctaaattacagttttctccttccattgtttgacttttttttagttgaagttctttaggtttaagtttatagaaaaattaataacatttataacaccaaattagtttgattgaacttaatattgaatatattttcataatatgtttgttttatattgaaaatgttaatatttttttacaaatttggtcaaacttaaagaaaatttaactaagtaaaaagtcaaatgacttataatatgaaatagagtagcttttacctttcttgtaccttctgaccaatccgaagcaaaagatgacgcagcaaaatgatccaagaagtgggaaaatcgtggccatggccatgactttgctcctcctcctcctcctcttgtgcttctctcccggcggcgacgcgacggcgttcgccgccaccgccggagctacggcgtcggcgcccgacgagccgatgcgccgcatcggctgtcccttgtagaagggatacgtctcgtacctgaagttgcaccagaggccaaggatccggccgccgcggcggccggcgaagtacctcgtcgtcatgtcgttgatgctctggaggcagcgccagcagccgccgggacgcaggtccggcgtgcactggaggccatgagaggtagaagacgtacggagaacagtgggcggctgagcgtccactgcccgcccgcgtgcgcgatatgtagcgtgcgtcggtgcgaccgtgacggccgcgcgagtcgagcgaagtgtagtagcgactcgcccattgccatcggcacgtgctgcctggggagcgtagtcatccattgcagtgcatggttaggctgtagtgcatgcgtcacagcgcctagtgcgcgacgattgaccgggtgcgtgccgcacactcggagacagacatgcgcggctgacgctgcatggtttactaccgctggtgtacagtgcaggcagccgactggacactgcgtgctcgacgtgtgcgtgcgctcgctcgtcgcgtatggagttcgcgtgtctgacggtgtgtaggagtgtgcatgtgccggaagataccgcgagctaggacatgccgagcggtcgtgcgtgcagacgacccagcgtacttcgagcgacgcgaggcactgcccagccgcagccagcccggggacgctgccgagcgaacgcatgtcgcacgcaggccgaggacgttgaggtaagtcgccgcggcagagcgccacgccgtacacggtgtccggggcggcgccggcggcgcccttgccgaacagcgacggcgtcgacgcgttcttggccagcccagcaatcaatcgctcgaggttggactcgtaggcgctcctcccgtgtagttggtggcgccgcagttgaaccacacgtccggatcgcggcgacgatcgggtgatcgtgcgacgacgaggacgacggcggcgacgacgacgatgtcgatcatgtcgacgccgccggtgaacacgaaccaacaagaaattaagcggcagagttgtgggaattcgtcttctaccttgaggaacaacgacgatgacgtcactcatgtcggcatctttggtgagacaagcgtatgccgcttcacatgttgattttgttcgttcgttcttctcgccggtaacgagccaaaatagaatgaaatcagatacttccaacaatgtgtgtacgtttattttgatcttggaaattttattgaccagtattatgtctcctcagtagttaattacacgagagtaccttcacggtctctattctcggcgtctgattaatatgaatggtttcggagcaattttaccatccaatatctggtatctcaaggtaccacaaatttttatacctatattggatggtaaaaatacttatggtccagactgattctactgcggatagagacaattgtgaaacacctcgccacgatcaacttgttcaagagtttcaaaggtctgttcggttcgttttgattgcgaatcgcgatgtgaaattagtcttctgcaaaacccccctgaccactacttgtgtcaccgttgtattcaaatgttacttctaatatattgacatgtaaagcttttatgcattcgaaaaaactgaaaggaaattagtcttgatctgcatcgtactgtatattttgttgtacagaaattataacactgtattactcttctgaatcaaacagtggattgcatctatataaattacccaaatcaacctaaacaaactcttttttttctttcatccattttccatttccaactttgtttggaattttcgtgtttatgttacaacttttcaaacaaataatacctcaggtgtaaatagtgagtttttatttccatactatataggacatatattgggggtggggaagaacaacttgtgttgttcttcactcatcatatatagacaattttccttaaaaaatcgtctaagaaatatcatagcaaaagatccaatccgtaccacaaaagtgtacacactgtctttagcacattctttgagtacgtttgtgacaacgaactatagttagcaataagcatctgtgacgtccaatcaaattgtcatctgggaaatataatgaattagcagacgccatgatgttgactaacatgcggaattaggtgcttctgattgttgaagtctttgttttttacaccataaccgtaccgcaaatagaaatgctttccaggtgagctcaccgaatcagattaaaacgtttaaggacatccaatatgtctatataccacaattgtctgaaggacacacttggatgaatgaaacaatatgattttttttgttgcaaaagtaccaagagaggatagttcaattgcctttcattctctaactatggtttttttatgccaatatatatggactatcacaatcagcttgactgacgatcataataattgtattagctagtgtgatagaaagttatttcagagatttctttattgcattgggatgatggcatctattggagttcttggtgttaactgattcatgactttgtaatttcagctcccgccaacatatgtgttttaacaaattaatacattccgctcgctataaggacaacaaaaacctttaatgccatatctcactcgaatcaaaattatagagacataaagtttatatttatacatctctgttttttactgtgcaataataacatggttttggcatgtatcctatcttattataaagttatcccccactaactccttaagcttaacatgcaaagatgccacatcatcatccactaatccactaattaacaagataccacatcatcatccactaacaatcatcacatttaaacatcatacaaacatgttatattatctataattttatagtttttataatttaagagcttttaaaatacaagcataatacaagcatgttaaattatcatcccacataatttaaataatatttcaatatatatctttattatgtcttatgatatcctatatgcttatatagtttatcctcacttagttagtgcttaaatgattaatttatggtctaaattatctttctcctttttttttctctaattaagtcatatcacatcaattgtttttagcctttagatgattaatctacggtccaaactatctccctacttttctccccttactttttagtttgaatcaccattctatatactatttaaatttaaattatcataaaccacattaatttacttaatctgatgttatgtagctatcttacacgttattttttttgttgttatcatactaaattcccgcagcgatgcgtggggtttcacctaattattcatgccagaaaacacatgatggcatgtcatttttcaagcgccaatagtcattaatagtcatttaagttcgatcgatcaaacggggcttgttcaggaatgcaggtcggtggcgattgacctcctctacaaacgaatattgaaacaacaaaagtaccactatgtcaaggcagtttttcggcacataattacacttatatagacatgtatggaaaagattacgcctcttattatataatatatatgttctcacttagacgaatatgaaaagattacacctcttattatataatatatgttttcaacaaaattagatagtgggaaacacaaatgaaataggtaaatctcatcatatactcaatattacaaactaatgcatgcatatatttcaattatctaggattacgtagtggcggatccagaaagaaatagcagtgggttctaagcaaactagatagagttatagtcccctctcccatctacatatgctaaaaaaatttagtggggtctttatagtcttcacgccagtagtgggggctcaagaccccgccgcgctcatgctgtatccgtagttgaatgtggaacaaaatggtaaatctcatcatatactcaatattagaaactaatgcataattatgtttacaacatgtattttaatcgtttagggttatctaacttgattatggaacaaaatttatatcttccaagtggcgataagaattatactctagcatgtggcgataagaattatactctagcatgttctcaggcgatgtttcagttattgtttgttcaaggaagtatagcttgtttatatctattcagttctcaccaacatctctacatgtcctatgaacttttcaaagaggattagcatgtattaataaaaaaccttatgtaaaaaaagtcttgaccagattatctctaacttttctaatagacacgcgtgtcttagtgtcacaaaaaaacaaaagtaaagaagtcttaactcaaagtcttgtccaagagacaccaacttctcaaagagaatgagcatgtccatttacctagctcctctatatagccaaccgattttacagatgatgcatgcatttcataggatgaaaatagagatgaacatgtatatggggagaaaacattaatttttcggtacattgctcaacaatatgctaagcatgagtgcatgacgcactcacgccctatctgatgctcgtgcgtatatatattgctcttttcctgccaagttcgtccaacatgcatgatctagctattcagttaactaggtgaaaccccacgcattgctgcgggaatttagtatgaagatatacattgaaatattatgtgaattatgttggatgataatttaacatgtttgtgtttgaaaagctcttaaattataaaaac

SEQ ID NO: 33264 - DNA, 694 bp, Oryza sativa
gacgtaccaaaattccgacagaaacatcttcaatttttataatagtagagactgaaaaaatacccatgcgttgcaatgggtaaaggcatttttttctagtgatacaactattaagagccaaggaataaattgaaacataactattgctatacattataattgaaaaggcgttgactcctgcttgcctctcttaacttccataagacagttacgtgcccgtgcaatgctgaagccgatcccgcacaatgccaaaactgttcactgatcatcccatcaaatcgattttttatcaatctcccaaaattgattgagggcttttgatccacttgatcagttctttagtttttcctaaaatcagagcgaatccgtaaaactcaggataaaaacggcggggcaagatcatctggataaaaatggcggagaagatcatcggctagcaatccttcacaactgttaaacagagattaaatcttgtgaattaatgccgaattgaaaggtgaaattatgaaggaaaggatgagtgaggagtggagaatcggtttttgcaattagttagaggagaaaatgcatgtggaggtagatagatttttgcaattagttagaggagaaaatgcatgtggaggtagatagatgtggcggcgatattagggttcggtctgtgcggcgcggtggcggctggaggcgtgtggcaacg

SEQ ID NO: 33265 - DNA, 650 bp, Oryza sativa
cacaacaccttagtctgagtctcatgccatgcccacacatgcatgctccactcgatccactcaatccggccactactaactacttgcatgcaacagttgtatgcactgaccggtactagtctcgctaactaattagctaactaattgatgcatgcaagcaccataagttcaatatgaacccatgacattttcagctactacgtgcacgctcgcctcccttctccccacaaacctcgcctatgcctaattccctaatcatatatatcaccccgctaaatcttgatatatatcccgttaaatcttgtaatcaaatatttatttgacttactccaaaatctcactctctgtttctttttcttgtgcctctccgtttctttttctgttgccacatgcacggcatgttagcagtacatacgaataagctaagataccgactacacttgttttagttgctttccctccaactcctcttatagacaaatattatctgatatctgaatgctataaagcttttcaggtggtccccttccactaatagatattttaattatatatgcattcacaagccatccatctgctactctctcttccaatcatcttaattacatgttttctttcgaaacatgctatctccattttgtctgttcatc

SEQ ID NO: 33266 - DNA, 773 bp, Oryza sativa
aacatagctggattaactgtgaaatcaccccctttttatgcataccctacaattgcttcctagaaatcagggagcactgtttcagacagtcctgcaccccttgcagagtaatgtctttaccagaatgagtaaatctcacagtcttacgcccccaatgaatccacatgggactatgagcctcaagccaatccattcccaaaatcaaatcatagccacccaacccgagaatcttgaagttagaagagaatgtattaccctggcaccaccactcaacttgctcagccatctcatcacaaaacaattttccaccatctattatcatcaccagagcactaggtatgctattgggaaccagatgcaacctgtccaccaaatgagaagccataaaactgcttgagctacctgaatcaatcaaaatgaggacctgctgaatcagtccttgcaaccatatagtacgcttgccctcagttccaaacaaagcattttcagataaaagcagttcttcatcactgctactctcctccacctgcccaggttcatcagaaaactgaaagacctcaagcaattcatccaagacatggagctgaacagcctttggacacttatggcctggaccaaatttttctccacacttaaagcactctcccctagctcttctagctgcattcaatgagtcatattgttcttcccatttaggcctttcttcagttttcttgatctcatcaggtggagggccaaggatgcccttagctagacttgcaccttgaaattat

SEQ ID NO: 33267 - DNA, 10617 bp, Oryza sativa
ttttcgatggaatatgaaagatgctaacgaaatggatgatcacagattaatctacccctaatcactgtttagtacattactagtatgtctttagaggctgttcagattgtatctaaaataaacttagttggcaatattgccatgttttggcaggattccttatgtgtttaccaaagtatggtaaaaacctaaatgtatgcatatctttgtcaacttaccaaaaaatggtatggtttgaagtgacattaatctgaacaactccttaataacgaacggtttagattatttttattggttgtataatactaccagtggagagcaacaaaacacatcacccttgaaaaagacgttgaattaactcatacacatcagtacttcagccttcatggggcactaaaccggtaaacctgtctacatatatataggactgttataatctgtaaatgaaacactttcttgatgatggcacatcatagacagggtaaccatagtacaccctacaaaaaatcaaaataactgcagcaacatcaacaaatctaacaatcaactggtgcgtgtttcaccctatcacttttggatcatcgatggagacaaatgccgtggtcagcatgcagtacatggggaaactgtaaatgccatgagagcataagcagttaagcacaacactgtagatgtggcgctgctgaatgagtgcagtgctccatcatttggaggaggaacggacatgatggacgatgagtgattttagctaaggtttctaatattgttagggcatatttccctaaaaaaatcactgttgctgaaccatgtctataactgtacagctcaagttccagatggctccctttcctacaaactacacactatcagttgactttatatcctccattatacttttttgtttgcttgctcctgaacttcaagtgtgagacatgacgaatttctcttgctggtttaatgatagtggatgacaaaaccgttgagtaggctagctatttatagctgaatagctgaatttgtgtttttttgttgtgagatgcatggattgaatttagtgttgcgtatgtttgtcgagtgacatataatctacgttttgaggttattttataatctttcatgatcgacatgcaagatataagtgcatgcgtacttgagttgtaaattagatggacttttctagatcaaccgtcttttgcttacacaagctatagttgcctctttcatgacataccctttaatcaagtagtaggggtatgaaaaagaggatgagcctttgttgttggatcaaactaatgtactactcaacattattattgcaacaaattgtcagcaattagtatatttttttgtatatatggagtaaaataatgtaccactaagctatagctaccactctgcactttttcttcttctacttgctagttcaatggattgagtattgacgatttatactctttgtaaaataataaaaaaaacacaatggcattgttctattccatgtcttacattcacgtatcttttagttagaaaaccacatggtactctcttttaaatctcagtccataatttttttttgaaaaaaagaacaaacacattattgtacggatcaagcaaaacagttgtacggatcaagttcccagcgcctccttctcctataatattctttagcaggttgattagatgcactaattcttcaatttcccaaatattcttgatctttctaatgaataaaatctctgtggagaactcgagaagcttgcttacaaattagctgtctctaccaaagagtagatcattgccatttattgaagagcatacatgtgaaatcgtcgatgttgaattaattcatgcacacattaggtagttcatcctgcctgcagaaaattgtcaagatgtccttaggcagttcagcctgtcttctggcaagctttatagacacaagggagaactatgtccatgactgaaatggccacatcagaagggagtatgacactgtaagagcaaatatctgtagagtgtgcatgagggttattgttcattgttgctggagtaatttccagtactccctccgtttcaaaatgtttgacaccattgactttttagtacgtgtttaaccattcatcttattcaaaaaatttaagtaattattattttttttcatatcatttgattcattgttaaatatactttcatgtacacatatagttttacatatttcacaaatttttttaataagacaaacggtcaaacatgtgttaaaaagtcaacggtgtcaaatattttgaaacggagggagtactaattaattaaatccctctctattgatcccttgtaaactgtaaaggaaacatcttcatgatggtgcatcatgaacaaaaataactatacaatttatatactttctatcaacaaaactatcaagcaataggtgcgtatgtttcgcctttcacaatccatatcatctagtaaaaataataaaaggaactcagttctacccaggttattgacagagctctaccaaaatggcaggtgatctgtgcacattacatacgaaactgttaatgcaggcttgtccatagtttttgatgtgtagagcatgctaatctttaaactttgaaggaatgattaaaagtagcatgccaatcgatgctcaggtctatggttgtgccaggccatatttccctagaaaaccacagtgaccactccttgtaatgtctcctgtaaaatctgaagagatcgggttcctgatgtctccctttcctgtaaattactctcatttgacaagcctctactgtactgttctcctcttgatctccaacttgtgagacatgatgagcttctattgtggattttacgacagaggagtgtccaggcccttctatttatcggttggcataaatgccaacagaggattgattagtgaggtcacatggcatatcacaaaatttattattttctcatctcccacgtctatgggtcatcaaggcgaaggagtctagcataataaaacattagatgccaatactgtatataaattgattttactctgtttgactagtgtagtaaaaacatgttctcttttctcatgcctaaagataaaaaaaatgaaatagtaaaaaaatgcattatcaagtaccatttgttcagatgttagtgacaatgccatggtgtgcaatattgcttttacacagggaagatatgatacaattaataacaaaatcaagattgagtgctaagtagaagaaaaaaagtgcacaacaatatacaagtaaacttgaaaatattcatcaatgaaactgttataaaattaacttcttcaaccaagtttccatgatctcttattcatacatgacaataaaatatgcactgctgcatatgaaattccataatgtttgaattttaatgacacgatgctcgccaacctcaaaagaaaacaacacacataaccttgcctcagtcaacaaaagtatagatcctctttattcctgtaaatgtcaaacaactgcttagagcactgtattgcatattcctggatgaatttgggccctgtagcatcatggttcactaggtcttctttgttcttcttcattggcccattaatatcaccatccaaaagaaattctgccaattgtgttgccctattcacaacaacaaaagaggagaatattttcaataattgagatgatcagcaaaattgttacatagttatgcacctaaatctatgttagttagcattgcctttcaattttttaggaaagttaaccaaatatgcaatttaagatgaacctgtctattacatcacattgaaaaatgagtacaaaaatcaagaattaaataatagtaccctataaaatacaccacataaagaacctagtgagggcattgagcatgcatgcttgtaaggtcatcacataatcaacatagtaaattccattatattttgtccaaggaaagaaagacttttagttttatatctttctttctcctgtattataataacaaaggcaacatagggtatatattcatcattttctatacataagaactaacaaaatgcaccccaatcatggagtgtctaccttaatttcttaaaaatgaaggatatactattagtgtatcatataaattaaactaaatagaaactctataaaaaacaccatactgacaattcctataaagcatttaataatgcattccacaacataaacagttaatagtaacttcgaagagcctgatgaagcatttttctaataagtggttcctataaagcatttttttaatgacagatcatatatatgacagccatataaatgtttcttagaataaccattctacatagcagtcatgagctgcagtgaaaaaaaaagttcagcttcagacacaaaaactaaaaaactacaagattccaataaattgtagctgaaattcatactcaaatatttatataactagtttgtaaataaactatacaatacagtatgtatataatatgtagtaatatgaataatttcccttcctagcattcaaacctaatatttaacatacctgtaagcctgactttcattgagtgaagtaaacttagttcgttcttcacatgtcgattcaaccattagcttcttttggcgataaagagcgcaaatagctcccatgcaaagctccacattttccatgaatctgataaccatattttcctcagactcccacaagctggtttcgatttttgacagcagagatgcacttttactgctggatgggagcaccaaagagaagggtacttgctcactcataaaggggcctccactttcttccatccaagcatcaaaagaaagttggttcatcaaattattcaagtgcaaatgagataattggttctgcatttctatatttcccttatttgattcttcaaccaagtgtgggctcatatcgggtacagaggcacaactagttgctactagtgctggagctattggagaaccacccgtggatatcagccccatggaaggaggttgctgcatagatgatggtaacaagggagcagtttcctcttcaattacatactcttgatcaacacttcccaactcagagaatactgatctcttgttccaatttctctcttgattatctgattccaaaagtaagggtggacctaccaagatcgctgttggagggggtactgtggctataatcggtatatctgacaatgatacatctgtggatgcgggaactgtggatgatagtggtagttgcaattgtagaatgcacttgaaattatttgacatggttggtgctggcttaattgaactctggcatggcctccctcttttttttggtgctcttgatgttgtcgatgcaatgagaattcttgcgcaaaactggtgggatagtcatgttgtccatgtcgaccctcttcctcttgcttgaagaacttgaatgattggtgccacttacctcatttttgttggagtcaatgttagtcttcttgccaccttcactatatgcgccctccttggctagaagatcacacttcatctgaagcacatcaatcttggcttgtagacatgcctcagtctcggcagcccgacgctcacgctcgccaagcacatgtgcggccaccttgtaatcagccatgcgatttgtggtttggaggtggcacacaaggttggcaccggagagttgcgcgagcttggctacggtgtcaccatcggaggccatagtgatggttgcggcggctctacccctaagctagactagattggatattggggaaggggattgatttgggaattgcacaagtgggcgatttcgtaggatctttgatttgggaatagcttactagtattattgccatcattaaatagggtagtacaattgtactatgtactacactaccactctgctctgacctatcatcatttctactttggtacatttgacactaattagtattttttttaggggtgcagggggatgcgtgtttgcattacctccaaacttggctcgtactaaatattctacaggaggtaaaattgatccaggcatgtttcttagcatctcaattttctaatgcctcatttgtccctccaaatacaacaatgaaaatgtaatctcttaatttattccgtgaaacgtaaagtgtggaaatatttttgccagcttgcaaattctatgttgatgtccacctatccatcatttattcttgtttgaggttactacttaaactccaatgcgagttgtatattctatataggccctcatttaaaccgaaatattgacatacaaaataaaaataatctgctatggatttgaatttgggtgcaatatattttcttgtggggatggaggagaggaggggggataggggtttggtaatgactctgcacaatcaagatggaggaaacatatgtaatggcatccaaagtaacactagcagagttcataaagtaattatctgcgagtaaggttgccgagtgtgattttggagcagaacacaatgccactaccatagaactccttgttcttgatgccctgttaatgctgattaagcaagaaccaacattgatagcggtttcctaacttctaggactcatacgtgcaatgagaagagaaaaactagcactgatgatcccacattagtgctggctttttagttgaactggcataccaaaacaactactagtggcaattttttagaggaatcgatgcagaaaatcaatctaggcagagcactagctgagccaagctgcgccaggcaaagggtgatattctttaagtgtggtggtatctgtctcctgttgtctccaaccccttctccccaactcattctttactcgccggcctccatgtccccaccatcatttgggtcccgtgtgcgccggtggagacctcctcccccacctctttgtggccgctgtggaaatcgcttcgccctcacctcctccactgcagccctagcagaaatctttgtcctagtgtggtccagtgtcgatgttaggtcgtcagatctagctgcgatgagcccaggggtagtcaaatatggccgccacgagttcaggggtggccagatctggttgccttgttctttgatgtaacaacattgggagggagcaacgacgatgatgacaaatgcctctattgcctgaggcagaaagagctattacgcccctgactctatatatcgctgtactttctttcagggatacatccctattttttcatggagttctaaatacattctagccttgcaattctattctaataaagcatgtggcaaatgggctctttgtgctcggtaagcacccacttttgcctgcatgatgccacatgtactagtaaggttataaaaagagtagaaatgagtccattgaaaagtattgcacatgcaacaacaattcagttagccaccgtctcttaaatttcacgtactactaaggttaaacagattagaatgagccatgtttttagctgatcaaggttgtttgcacctctagtttaacatattctatgaatactattagctatgaaatacaaaaacaacataatgcacattagcacatatgtggcgtccaagaccatacaatgcgtgttgtacttgattttctcttccaatgaatttaattttgtaatttgagtattttgcaatatgaatgattcacaagtcaggctaaaactaaatacatttggatcttttttcaaaactacatacaaattggacttcattttccattctcaccactttacagaaaaagattaattatcatttatcaggaaattcttttgtatagattcttatttttttccccttttggaactctggctttcatcctattggtaatttttgtgcactctttaagaaaggaaaaggtaacgttcaaaagtttaatcttgcaccagccattcaagtagtgttgtaataacggtttagaagagacctaattaagaaaataaaataaaagggaagacatatgggaaacactatttgtaggtaatgctattaattggtctgggtgttgcctttggaatttttcttctacgtttgtgtgggggtattccttttctgcaagtatagaaggtatatccaaaagcaaagaagaaatattttaagaaataccaagggccttcttctagaatcaccaatatcttaagatgaaaatgccagtgatagcacaaagattttttctttggaaaaactaaagaacgcaacaaataactctgatccaacatgtgttctaggtagcagagcatcttacattgtaagaaggaatcttatctgaccaaggctatgaaaaatcttaagatcacggtaaaaatagtttaatcaattcatcaaatgaggttgcaatattatctcaggtaaatgatcgaaatatcatctagatgttgtcctgaaattgagatccctatgcaagcaaaatttaaaagaaaaactgatattgttgttgcaaaatggagataatacaaagctcatgcaagctctgtagcaatccacaaactgtcatccccggacaacaataacttgtcactactcagattatcgtggataatattgagtagtgaatcatcacaaaacttgtgtgaagagtgaagcttgtctaattacttcctttgggggaaaaaaacaatgcccataatagagataatttcctcttatgttcttgaggaagcatgtgagaatgatataacattgttgcctctcctgctgaggactcttgaggaagaaagatctgctgtatcttgtcctgaagctttggaaattggccatccaacaaagctcatgcatgcgatttcttccagttgtgtcatctgctacggcgagagcttgtgccgtttgctacccagaatacgaaaggaaatccggtttatcgagtacaatggtttggtcttatattgtccgccttcatgcatttttgtgttttcctacaaatttttctggccttcatgcatactggattctgatttgtccatttgatcaactagaaaggaagcccgcgcagatgcgcgggcaatttatttttttgtttatagaaagaatactaaaataaaccatatgttaccgtatttattttaagaaccatagattaccttataatataaaataagaaatatttattatgtgaaataaattataaactttgatatactaattgataatatctattatattcaaacaaatttcactttgtcatggctatacataaagtcgcatatcaccatctttcgtaaacatacaggttaatatgggtttagatttttttcttttactatacatctaagtcacctacgtatattcatgggtaatattcgaaggaataattcatattgtcaaaattatttgtgctaattttgtcaacactatttagatgagaatgacatacttatataaggatataataggtttccatgcgacattttttattgtacgtatgtattttttttgtgaatagtactgcgcatattcgtaggatggttgtgcacatatttatatgagtgtctatgatttcgttttagatcattagttaaaaaaatattttaaaaaagttttgtgggatggcatgaagcgatgccacagtggcatgactttttcgataacatcgtaaagagtttcactatatatatgcataatttgaggaaaactttagtgctgcaaagaaagaaacaaaaaaacaaccagacggagcagatcatatatacattcttctttttttttccttttcgacatctcttgtataggtacgtacgtagggagagattagttggtttttagctggaatatatccaatataatggttgaaaataatggatctaccagttgaagtgtaaattgatgaccagatattttcttttttatattttttcttatactttttttctagtttatgagatctattacgtgatatattaagagttcttgtagaagtgtagaaattctattgcttatactgacaatatacttgtagtcgattattatttgctgtggcttggtggcatgctttactttacctatcatttgttgatagttctccacttagcatagtccgttatatatggtgcttcatgacataagtgctcgttggatggtagctaattattaggtgcactatgcatgaatacctcgtaagcaatatgacttgacgattagtggatagtatttatatacttatggataagtggtggcatatgattatatattaggatatttttttattcataaagtatattatatactacacattaaacattttagtaaataagcaataagttctagagtacttatcagattggttactccttgttttcccagttatctacccattgatataggaattattacaaaagacatatcttttgataataatatctaaatccatctgaaccattttatgcactataattaaattgacaaccataacctacatcgtatatatttaaaagcaacttgtgtataattaaaatatattttatataaaagtttaaaaattaaataaatctattttggctttattatattcaatatttaattaatcttgcactaatgatatgtgtcgtttcatgtatcctgaataagctcagccatccagttacagccatccagctagatcaaatgaagcataagtagaagat

SEQ ID NO: 33268 - DNA, 18839 bp, Oryza sativa
cgccatctccgtcgtcgccgttctctctctcacttttcgcgggtggagggcgagagacggtggggggagaagagaagagaaaaggcgctggccatggcgcggcgggcgcgaaggtcgccggcgatggcgacgccgtccacgcggtcgcgtgagagagagaagagaagagaagctagggttttcggcggccggccgggagaggggggttttgatcctccgatctcggcgcccggccgtccgatcgaaaccctagctgatcggacggtcgacgccggccgggccgaaatcggcccaagagggcgcgcgcggggggctgctttcctggcccaggcccaggttgcggcctggggaaggggggcgcccgcccgtgccaaaaggccgcgggccgaccgggaaaagtctgtttgaggtccctcggggccgaaaacaaagaaaagagaacagtagcattttttccaatttattttgtcgatttttcatgcaaatttcaatagaattttgaatagatttttgcatgttttacctctgtttaaatttgaaccaacgggagaattttgcagagagtaaattacagtgttttgctactgttcatataaattttatatagtttttccgctgcaaatagatgaaattgatgaaaattagtgtttctaaaattaaatttcgaaccaacgggagaatttaattttaggaacattaattatgtgctatgatgttgtaattttctgaccaacgttgataattgcaatgttatagttatggctatgtgttatgtctaattctgcccaacggtgatgtaggcttaatgcatactattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtgttgactaccccatgtcctatagaacttgctgaacttatcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccaaatgtgacgctgtctcagagtaccttgaaagaataaagagtcagtttactggctcttcaaagacttatgctacacagctgatcaagcagcttgtgacagaaaggtaccatggaggtggtgttagagaccacatacttagaataagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaacgaatcaaatggtggttcaataaactatgttaaagataagaaaaaaaaccacaagtctcccacctcaaaaggtaaacagtctcagcatctgcctcagcaacaacagttcgctgttgagaaagatcaatgtctccactgcaagaagacaggacactacaagagagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagtgaactcccgatgtctcatcgaaattatggcactgtcgtttgggccatatttcgagggggagaattgagagactagttaagaatgaaattcttcctccattggggttctcagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcactggataaatttaagatattcaaagctgaagttgaaaatcagcatgatataaagattaaagtagtaagatctaaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcataatgagctactccacactaccactcggtttatggatggaggcgttaaaaaccgccattcatattctcaacagagttccaagcaaatcggtgcccaaaacaccgtatgagctatggataggaagagtaccctcgctaactcacctccgtgtgtgggggagtcctacagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccaacacctgttgttacccctcctgtggcaacaatgaatgagagtgaggaacctgttatacaggattcaacagaaatggttgccacaccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttaaaatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacacaacgagaagggattgattacaatgagacattttctccagtctcttgtaaagattccttcaggattataatggcactagtggcacattatgatttggaattacatcagttggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaaaaaatttgggtttcaagagaatgtcgaggacaactgtatttattcaaagtttaagaatgggagatttattttcctaattctgtatgtggatgacattctactggctagtagtgatgtcagtctactgcaggaaacaaaaaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtatgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacaaaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctatatttacaaatctgtgatggaatagaaaaagctaaaagaaaaagtgagatcaagggggagaatgttagatagatctccctccccttgagcccaacggctcaagggggccttgaccgcaccctgatcgggggcgcccagcccaatggctggtgggcccccgtcacactgcgccatataaaagaggggtggaggccggcacggcacaaggtacgaagttcaccgccgccgccaactccaccccacaaaaccctaatccgatcgagagggggcgcagccagtgacgggaaacgccaccgccgcgccacgcctcatcgccgggacgtctacgacgtactgccgcagccgtcatcgccgtcgacctcaccggcatcgcatccacgtcaagccgcgacgacaacgacgatgtccggcgcctcttcctccacgaactcctcaaccggtcggtctatctaaaccctctcccgttttcaatctctatagttcaaacatcaatcccaaatagaaccacccgactagatctaacctaggtgatcctagagcaaagtctaacattcttctcgaggctgtaaaccccggtagtcttgctatcagtttgccatgaggatgttgtacgtgtatttgccatctctgccgtaaacctaagacccgcaagcacaagcggtggctgtggatcttgctgcacttcatctgcaaatgcaagttgctgaagctgctctgccacatacctcatctctggccttgccgtacctggaataatcaagcactgactcgctagcactgcagcctgatggatcactctcaggttgtcttcattaacaatgtcactatcaaggagtttaatgagtgtgccatccgtcatagcctccttaaacattgaggtcaaggtcttcctttcttttgatagtggcctcttaccagttagaagttcaaccagaattactccaaagctatacagatcattcttagctgtgagctgatactcaagcaggtagtctgggtcaagatatccaggtgtgcccttgggcgcaacctgagttttctcatcaattgttgagcagccaaagtcagacacctttgcaaccaattcttcggtgagtagtatgttcgctggtttcacatcaccatggagtatcgggtgtggtaacgaatggagatgcgcaagcgcatcggcagactcggcggcaatcctcaggcgggttcccaaagtgacatggcaactcctgttcctttggaagtccaatagctcatgaagtgttctattttgcacaaactcatagacaagcatgggtgcctcaaattgtaggcaacaaccaagtagcttgacaatgttagggtggttgacacgacaaagtatgaccagctcctgtacaaagtccatcttcctgctctcatcaatctccttgcacctttttatcgcaacaatagtgccatctatctctgccctgtaaactgttccctgtcctccctccccgacaatgtgtgccttgttgaagttatttgttgcagtttcgatctgccctctctcatagagggtaaacccaacattgccctctaccttcatcatttctagcagtagctgacctccatgttgttgaaaaaattcatctgtctgtcttaatagagcttgtttttttgtgttctgtctgtgccggatcacctcccatccaaggaaaccaaatagaccaacaaatacacaggtaacaagccctgaaaggacggagttttttctttactgaaaaggcttaatcatatgtttgaacttcaatattttggcatcaatgtacatgttgtacttaacagtctaggacacacaattaagcaaaccgtaagttttagtgtgttcaaacaatcattcccttcggtctttttcagttaagcaacctcccacccccacaaagagaattggatgggattttgagggcccctcaatttcatccaatccttttttcaaggagattaattgaacaagtccacaccttaattttctctaaatccacttcaatctacttgacagagagattaactgaaaaaggcttaaaacattgtttggcaacatgggggtggattgggtgaatccccttctctcatcatccccaacccccttcaatacccctcaacctaacctattaacttgtatgtttgggtcatggggattatggtggggataatttgtatccagaattaagaatttaaatagtgcaccaaagattaaatgccatcaaaacaagccctaagatgttctgtagatagatatttgcagacatcgatgtgttatttaatttatggtatcatttgtaagagaaacaaaccataaatgagtcataagttcgggtcgttccctacctacaatgtaattacttatggagaaatctatctatctattatctattatatactaaaagttcatttaaacttcctataaacactctcaacgcgccacgtggatatcctacaaacgctcctaagctgcggcgtggtgcaacatgagaagacaaggacccacgcgatgttaccttatttagaatacgcaagtggggacgtcggacatgggtctgacaaaacgatcttgggccttgccatatttatctcaaaattagttccgtcaaaacaaattttaaatggcagccaagattagttacgaccctctggcaagattagctatatataatgtgaaacatacgtgtatatgtacctcagtgaacaacaggttattatctttacgtacatatatacattccaccaattgacgctataataaattatttacatataaaagccattttatataaaaacaaaacacctaaccatcgattttcccttaatccgttagacccataattttaaaccattaaattagaacaatctaaaaaagcaaatacgccatcaagttgcacacctcttccgtgccattatgcatggctccatatatacactcctaacatgttctttatttcgtcaacaatagttcgagatatagaaatcaatcaagtataaatcaatcaagtataataaataagtattataagtataatagatggactattattattattattattattattattattattatatactaaaagtccattaaactttctacaaatgctcctaaaccgccacgtggcatcctacaaacgctctgaagcagccatgtggcactataataaattagagaaattcctaaacatccagctattgattttaattaaatttggtggacccattattacaaccattagatttatctttaaaaaatcaatctcctaaaccggccccgctcaggcctatatgtaatgtaggtacgtacgtgccattatctacagtaccatcatccttcgttatattctttatctattttcatgctttattgattagaaaagcaaaatttcatgttaaaaaatttagcaactatatatctaaatcgtgcaaatatgcttatatatatcttgaaattatttatgactaacctgtctattatatatatactaatttaaagtctattaaacttcctacaaacgctctcatactaccacatggtgctctaaaaacgctcttaagttgtcatatggagctctaataaaatagaaaaaacttagaaattctgaggaaaaaagaaaaaaatctagcccccgattttcatttaagttagtggacccattagtttaaaccattagattagatttgttataaatatattatatataaatagtaatctatccctcctaatttaccagtaaaacttttcataaaaaatattgaccagaaaaagctgagaaggcatatgtatgtacgaattaacaaccacgaccgagaaaagaagaaatgatatacagcaaaaaacagacgttatacgtacattgtaacgccccgattttcgttcgggattaaaaatcatttaataatacattttctagaaattaaataaaatttaaagcaatttaatcaagtgaaataatggaagaattaaaattttcccttaaaaatcattggccgggaatattttgcaatattctttgtgccctaaaatactctctgaaatttcccgtgaattttcggagctcaagaaataattttaatggcacaaagttcattgaatcaattaaataaaaaaaaaagaaaacaaattaaaatccttcctctctttgggcccctttcggcccaatccctcctttcccctcctcggcccagctcgctccctttcgcaagtctattttgcctccctctcccatctctctcccttaggccgacaagtgggaccgcgggacccacttgtcaggcccatcccccttcctcacgccggccacaactgccgccatggccgcccgagccaccccacgacgccgccgtttccgcccacctcctccaccccgcgcgcgcgcgctcgtccgtgggacctcgccgcccacgtccgcgccgttttcccccacctctcccctccaaaaccgccacccacaccccacgatgccgcccacgccaccggcggttgccgccccgactccgcctctcccgggctcgatccggcctcccctcccctataaaaacaatccccggccttccctcatccttttcccccatttttcccaagccgccgcgccctccctcgctctccccgcgccgagcccacgcaccgccgctctccggcgaactccggtcgccgtttcccgccgccacagccgtcgccgcgccgagccgccgccaccgccagcttcgccaccgcaaggggaagtccggccgcctcttatttccccctctccacccctcgaacaccactcccactgtacacccgaggccgccgcccctttcaccgcctccagccgcgcgccaccgccgccctagccgtcgccccaatgcgccaccactgccagtaccttcgccgcctcaaagtcaagctcggccgccgctcggttgtcgcgcctcgctgcccgagcaccaacttcaccaccaacccgagatcgccgccgtgtttgccgtctccatctgtgtcgccccgcctccccggtcgacgccggactgcgccgtttcctccctcggatcggcaactccgagccacaccccggccaccgcttcctcgcctccgggaaccactgaaatcgccctctccgcgccccggtcgtcccggtcaccgtccgccgcctcgcgccgtggtacgccaccggaccaccgttgcctccccgaggagcccgccgccggcttccccgttgcagtctcgccgtcgccgcccttggtgagcatccctcctctcctccccgcgccgtcgccggccgtcgtcgccgatggccgcgctgccgcgcgccatcgctcggccgggccggcactgagccgtgcccgtgctctgggcgccctgcctcgtggccgcccgatcagctcgggctgatctgggccgtcggttcccgtggaccggcggtggaccaccccgtggtcccggtccacggtggaccgattcccttgacccgctgacgtgtggggcccgcctgtcggcgccggcctcacttgatgacgtcagcggcagcctttttcctttgaaaaattaaataataattgcgcaataaatcgagtttaattctagaaattaatttaaatggctcaaaacttctaaaattcatatctaattcattcgaactccaaattgggccattcaacttgcaaaattcatctaaaattgagctctacatgtttgtttactttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatattgagcctactttacaaatgttttaccgtttacaaataaatatgcatgttttgctaattacatgggatccgggtattacctatctgctcgcttgtgccatgtttacttgatatctgtcctttgtcaaccttgggtaataaatcgactagctcatgttacttatgtgacctagctagaactatatgcttagccatgcttaattaccactagctcagttgatgggataattatagtattagaccttttagtaacagaatgagctgcgtgctcgagacatctggccatgcttcatggtcgtaattatccaactaaagtgtgactaaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgctgccttgcgaggattgggggtgaaacctgaggtgtggtgtgcttgattagagggggttatgcgaagggtcctgtcacggcctctttccgatatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccactttaataaatcgactcaatgcactgtggttcaggtgggttggttgggcctgttcaacgtggtgtagcgttgatcagtggagatttaatgttactttaattactcaacagttttactgttttgctcaataaaatgttttacaactgtctttatgcaaatagccacaaaccgtccttgtatccccttgcacatctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgtcttttccgctgccgctgcttttgtctcggtgtgaggactaagtgcctctcctgtaagtattttacgctttatttacatttggtattgtttattacttgtcgttttgtgtaccctggctggtcctggacagggatttactacacaaaatagtctggaaatttggactaaatttctgggcgtgacatacatactactggaaattgaaaaaaaaacatcgctttttaaacttggattttcactacctctgtatttttttacgacgaccaacgttaaatatttagtgaaactaccgaaagaaaacaatactctttaaactggattttctattatagttcatatgtatttttttattgttttttatatattgatgaccaacgttatatatttagtgaagatgatagtataagaaaaatatattacttgacaaaacatacacagccaaaaatagatgtataatataatataaaatatcaaataaacgtatcatttcagaatattattgttgagtatagatagaatttatttgtatcaatgggcctaaattgatagtttaggatgaaataatgagtaattaaatattacttaagacatattgtcagaaacacaaaacaaaaaatgtattgtataaaaatatgtcgaatgtttttctcgctaaacacggttaggattttagccgttaatgactcaatctacgcttttgatttgtactttttctgagtacataaataacaaatttaaggttgagttgtaaagtgcttataaaattggctatcccttatttgtcttgagcatgttctccaaactaataaactttttttttaaaaaaaaaactcttttcatgtctataatatttaataatcaattaatcgttcattaatggcctacatcgttttgagtgccctacataatctcaactaatgagatcgaatgtagcctaagtaggagataaattaggttatttactataaaatttaaaattaaagaacaagttaacaatattattaaaaaaatcattacaaatattctatcgactagctgttgttcactaatccatacatttttaagaaaaaatcaaatagattttgccgtcccctccttattttttagctataaaactaaaacagaaacaatcaataatattgaattttgtttagaaacacagcgcgcatgcaccctacccctttagtacctccaaaagactgagccagtacattttttgattgacgaagttaccacgacgtctcgctatcgatgggtatgtcacctcgccatcgatgggtacatcacttaccattaaaaaaataattagccgtaaatgccaacacccgtatcaaatctaggacttgaacccgagtgggcaagtaccacacaggaaacgtaacgattgaggtgcactcactttgcaataactttgcaatactcatatgccttttaaatcggtaatctattagttataatcgttagatctatcttatatatatataaaaagcatgtattcatggtacatgatatttccaaatttttactatgcaattatatttcgttgttatcatattcatattaggctgcaaggagcctgtcacccaccctacatgaaatgttcctttatggatcaccactcaaactacatcaatcatattaggctatacaaacccatatatttattggagcttcatgttccgcctaattatttctttaatgaactatgacaatagatatgcaattaaaaatacaccttacttttactttcgttgacatgttttctaaaaaaaataagtcttccttaatttcaaatgataaagaagattataaataattgcttatatatattacttaaatatgatacaatataaaattaataggttagaaatttataaaagcaattaatgccgatgaaaacaatttatggagaaatcgtagcagatgttctccgtttaatactcgaacttagcatatgacatatgcccgtgcgaatgcgcgggttaccttcctagttaaaaataaagatggagttgctacaagattatacgaggaaagtttatataatcgtacaagttactgaaacatagagttggaatttatattgcgtaccaaatgccactcgtactccgggtgttaagaagttcttttggcatgctccttcaatggaggcatttcctcgggtacccgcaggacatgaacattcgaaacttcctagtatattttttgcaggttccgtagcaatggtaattctcatgttcttcacattcatcaatatctacagtggaatattaaatttatttagaaaataaaagaataattaaatatcgagaaatattccatgactataataagtaattaaggatgaaaactatagaaatttaacatattcaccttggcagccgtgtaataggtaagggtttccttggtatccatgagtacagttgcagatgtagccgggtccgctggacgagttgacgcacacgctgttgctgctgatgcacgcgtaggagtcatgatctttctgcgcttccacgcaattgctcgcgttctgcacagcccagtcaacgaccattggcacccgcccgccgttggtatcgatgaactgcgatgaattcatcacgtagctcctccgaaagctaaatcttgatgactccatcagcaccgcatagctgcagctgctaacattgtagatctgcgtcgtgttgtagtccggatcaaacatcgtattgtaggaggtgtgtccctcggtgatggtggcctcgcagcagcctgtgccggagcaggcgccatccattaggctcgtcaagttattgcctttcggcccgcaaaacgccgagcacgcgctggcgtaccgcatgtcctccctgtctccaactgtgatgtacgccaccgtgtagcacccaacgattatgaacttattctcggtgtcggagagcctgtatgcctcggccggggaggtagaccgtgtcgctggactcatttgtcatccctttagtggcgctgttgtagcagtataggagctgatgttgttccacacccgtgccttaccatcgagcagagagatgctctccagctccaagtatccaacgctctccgtgaccggtggcaggaagggcttcttgcccttgatggtgtcacggcagatgagctcgaagccaggccacgagcagccggcctcgaacccgaaaggatacgagatcttcacgtcgccacatgccgtagagcagctgctacgaggaggtggcggcactagtggagaaatcatctttgctcggtcggtcaaaatccacaatagtcccggttgcaataaaaaccgggattaaagattatctttagtcccggttcaaaagtttagagctgctttttaatctttagtcccgattggtgttgccaaccgcgactaaagatctatttctaatgttaccaaccgggaaaaaagatgcctactatctttagtcccggttggtaagatctatttttagtcccggttggtaataccaaccggaacaaaagatcgtggcggagagtacgaggcatctgccatctgcgagatcgaggaggaggaggagatggcagccttatctcttcacctcttcaccttatctcttcatcccactcttcctcttcctcctcctctcctctaactcctctccttccctcccccatcctcccttcctcttcctcctctctaacttctctcctctaagtcctctccttccctccccatcatcctagatcgggcggccggcgggcggaggctcgggcgggcccgggcggccttgcacggcggggcggaggctcgggcggcggcctcgcggcgggcggcgcaccggcgggcggcgcggcggccggcagcctgtgttatttctttttaagaatttgtgattcggatctgtgtatttgatttgtgtgtgatgtccgtgaatatgtgatgtatttgtgatgaattttgtagaagttgtgatgtaattttgttttaagattttgtgatctatttgaatatggccgatttggggatttgaggatttggagataatttatttaggattttggaatggggatggagtgaaatcaatatattaaaaacacaatgaagaaaagaaaataataatagagcaaccggatctagctaggctagctctatctttgaatcgggactaaagatggatttttactcccggttttttcacccgggactaaagaacaatatctttagtcccggtttgaaatccaggactatagggggttacgaaccgggagtaaagcccctttctccaccagtgcgacgaagctccaacagcgagcagcaccgccaactgatctacagcacaaatccaaagtaaggatggcaacaatctctggaaattatgcatggctttcgattgtgttcctcctaaccaactgctggatgcaccttttttttctccctttgaattggagaggtgggatttaataattagctctcttaaactgtacaagtaccgtggattatatataaagttttccgagaggacctagtcgtatcgtgcaatcatatcatcctttggtaattggactgcaacagttccaagtcaatgcattagagagtggaaacattttttcactctgttttgctccatcagtttcatcagtttctccaggagtttatccagcgcgtcgcaatcttttcttcataggagtacttttccaacgcgttgcatcagcgccaccaccctgtagacgacctgcattcatccccccaatcccctctcctcttccactttaattacatgccattcagccattcaagttacgtcaaacaaacattacgaggcgcgcgaataggaaccctagcatagcagtgctggtgtcatatggcatgtaaatttgtgcttacgacgacctgtgtaaaacgaaacaacagtgcgacggatatatatcatccatgctcttacgcagccattttcttttccaacgtaatgaaaaagtacatgctaagacccgatcgcacatacaattaataaggctcaatttgatgcgcaagtagtgattgtaccacgctggcattaatttaaaatttctgtttcagttattactaagaaatactatatgaatttgcacgtaccgttgacaatattgtaatcaactgagttgttactagaaagaagtccattttacaatatttgactttgtgataagaggaaaagagaaggagaagaacgaaaaattacgtgatctattagcgcatgattgataagtatttaatactacctccgtccctattactcgtcgctttgactttttatttgcaatgtttgaccattcgttttatttaaaaaattagtatttaaagtacgtacttttgataataaaacaagtcacaaacaaaataaataataattctattttttttaataagacgaatgataagatattacaaacaaaaactcaaagcgacaagtaatatgggacgaaagtagtatgtttttgaaagaaagttttttatagaatatttttgcaaaaaacacactatttagcaatttggagagcatgtacgtctaaaatgagctgaactattataacatggttaattaagtgttaaatattttcaacttaaaaaatagactaatatgattgttttaaaacaagttttataaagaacttaacagtttgagatcgtttgtgtgaaaaataacagattcctctctctttaagccattgccgaactcagccttatactgcctaaaatatcaacatatataaacatcgaaacggttgtgcactgcacgatcacaaaacttggcaaacagaacacttctgaatcttgtccataagttataagagtaattttgctttaagaaaaccaattgttagggtggcatggaaacacaaactagcactacttcaaaagtgatttttctgtacgagaccccataatttttgcaaatggaccatatatagcgtctgaaaaatcgagggtcattttccaatacggctgcttgtgtggcccgtatggaaaaatcgattttcccatacaggcttcttaagagggccgcatgcaaggctcacttaagcgccgcatggaaaaatcaatttttttcatacgggccacttaagaaaccgtatgcgaaaataaaatttcaaaaatttgaaattagtttatcttactcatataaacttcaaattagatgatttttttcctaaatgtttctaaaattatgctctttcatgttattgtattcttactgctattattttggccattttttcttgtgactttctttttatcaattaaaaatttgaatttcaaaacttcgaataatattttgaagtagtaactgatttcagctgaaaaagtcacatcaacaaagttatataactcatcaagatctataacttttattttggtcatttcttcatccgacaaagttattgtaacatattctcaaaatttacataagagatatgtacatattcttcatttcttctattttggtcatttcttcatccgacaaagtttataaaacaataagagatatgtatattttgtgaacaatgttacaaaacactttttcggatgaagaaatgaccaaaatagaagttatagatcttgatgagttatacaactttgttgttgataactttttcagttgaaattatttagtatttgaaaatattgtttgaagttgtcatattttaaaattcaaattcaaactgttcaaacaaagtca

SEQ ID NO: 33269 - DNA, 20424 bp, Oryza sativa
  unsure (1)..(20424): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttcttttgacagtggcctcctaccggttagaagctcaagaagaatgactccgaagctatacacatcatttctggttgtgagttggtactcaactagatagtccgggtcaatataccctggtgtgcctttgggtacagcctgagttctcttatcaatcgtcgaacatccaaaatcagacacctttgcaaccaagccatttgcgagaaggatgttggctgtcttcacatcaccatggagtattgggtgtggcaaagagtggagatgtgaaagtgcgtctgcggattcagcagcaatccttaggcgggttcccagtgtgacatggaaccgcctactcctctgaagatctagcagctcttgcagtgttttgttctgtacaaactcatacacaagcatcggtgcctcaaattggaggcaacagccaagcaacttgacaatgttgggatggctaacacgacaaagtatgaccagctcttgcacaaactccatcttcctgctctcgtcaatctccttgcacttctttattgcgacggcaactccatctataacagccttataaactgttccctgccctccttccccaatgacatgtgccttgctgaaattatttgtggcagtctctatctcccctctcttgtagagggtgaacccatcatttccatctgctttcatcatttctagcaatatctggcctccatgttgttgaaaaaactcatcagtctgtcttaatagagcctgtcgtttaattttttgtttgtgtcgaatcacttcccatcctaggaatccaaagaggacagccaatacactggcaacaacacctatggaaacagagatacatgattagcaaagtgttttgaaactgatatgtttaaaacagagatcaagcagatcaagatgaggtaacatagagttggaataaatgtgtaccaattgccagtcgtgttttcggtgataagaggtcttttcggcatcctccttgaattgccgcatttccactactacccgcatgacacacacaatcgaaacttccaggtttattgtagcaatctccatagcaagggtaattctctccatgttgacattcattaatatctacaatcaaatgaaaagttttttagaaaaatatagcgttacatgcatctataaaaataggctccttttagtacaaaagctaatcaataatgagctgattagcttttagtccttgttcatttttctcacggtcactcaccatgatccccttgcccaagtacccatatgcaaaaaaaaaaaaaagcaattatctaacaaacttgaatttgtataggtaatttttttaaaaaaagacaataataaaattgaatggattaataatgttgtaaaacaaaaaatgaatccggcaatcttgagaggaggtagggggggacagcggtccgcgggaaaaaaaaagaaatctaaaatggaaaaaaagtgagaatatgaaacaaagactagaaatatttttaaaaaaaaatagccttgcttttgatcagttagctgaaaattccgaaaccatcagtcgactaataacaaagtgttgtcgacgtcggacatcgagtcgtctagcttcttcctactctcgatcgctatcatcaccacgcttctctcccacgcaaaatacagccaaatggtggcggtggtttcagaccagcaatggtgacaacaaatgtatatacgtcttctccggcaatggaccttaaaagcgacggcgacgtttggggtatctgttagtgttaggatcagggattgaaattttgcttcgaaatttcggaataggtatgcaactatctcgcctgaagtttttgaatttttaaagtttaatgaatttggtaagaatttattcaaattcagtcaaatttatttaaagtttgaccgttttgtgctccacataaaaaaataaaacaaacatggccatggtacatatgccttgctaaattctcaacatagaacatataaaaatgaaataaaaagtgagaaatagagtagcagaaagtataactaacatttggcgcaatggatctatcaaaccattcgacttcaaaaccttctcccctatgtttgtgtttataagagagaaaatcgtgctcaaatggcatggcagctcgggctcgactttatataggagaagctattttcgctggcggaccacttaagccatcgccatagaaaataataggagtggtggtggcttaagtgggccgctagcgaaaataggttcatcttcgctggcggcccacatcaccacaccgccagtgaagactttccatcttttttccatcttcgctggtggtcccttaggtccgccgccagtgaaaataggaatatcttcacgggcggcccgctttactcagccgccagcgaagatatgttttcgctggcggcccgtacccacgacccctccttacatatttgtgctggtggtcatagcccatggccgccagcgaaaattatagggcaacgttataaaaaatcggtttttaagtagtgagagggaaactgtttaattatatgcataaccaaattaaaggtctaatgccctcaaatacgaaaagaagttgaacgaaacgtacttaagaaagctgcgtatgcacagctcactgcatgatacaggtatttcatactagttaggaaatactcgatcgagtataatcacaatttcaaaattctggctatatggagtagagggaaaattaccttgacaaccgttgggacctttaaggtaaggattgccttggtatccttcttggcacctacagatgtagcctgttgtatcggaggagttgatacactttgcattgtcgcttttgcaagcataggatgtgagatttcccatagcttcctcacaagtgttggcggtgttgatagcccaatcaagcaccaccggtgcctcgccgccataggtattgttgaactcgaacggtgaagtcaggtaggtggttgaaaaggagaagttggacgcttccatgagcacagcgtagctgcagggggttcgattatagatccccgacgtgttcatgctttgctcaaaccacacctggtagtaatcgaggccctttgggatggcagtctgacaacagcctttcccagaacaggtgccattgatcaggctcgttagttcacctcgccggcagacggagacacagccgctcatgtacttgcccacgtcatcctgatcggcgatgtatgccagtgttcggcacccaataatagtgaacttgttggcggagtccgagaacctgtacggcgtgtccttcaggtccacataccacaggtcatcgaagttcatctctcgggttgagatgttatagcaggaagaagatatacgagtcctcacgcgggcctgactaagctggacatcgatgctgaggagctcgacatatccaaggaatggcttctggacgccattcccggtgttgttgcagtcgacttcaaaggaaggcgacatagcgcagccgcttgaactgaggccgaacgggtagacgatgtctacaccaccgcacttggtggcgttctggcattgcgacgacgctgcctgcgcaccgtcgagtgtctctgcagccagcgccgtgctcagcagtagtaccaatagccaaatactatcataaaacgcagcgcaaatagaagccacagctgctcctcggtggggagacatggataagcgaatatctgtgtgcttttggtggatatatcgagcacactacttttgcaacctcagttttcacaaggaacggaggaatcgtatataaagacgagaggggtgtagcactatcatgtcctacctagctacttgggtgctaattaaccacgaaaattaaaacaaataaacaatgatatgtaaatttatgtacacacccgacgactttgacttggcaagttttcgctaaggactgttcgttccaacgtcgttttacactgttctctttaagagctgaactgttccggagtacacgtagtgttttgaaatagacatatatatttagaggaatatattttagaggaatatatgcatagccaggtctaaaaatcttaactgatatatactgatataaatattaagacttgataggtaaaagtggcattaccatcataaaaacatattattttgaataaccattataattaaatatgtaatttagatgacatgcaaagaggcccggagacgtaattttttttttaaaatggtcaggccattgccgacgttttatattaagaaggtgtccaattttaagaagaaaacgggatcaaaccttacgctgcctagttaattaggaaaaactgagcgaaaaccataactacaagaccacaccatagctaacctaacatatgctaccacgacggagcctaacataaggcatcgaccaaaattgccatagaggcgacacagcaacctacacatgttatcgttgccgagcttgccacccaatcaacacagcagcttcgacttcactgcgatgctacctcaaagctaaaatgaacaaacaaaattgacactgacgaagcacatcagcccaaactaccaaggagccacttcctacacatagctagcatcaacaaccctataaggagattgcagtgtatcatcgttgctgagcttcatcgcacccgtacagtgaagcagctccgactctacccaacagtaaccaaataaggatgatgaacacccgcagcagagcaagaaacgagaccaaggcggcgaaggcctcgtcaaacaccttaggcctatagagctttggaagtgttgcaggagtccaccaatggctaggttgcacacggaaggttcttgctgctagaaggatcgacgccaaaacgacgcctccaagaaagggaatgacgcctaaaggcatagtcgccgtcatgccggcccatggcctggcaaggttttcaccagcgattcccaatcaaagcccatacaaccgttgtgctcaacgaccgtcgctggaccaccacgccatcccttcagcacccaagcctagtcactgtgctgctggcccgagtgaccaagcgtgacccacgctaacacgcagaccacctccagccacagcctcacggcgccgcccatggccacgcgtcgctacggccagaacctcatgacgcggagtggaccacacgccgccgcctcgcatgctgtcaggacgggccaacgacaatgcgtcctagcccgcggcctcgccctcctccttcgcgaccatccagcgagcatgccgctccagccgccgctgggccgtggcacgaggtgaagcaaacaccggcaccgtcgcgggcacaagtggcgcgtgcgcgttggcggcgagcatttccgatagtttagtttaattaactaagtgattagtagataatgacggtaattaagatatgatttttttccgaaagattttttctactaactgattaaaaactttcaagttagatttgaaaacttttgaagtcaaattttaaaaactttcaaaactcaatttgaaaattttcaactcaaatttgaaaactttcaactcgagatttgaaaactttcaagtacggatttgaaaaaatatgaaaactttcgactcagatttaaaaactttcaacttgagatttgaaaactttcgactccgattcaaaaactttcgactcagattcgaaaactttcgactccaatccgaaaactttcgactcagatttgaaaactttcaactcagattcaaaaactttcaactcagattcgaaaattttcaaatcgagatttgaatactttcaaatcagatttaaaattttcaagttaagatttaaactttcaactcaaaacattttgaaaaaaataagtgtgctaaagattaaaaaaggtaatcagaaaaaaccgaaaaaaattgcaaaagaaaaagaaaaaagcaaatcgtgaaaaaaaaaagaaaaaatgggctgatgggccggaggcccgagagcagctggcgcgcgcgccggtcccctaagtttaaggctatttatgacatgacaagtatcagtatggtttccgatgagaaatcaatttgatcaaggaaaaaaaaataaaatagcacccaaagctgctgagctctcggcgccgtgcccgtccaggggttcgctgttcatcaccattcaccaacacggactaagtcataatctctcatgtttgcattgatggagtccagatcgctgcatgcttgcgttcatggttgccttggattattattattttctttttaaaaaaaaaaactagtccagatcgtagtattcgatcgaatggaagacgactgtaggatatctggtgaataaacgcatggtgctgcgtttatgtcacactgaccatgtccaataataagatatttgggcacaaagtgtgtataaggtccgcgaattgtacagtgctgcgtacgttcatcacactcatcattttcaacaagatggtacgttgagcacagctcaaaatggcgccaagcatacaaatcgtttgctggtcaagtcttggttgcatctggcctttcttcgtagcaatgttcaacatatcgtacaggaatcatcaatcaatatccatggaaatccagctacttatctacgatcagcgtgtgtgttccgtccctttccttagttcccagtcccagtcagtcgtgataacgtgcagcctttcctctgctttttagcctctaggtatccacatcaggaatttcgacgccccctgtactgtagtcgtcgcaaatcaggagaggcgaatcgacagcctaaccgatgctgtaaatatagttgctatatggtggtgatgatgcatgactgttggcattcgatattacttccttcgtttcacaatgtgaatcgacagcctaaccgatgctgtaaatatagttgctatatggtggtgatgatgcatgactgttggcattcgatattacttccttcgtttcacaatgtgaatcgacagcctaaccgatgctgtaaatatagtgctatatggtggtgatgatgcatgactgttggcattcgatattacttccttcgtttcacattgtaactcattctagcatttcccacatttatatctagatagatatctatctctatctagattcattaacataaatataaatgtgggaaatgctataatgacttatattgtgaaacggaggaagtataaatcttcctgctgctgattgcattcttagtgaaagtgtcaattaggcctagaggggggctgaataggctaattcaaaaatcaattaaaagcggaagcagtaattttcagatatttccgaaattttcggatatatccgaaaattttcggagtcagcacaaatagcaaagtaaatcctagatctagttgcctacaacaataatatgctagtacaaacagcaactagacctatagcggctcaaacaagcaaagctagtggagagggaggaagtaaagtcaccaaagatgaagctcacgaggttgttcccgaagttcgaatccttgaggggattctactctccgttgaggagctcactaagagccgggtcttagctaaccctttcctcaagaggttgcactaagcactcctccttccactaagggtatctcttccgtttcggaggtgagatccgaccttcacaaacttctcccggccaaccacaagtagatcggtggctcgggagcgacacctagccgcctaggagtcctcaacctccaagaataacaaatgaagcaaagaactcccggagatgatgcaagtgctcacaaatcttcatgaagtcaatgacaagcactcacacaaactcgaatccacaactctcacacacacaccaaatccaaatcgaacacgggtgagagggaaaacaagaaagcaaggctcaaaagtgctagagagagagcaagccaagggcacaaatgattggaatggaaccagcagccctcacaagtgaggggagggggctatttatagccacagcccagattctgcccattatacacaataattgagattttcggatatcccgaaaggttttcggacatgtccgaaaattccagctcagcaccaatagcaaagtcaacgaaagatttttcagacattccgaaaaaaaatttcggataagtccgaaaattttcagcaccaaaacatcattctggatgttttcggaaaagtccaaaaatcactttcaaacaagtccgaaaatacacaaaagcgacttttgcctttactgaagttttttggaaactccgaaaatcaatttcggaaaagtccgaaaatgaacagaaccatatttgccttcacagtcattttcggaaagtccgaaaatgtctttcggatatatccgaaaatttccagaagcgaaatctggttctgtgcattttcggaaagtccgaaaatggctttcgaataactccgaaaatttccagaacaactcaatttgaggagaaacactttttaaaaattgattttgagcactttgatcactcctcatatatcaatgcatcatccctcttaatagtgcggcattcctattgactcaaacaaaaagaaaagttacaatataccatttgtcctatgccgcatcacatctcatcaacgtatttggcgggatatgcattattctaatttattgaggacataataaccttcacatttgcttaaataaaaatgtcagtcctctttaatcgtattgtaattaatcaccaaaatcattaggggcctagatacaattttagttaggttgttccaaaccaagatataatttttttaagcccctggggatcgggacaagaggtactatcatactcccttcgatgtgtctagatgaggtggccggcactggtcaccaattaatacagactttgcgtgggctagcactcctgccacagttagtccgcgctcttgtcacttgtgccaccaccacgtcagacgtaaactatgacagtgtgccacgttatgccacctaggacaaaaccgtcatataaatcatcgatagatttcacttacactggttttaacagtttcgggatgctctatatccggttttgtgattcaggtacggatgaaacttggctcatagttaaggtaccaaaagtgaacttttccataagtgcgtaagaaggtgttttgcatgcggttcagtttttatgcggcccaaggactcccactcgagcctcgtctaaaagcatcatgggctgataagtgaatataaaaggaaaaagtccaatttgactccctcaaatataggtagaaatctaattcgtatccctaaactgtaaaaccgggaacaacgtatcctccaatggttaaaaccgtgcaacatgactcccaggctgtattgacggtggtatctactgatctggcatccgcgtggcagcctagtcatcacaaaaaataacaaaataatgtgggtcccacatgtcatcctcccctccctcaccttccttctcttttccattctctcttccctacacagcagaggggcggcaacaggcggtgctatggctggaggtagaggagagggcagcggcgagaggcagcagggcaccgctcgacaaaggtgcccgtctcgcgcagatggaagtggggatctaggtggcaaggctgggtcaaagcgcgccggcgagagcattctagctaggacatgttgaggatggcctggcgcaagagcgtgcagatggcagtggagagctcgccgtggaggttgatggcgtggggcgtgacgacggccaccctcctgcaacgacatagcaagcaatgcgtggccacccacatgggtcaccgcgactcaccgccgacgctcaccatgtcgtagttcgagagacggtctacagtgaggtgtggttctcttcgctggagaagagcatcaagttgcggagctccacaaggccaccgccaccgtcgtcgtcgcctggggactcagctattgaggtggatggctctagtgaaggtgtaggcgcggtaggtctggctcggcgcggatggtgagggagcgcagagaaggtggaggcagtcgaggagagcatgtggggaggaggcgggagtggccgaggagagcgcgtgggaggaggcggtggtgattcttgaccactccactccctaccagccctgccggccccgtgaacagtgacgatactcttgtcggcggggcggtgccgctcttttcggacacagatcttgctcacgccgctagtgcttgtcgctcgtccggcacgccctgtcgccgcttcccattatcatccgcacgggccattgctgtggagaagaagggaaggaagggctgaagggggaagaggaaggggagagagaggaggaagaagaggcgaggatgacaagtggggcccacatgctaagtcagcctattagactaggtcaacgagccatgtcagcataggatcaacatatttgatattatttattatatatatattgagggatacggattcgattggacttatatttgacggagtcagagtgaacttattaaaaaaaaaaaaagggaccacccgtggattggaccccaatctcgcctcttactcggcccaatcaaacaaggtccctggagctcgagaccggagcattttatcccctccgtacgaaggaattcgccggcggcgagcgcgagcgcagtggtcagtcgagtgatccacccgacatcggaatccaccggcgcttccccacgcttgcgccgcagccacctcgtccactccacacttgcctccgcgccacctctgcctcttcttggttccgcctcaagaaacaaccctaagccgccggcaaatcgccggccgtttcctttgaggtatatacgtcgcctccacatcctcttcttggttgagatgaccgagtaagaaggccgcgtattagttagagagatcctgttgggaatagtcccacattgctaatctagggggagttgaaccaacttaaaagtggggggagcccctcacctcttagagctagcttttggggtgtaacaaggctttctcctggttttgggccaacagatccaagaaaaatcgctcaaccatatgatgggtttactaaggtgcctgtgcatccaaatatgtcattccaacagatcctgttaaagttagttcgctttgtttgtacacttgtttgcaccggcaatttcagattttaattcatatataattgcagacatttgtggaacattggtttatttaaccagcattagaattgagatatgtagattgttacattacttcaaattttctgcctacagagtacagattcaaaagtttgtctatgctaactgatttggaggcaagtaattaaataagttactatgttcattaatgttttgtagatgaataaataaataaataggttattttcttgcttgttcttatttgtttatctcattatctgcgaagataagtaggcaaactggaaacacattcagcaaaaggtttagcatttcattactgtctgtatgcttcgcagacattttgccatgatgtggttcattataatttccttaattttgaccagggatctggatacctgctgaaccttgagattacctaactagcactgctgcgtttctcaatggagcatctctcggaggaactaatcatcgagattctcaagaagattacaaggacaagcgaccttaattctctttccctggtgtcgaagcagctctacactatcgatgcagagcaaagggctgctatacgccttggttgtggacttgcaacagaagatttcttagcactttgttcccggtttcctaatttgctcaaagtagagatcgattactctggttcaacacctggtaatgggaaccatatcgacaaccaaggtctctttgttctttcatcttgttgtactttgcttaatgatattaccttaaccttctgctcaaaaatcaatgatgctggtattgtttgcctatcttactgcaagaagttgatatctctaaagcttaactccctaccagaagtaacttcaagtgggcttctcatgctattttttggttgcaaggccctatcttctctcttcattaatgattgcaagggaattgctggcagcactgagtggctggagtaccttggcactgatggatcattggaagaactcgtcgtcaacaattgccaggaaataagccagtatgactttttatagtttggtcgaggatggatgaagcttaagaaatttgagtttgaaaataaggaaagcttgtggaaacactttggccccagccatgactcctcgcacaatgctaactgtgtgtatagatatgatttgtgctgtcagaatttggaggacttaaggctggctcgagttataacagagccagaaggcccagaaactggactacgttttctgctgaggaagtgcaaggcgttagagagactatgcctggagtatgttaacggtgttattgacaaggacatgattgtgctatcccagagctgcaagaaccttaaaagcatctcactttggatgatacctggactctaccatgaacctgatggcatagttttcagaacggatcttacagatgaaagccttgaggctctaaccaacaactgtcctttgcttcaggatgttgagctcgcgtttacaggtgttgatcactgggagcctccagaaataggcttcatacaggagggacttgtgaagctcatgcattattgtccaatccgtactctcacactaaacggtgccctcttcttcaatgacaaggggatgaagggactctcatctgcaccattcatggagacactcagcctcgtcgattgcaaggagattactgattctggaatgtgcttccttgtgcagtacccatgcctgactgatctcaagctccagcattgtcctggtttgacagatgttggaatagctgagcttgtacatgcgcagaaattacagtctctggttgttgatggctgctgtaatatatctgaaaatgctgtgcagtgtgcagctagatcagtccagtactttgtcaactctgccggatcatgtgctgcccattttaaaagactgcattgattgaagctgttaattcgttgctgaccgcacaccatcggtggatatctcagatggagctgttgcttttgctgttaaaccatatcgtctctgtgatctgatttttcagttttcactgtcatttttgaacttgattttactttgccccttttgttcctgttattctctctaagcataagagcaactgagcaaaccatatgatgatgtactctgcaggcatctcatcactctgtgtccacagctaatgttcagaagagtagtctccagcgatcggaatttttcactttggcgtcaaacttgttggtatcctttgcatttatcgtggttttcaacttgttatagttttagttgcaaatatatctttcatcaaatttgggaatgcctgatcagttcttacacataaacaacatttggctggtactacgtgtaatgtgtaatcttatcctgagttgacccacactcctaagtgagcaaacacttttttacagcgtaacatgtgagcaaacgtgctgctgtaacagttgtgcttcaggttccttcttttttcgacttcttttttctattaaggccctgtttagttcttaaaacaaaaattttcacgctgtcacatcatatgtttggacacatacatggaatactaaatgtaggaaaaaaaatcaattacacaattgcgtgtaaattgcgagacaaatcttttaagcttaattgcgccatgatttgataatgtggtgctacagtaaacatttgctaatgatggattaattaggcttaataaattcgtctcgcagtttaatgacagaatctgtaatttgttttgttattagactatgcttaatacttcaaatgtgtgtccgtatatctaatatgacaaccaaacctaaaatttttccccaaccaaacaaggcctaaatggtagatgcgtacacccctacacacacattatcgctaatatgccacctaacacatgctaaaaaaacaaaaaccagcagcgcattcctgatttgactaaattcatgtgaaaagtccacttacatgtgtgtaatattcatgaattcaaggactttaaactctaatgcgtcgagtcatgaagctacgacttcaccacatctctgtgctttaccaggttcccgtattgcaggtattttgttcttttctttcaatcttatatgttagggggacctataaccccacgggtagttataggtcatgcccatgtactctctgcattccagaataagttgatctaatacggaatatgtcggatcaagatctggtgcagttgttactatgactgcaactttagcagttgcagtgcagccgatggatcaaaaatcaacggctcagatggaaggaaaatactgttcagaaaacactgtagcaaatctgtactatagcgattactgtagcatcgatggtgcaacaggatgacagagcgaatccgggcgttggctcatcgatccaacggctataacatgctccgactgctaaagttgcagtcgttactgctacaacaccatatctcaattcgaatatgtcatattatactctaatctatagtacttggattatgacctatgggacaattttttatgggaaaaaagtccgtgttacacctagaaatattttattagatcacttaaccctaaactattttggctgattttacctcttaaattgctaaacatgatttattttacagcttagtggcatgcccccatatagaagtcatattttaagatgaatttttaagtcataggtgacaacactaccaaagttccaaaattctaaaaatattgagatgtaaactataatgcatctatcaatcctatcaaatttcaatgcaaaaatacgatttacatagaataaaaaggagaaatttctttacagggtaccatgaactattttcaatagtccaagggtgtaaaatgaggcagcaaatagtctgtgggttaagtgatcagttaaaataatttgagaatgttaaatggacttttttttttacaaatttaacttatgtgaataacaggctttcacagattctaaccaaaaaaagaagttttcttgttctttcgaaaaaaaattggcataagtaaattttctacatttcattaaatttcaattttctttccaaaaaaaaaaacgacccaaaggtccaggaggccgaggcccaattacgcgacacaaacaacgcgagttttttttgtttttagatttttttttttttaatatttacagaaatattatagcgccgaaaaaatttgcaaaactagaccctgccgcccttcgcaagggcggcaagccgacgtggcacacggcgccgtgtgcgtcttgacggcgcgcacgggccgcggggagccgagggcttgccgccctctgcaagggcggcagcttcctctctgcacaacggctggaaaggactcctgtttttggaaaacgtaacagcgaagtgtaggaatgcgagtcccgaatataaacaacaacatattcagtttacaaccatatagtacaagaatgtaaagaaaaataaagagatgtctgctctactggccgtgactcgcgccgcgaccccgcttggtcctccgggcctgtgctcgcacgtggtcctgggagtacgtgaagcgatccggtgggacagcacgggtagcgcgagggtctgggagtggggtggagggcgactgctcctgcgtgtgcaccggcggtgcgcctccaagctgtgagggaccgataatgtccgggaagtcgaagtcactaatgtcgaagtgcgtggcggaagcccacccgtgctcggacgaagtcccggtaggaccctgccaagacgtgccgggcggctgtgacgaagtcccggcgtcctgccagaactgcgcagacagcgaggccgacacacctgcctgtgacgatgaccccgcagcctgccaggagtgggcgcccggcgtcgtcccaggctgagcgaagcctacacatcgacgacgcgacacttgtaagcttacacataaattgagtatcaattgattgatgatgtacaaatagaccttgaatatacgtacctccgaagggagggggtgtcggcgtaggaacgtgcgcagctggacgaggagcagtcggtcggggacgcacctgtggtgctgcgtctgcctgagcaacgtcggcagcacgacaggtcagcgcacggagaaccgagcgcatcgagtcccgtatccgcgtgtacgtcgacaggtgctcgtctgcccccacctcaatccccgcgcctaaccgttggatcgccgttgtagcatcaacgacgaccctgttgcactcaacggcctgcacggttaattacaacgtaaatattcgtagcctttgtccaacagaaaggatgatgagacgatggtgcgatgcaaggtactcaccgcacgagcgaagtcctggtcgcggtgcctggcgtagaggtctctggcgctcgcggcgtgggcctgttgctccgtcggagcgtaggtgactctagtacgggtgcgtggctgataccaacgtaggtacgcctcatacccctcctccgtgtgtggctctcccgcgtggtccacgacctcctcggtagcaagcaaccagtcgtcgagaaaaggccccaacttggcaggccagtgaccagctgagtgctgacccttgcgcgagtacctgcaaattaatgtattgtattagggcaaacgacaaacaaagcaaattattatggacagcccgatgttaatgcaacatattaaatcgtagtaaaacggcttaccggtgaacggcagccgtgacgcccgccggaaacgggactggaaaggactgacggaagccgaactgccgcatcacgcggtaaggtgcgtgcggctcgacacagatgtcgaacaccatcggaaccgtagtcatccagtacgcctggtccctcgtgcagagtgtggacaggcctagcggcgcccgactgtgggtaagcaaggcactgtagggctcccacactacgtccgtcggcagaaggcggtcgaactccatcacaaactccgcgtacgaccgcctaacctgcacgtgagcccatcggcgctgcaatacaataaggtcagtgtgacgtaggatgaagttaacaatagtaggacaacattaccaaatactagcgacgtacctgacgccggcaccacagagtacccatcgttgggtagtcgaccgccggtctgttctcgtacagcgacgcgtcgtaagggtggtgctccacaagggggcggccgatcgcaatcctctcagccgcccaaagagaaatgaagagagggcacccaccgaagatcgcgccagggtccgtcctggtacaagcctcgcagaggccacggtactgagccgccagcaacgcggagccccaactccactgaggcacctcaccgaccgcggcgtcggcgatgctcctggcgtagtgcacgagaccccggtcgaccgagtgtccgtgactaccacagaacatcacccacccaaaaagccacaacaagtacgcctccaaacaacggctgaaggagtactcgtcggcctcctccggtagctggtcaacctgcaagcgttggatgaaatgttaggcactttacaagttacgtacataatacacgtcagtttaggtagaaagaacttacagtgaactgaagcagccacctcttcgtaggcccggtgttgcggtgctgctgcaacggctcgagcggtagacctggtaggcgctgcacgggtgcgaaacgtgccgtcagctcgtccttccagtcgacacccatgtcaactggcccgacagcgtctcccgcgagcggtagccccaacaagtaagagacatcctgcagggtaggggctacctcaccgcacggcaggtgaaaagtgtgcgtctccggcctccaccggtcgaccaacgctgctaggagggacctgtccgggtcccaacgtctcgtcacgtcgtcgtcgccggtcgcggcctcaactagccgagccaacggtaagagaccggcctcacgcaacctgcgaaagcgaaataataccagacgttaaaatgaacacattgctaagccccctccaccgtagtaaggtaagcccggtgtcgtgaacacagtaaaaccatacctctcgacgaaggagtcgtgaaccaaaagtcgctcacgtgacgaccgtggacggaacgtcccaagctgagccccctccaccgcagtaaggtacgaccggtggcgctgatctatcgccggatccaacaactcaggatgtgccatctctgcaagtaacgtgttacatgttagggtaaataagaaggtaataatataattgtaaaaacaagttatctgaaacggaagaatacttatagagacatgcaagagtgcagattattgagaacataactttcgttacacaaaggcacgtaacgagaatgaaataacataaaacaaaattacaagccgtaaaacataaagacattacatgcggaagtctaacaagtggttcgcaacacaacacaatgcgaacatatcgataagttcgaacgaaattacaagcaaagccttttgccaacatacaacacacgaactacaccacgtaaccggtcgttccacgtgaacgtctaggacggggtcgccttgaagtagtgccttcacccgtagggcgagctccatctgctgctgatcctgatagacctgcctccgccgcacttggtttttccttgtctttaggacaatacttgtaggtgtggccacgttcatcgcatttgctgcaccgcttcaccctgcctgcctccgactcatccatatcgttgcggatgcgccgagtcttcctccgtcccgccttgtctcggagtttcgttgggtcaggaatatagattatcagatcgttaatctttgtgaactccccagctacaccgaagccaaaaatctcgccactccatgtgtgatatattgcttgcttggagaagtattgtgacacatatactgcatcttggatgccacactcagatgccgcggaaatgacatgggtgcatggcctgtggagcagcgtcggctttctacaggagcagtgacatgtgccgtcgtctttgagaacgcactcctgctttactctcttgcggtagatacccctgcctgccttgtcttggcagagtacctcaaacctgtgttgttgggtaccttgcactagagctcgatgtttcatggcctttgcacgccactccgctagttttttctccatgaaagttccaaataaaatgttgttgttcggcatagagggaaaaactgcttggaaccgctccctgaaatacttgcatgtcccatgtaaaatgaactccactataccaactagtgggagtccacggacaccgcgcatcacccagttgtaaacttccgccaaatttgttgtcattataccatatctagcaccacctgtgtcataagtcttagcccatttctcttttggctcattctcaatccactgagaaaattttcgaatttgctccccagttcttctaaccaatgttacactgtctgttgggagagctccgagtgcttgaggagggtcaggtacagcggccgctggtcttgttgcacgctggtcactacatttgcctgtcaactcatctaatctcttccaaagctcattgaattttttctcctggttctgattgcatagcctcttgaacatgttcatcaactccttgttcttaaattgcttgaagaaattagctcccatatgacgcatgcaccacctgctttgtacatcttcccactggccagggtatcctctttccatagtcccaaactttaactcttctatcgctcgaagcataccggcgtgcctgtcatgtattagacacacattgggcctcataccaacaacttctgtcttaaccagatggaggaaccagtaccagctgtcggtgttctcgctctcgacaaaagcaaatgccaacggcaatacctgattgttcccatctaccccaattgccgttagtatctggccccgatacttcccggtcaaaaatgtgccatcaatacaaagaactggacgacagtgcacgaatgccatcttgcatgcatgtagagctaagaacgctctttgcagcacagtcttgccaggatgttcaattgaggggaatgtcttgagtgcacaagaggtcccagggtttctttgttggataacagatagcagacgtggcaaattgtcatatgaggcttcataagttccaaa

SEQ ID NO: 33270 - DNA, 25757 bp, Oryza sativa
ttgaccatggtatagttgaaatataagtttactggacatatctgcaaagttaattactaggccgttattttacataataaacgactacagtgtaatatcttctttgcaacgtacctaaatttttatatattctattgcaatgttactcaacaacatttaaaactacaaacctaataactacaaatactacagatctactaagttacctacatggctacatctaacaatatatatttatatagtaccacaggtaaaactctatttcatacaatgcatttatcatatatttagtcacgtatataatctacgaatattacctgaaatcgaagtttgaaactggcagggcttcgcctcttcttttcttctcctccccttctccttttttttttttttttgatgtggagaggttaggagggaatgggctcctcaaaggagccggctgggctttataggcggccaggcctgccgccttctgtaagggcggcaagggggtcctgccgccctttgccagggcggcaagagggcaggagggggcaggaggacggccgtcccgcgccgtccagcgcgccgtgtgccacgtcggcttgccgcccttgcgaagggcggcagggtctagttttgcaaattttttcggcgctataatatttctgtaaatattaaaaaaaaaaatctaaaaatacaaaaaattccaaacaacgcgagggtttataccctctccgccgccgggggaaggggaagagctctccgccgcccgccggtgcccgacattgcggcatcggcgagcgcgagcgattcatccaagaatcgatcgagctcgagcgggggctttcctccaccgcgatccgccgcggccacacctactcctccacggtcacctcctcccccgcctcttcttggttcttcttcaaggaacaatccctcgtcgaggtatatatattcatctctatgtctcgccgttgctcctctaccttgctctttcagttcttggctgagaactcgggattaccgaggaagaaaccagtgcgttctgtgatacaaaaaaaaaaaaaagaaattttgatctttggctcagttgcatgatgtctctacctgggcgcttcgaaacatgttaatccagcagattcgtgttgcagtttgtcttgtgattttgttaaacttaggctgcttgtttcatcaattgcctcgtaaattccaggttttagtttgtataaatgctgatgttttttttattaattgatttgtggaatattcgtttgttcttttggacaagcaattctaagattgtaattcgtttagtagtagatcacttgtttatcaattgttcctgtaaaccaagatactacatagtttgttacattaattcccttctaggtttgcaaagctgctctgtgttaactgatttcgagataaattaatatgtttctgcatttattaataattttatagatgaataaataggttacatacttgatctatttgtgaagataagcaaacgaaccgtgaagcccaaacatgtacatgaaaaagcgaaaagttttttgtttcgtcagtataaatatgcgacatgaattttccatcatatattcatgcggttcattatgatttcattaattttaatctagggctctggacaactgctacaccttgaaagacctaactagctctgctgtatttctcaatggagcgtctctccgaggaactgatcatagagattctcaagaggattacaaggacaagcgatctgaattctctttctcttgtgtcgaagcagctctacgccattgatgcggagcaaagggctactatttgcattgattgtggactttcaacagaagatttctcagcactctgttctcggtttcccaatttgctaaaagtagagatcggtaactctggttcgacacctggcaatgggaaccatattgacaaccaaggtctctttgttctttcatcttcttgtaattcgcttaatgatctcaccttaagcttctgctcaaagatcaatgatgctggtattgctagcctaacttactgcaagaagttgatgtctctgaagctgaactccataccagatgtaacttcaagtgggcttctcttggtagctttcggttgcaaggctctatcttctctctaccttaatgattgcaagggaattgcagccagcactgagtggctggagtaccttggcagtgatggatcattggaagaactcgtcgtcaataattgcccgggaataagccagtatgactttttaaagtttggtcgaggatggatgaagcttaagaaatttgtgtttgtaaacaaggaaaccatggtgaaccacttcatcactcgccatgacccctcatacaatgctaactgtgtgtataaatatgatctgtgctgtgagaatttggaggatttaaggctggctcgacttcgaacagagccagaaggtccagaaataggactacgttttctgctaaggaagtgcaaggcgttagagaaactatgcctcgagtatgttggcggtcttattgacaaggacatgattgtgctatcccagagctgcaagaaccttaaaagcatctcactttggatgatgcctcgacgcttccatgaacatgaggttcttaggatgggtttcaccgatgaaagccttgagatgctagcccacaactgtccattacttcaggatctcgagctcacatttgcaggtgttgaggacttggaatatccggaaataggcttcacacaggagggacttgtgaagctcatgcattcttgtccaatccgttctctcacactaaacggcaccctcttcttcaatgacaaggggatgaagggactctcatctgcaccgttcctgaagacactccgcctcgtcgattgcaagaagataactgattacggaatgtgcttccttgtgcactacccatgcctggctgatctcaagcttcagtattgttctggtttgacagatgttggaatagctgagcttgtacatgcacagaaattacagtctctggttgttgaaggctgctctaatatatctgaacatgctgtgcagggctcagctagatcagtccagtactttcccaactcggccagatcaggtgctacccatcttaaaagactcgttgattgaggctgttaattggttgcttttgctgttaaccctattgtctctgtgatcggacttttcagttttcaccgccatttttgaacttgattttacttttcccttttgttcctgttattcgctctaaacataagaccaactgagcaaagtatatgtactagtagtactctgcaagtctgcaggcatctcatcattgtgtccccagctagtgtactgaattttcgtgtcaaacttggtgttggtggttttcagcttgtcataattttagttgcaaatatatatttcattaaacttgggaatgcttgatcagttcttacacataaacaacatttggctggtcctaagtgtaaatgtgtaattttgtcttgagttgacccacactcctgagtgagcaaacatttttttacagcgtaatgtgtacaaacttgctgcacttgtgctacaggctcctttttttttcttcgattacacggctgatgcatatggatttacaccactacacacgcacatccacgaattcgctccttaaaacacgcttaaagagacgaaaacctgtagtacatcctaatctcgctaaatttctattgaaagctcacttgcatgtgtaatatttgtggacactagagctttgacatgatgggttggtgatcttgttccaaggggttagccatgtccatgtacaatacaatgtagtggtatgtatatccactctgatgtgtttttagacctaagctctataaataccagttgttagagtgtgtaacttggtccaccacctatgggccacaaagagtcatgcatgttgggtttgctatcccataggttcaatcaactcgacctacaatttcacatcataagcttacataacctaaaagattagtttgacggagaaagactctacaccttttaagatgtgctacttcatcattaattagaaaatttggtccgaattcagtttactcttaaatcaagaaacatttagaactgaagtattacgatgagcggtgacagcaaagatctgattagtagcattatgaacctatgggcgacgttactcttaaaaataatgagttcggagatgaggggaaataaaatgctaaatttgactacgacagtatttggatgtatttgaaaagattaaaaatgaaataagggacgtttttttttaaaaaaagaaagtctatgttactctcccaaaatattttgttggatgacttaacccctaaactatttttttctcattttaccattaaactattaaaaattatttattttactgccgagtagcatttctctttgtgcaacttatatagatagaaaaaaaacagaaattttgttacgagtaacatgagtcattttaaatagtttgagggtgtaggttatgtgatcggctaaataattcaaggagtaagataaacaatttttcaacaatgtttagtttacatgaaaaatagggtttcacacaatataagaggaaaaaaaagagttctccattttttttaaaaaaaaagttgcgataaggtgaattttctacatatactattaaagtttaatttcctttcgaaaaaaaaacatatgctggtatttttattctaacaaataaagaaaatgaaaaaaagggagaaaaaaaaacaaacgacccaatgggccaggaggcccaggaacgcgacacgagcgacgcgagggttttatcgctctccgccgccgaccggagtaaggggaagagctcgccgccggtgccccgacactgcggcggagcgggactgcgggagcgaggtggccgcgcgcgagcgaggctttcctctacctccgccgcatccacccctcctcctcttcctcctccacgatcacctcctccccaccctgcccagttcggctggtcctctcccgcccgccttcttcttggttcctcttcaagaaacaatcccggccatcgatcgccgattccttcgaggtatgtatctaccttgcgctttcagttcttggctgaggactcgagattaccgaagaggagacaagtgcgttctgagattgaatataaaaaggaaatttaatcttcggctcagttgcatgatggctcttctacctggacgcttctaaatatgtcgatccagcagattcgtgttgcaatttcttgtgatttttttttaaacctagccctgcttgtttcatcaattgcctcgtaagttccagtttttagtttgtataaatgctgatgttttttattaaattgatttgtggaatataattcgctcgttcctttgaacaagcaattctaagattttacttcgtttagttgtagatcccttatttatcaattgttcctgtaaaccaatatatacatagttgctacatttattcccttctaggtttgcaaagctactctgtgttaactgatttcgagataaattaataggattctgcctttattaatcgttttgtagatgaataaataggtcacatacttgatttatatttgtgaagatcagcaaacgaaccatgaatcgcaaacatgtacaggaaaaagcgaaaagttttatgtttcatcagtatgaatatgctacttgaattttccatcatatattcatgtggttcattatgatttcattaattttaatccagggctctggacacctgctacaccttgaaatacctaagttgctctgctgtatttctcaatggagcatctttccgaggaactgatcatagagattctcaagaggattacaaggacaagtgatctgaattctgtctctcttgtgtcgaagcagctctacgccatcgatgcggagcaaagggctactatttgcattggttgtggactttcaacagaagatttctcagcactttgttcccggtttcctaatttgctcaaagtagagatcgattactctggttcgacacctggcaatgggaaccatattgacaaccaaggtctctttgttcttacatcttgttgtactttgcttaatgatattaccttaagcttctgctcaaaaatcaatgatgctggtattgcttgcctaacttactgcaagaagttgatgtctctgaagctgaactccataccagaagtaacttcaagtgggcttctcatggtagcttttggttgcaaggctctatcttctctctaccttaatgattgcaagggaattgctggcagcactgagtggctggagtaccttggtagtgacggatcattggaagaactcatcgtcagcaattgcaagggagtaagccagtataactttttaaagtttggtcctggatggatgaagcttaagacatttgagtatgaaaacaaggaaaacttttttagtattcacccacgttatggctcatcagtcaaggctaacacacatagatatgaactgtgctgtgagaatttgaaggatttgaagttggtgcgtcttgtaacagagccagacggcccagaaataggacttcgttttttgttggggaagtgcaaggcgttagagaaactgtgcctggagtatgttactggtgttattgacaatgacatgattgtgctatcccaggcctgcaaaaaccttaaaagcatctcactttggctaaaaccagaacattacgttgttggtggtcatatagagttcaggacaggttttactgatgaaagtctcaaggctctagccctcaactgtcctttgcttcaggatgttgaactcacatttacaggttgtgcgcactgggatccccctgaaataggcttcacacaggaaggacttgtgagtttcgtcgaatcttgtccaattcgtgttcttgtgctaaatggtgccctcttcttcaataacaaggggatgaaggccctatcctctgcacaattcctggagacactcagccttatcgattgcaacgaagtaactgatcatgggatgcgatttattgtgcattttccaagcttgattaacctcacactccggttttgtcataatgtgactaatgctggtctgagcgagctggctcatgcacaaaaattacagtctctggacgttggtggctgtggttacatttcccagaaaggtgtgctgggagctgccaaatcagtctactatgaagtgaattgcaaaagtcttggccattataagaggatgtgttgaagctgttaagtcattgcttagagtgcatcattagcattaaccagttatctttttctcgtcttactattcaccatcattttgtacttgccagtacttaattgctgtggaaagctctagcataagaacgtgttatggtgtagattgtggaatgaacgaaaatcctcagtgacttccagcactagtgttctcaagatggttctgcttattttgtcttgaatgaagttcagaattcatctttcaccatcattttgtacttgctagtactatcagttagtctttttattgctgtggtccgctgtagcataagaacggcttcttgtgtattttggaagatggctcaatgaatgaaaatcctcaatgatttccagcaatgatgttgtgaagattattctgtttattttaccttgaaattcatataattcagcctcaggattttcgttttctgcaacctttggagtcaaaactcgctattcctcattgccttctgacctaatttaatgcggttttcagtaggatatatcaataatcaatagttgaaaatgttggatatgtatgtacgttcaatcactagggatgaattgactgtgtgggaataatgtatttgtacaaatttaccatatttcttccgagcaacactctgagagttaactaatagagactctttcaacggaaagtttcatttcaaaatttaaaattccgacattaactaaaattttcaaacttcgaattcaaacttccaaactcaaaatttaagacattgtacattttttaaaaaaacaaactcctgctaaaatatactccatccatctacctttgatagtcatatttcatcttaacacatgaccaaggataagtaattttacttatcatacatttgaatatgctactaatcattcctcgtaaacaagcgattcattaatatttacatttttcgatgcccatgtagccaatcttgtgtggaagaataaagagtcacgtattaaatccgagaaagtcattaagaggataggttgttggattgaaatatgcctatcaaaaataaatttttcagatttggaaatatgactataaaaaatagatggatggagtactaaagttattaacgtgattaatttagagaaaaaaagtcgctaagcgtgtcattatggcggatgtgagatagcggatgtactagccgccctctttaaagtgagtggtgattattttgaaaaatgggctcggagataaagggtgataagaaattaaattttagtagcatgatatttttgatctatttgaaaagctaagaaaatgatttaagggacaatttttacttcacgtgaacaataggctttcacacagtgtaagaactaaaaaaaatagaagttccttttaaaaaaataatgttgcaaaatgtacatttgcaatatattatcaaaattttcatttgctttggaaaaaaacatatgctagtatatataaaggaggggaaaaacattgaaaaagaataaagagaccatagggccaggagcccagggcccaacaagaggcccaggacgcgagggttttctcactggaataagatcactttgactccctcaactgaccaccgaatctaaatcgtatccctcaatcgcaataccagaaatcttgaacccccaacttacagaaccggtacaatttgactcccttggtggttttggagagtggttttgctgatgtggcgcacacctggcagtgttgacttggtcttcgtcccacgtggaattgacatggcgcttacgtggcattaaaatttaaaaatataagcagggcccatttgtcattcacacaaaaataattgtaggccccactgacatgtgggtcccacatgtcatcctctctttatcccttcttcctcctccctctcctcccttctctatctatccctctttctcacatgtgggccgccggaccaatcaaaccggaaagccatggcgaccacgccgaccaccaccaccaccaccccctccgccgcctgcctcctcatccccatcgccgccgcatcgcgcgcttccttctccaccctcgccctcccgcgatctccctatccctctcccgctccgccgccgccggttgccgcggccacctcgccaagccatggcgaccacgccgaccaccaccaccaccaccccctccgccgccgcatcgcgcgcttccttctccaccctcgccctcttgtgatctccctatccctgtcccgctccgccgccgccggctgccgcggccacctcgccggcgcggcctcaaagtgcaagggcgcaggagcggaggagaacaagaaagggcaggagcaggaggagcaggagtagtaggaggcgtccgcgacggtggtggacggcgcggaggaggccgggaaggaagaggggggaggaggaggaggggagaagagccccgaggcggtggcagcggtgctgaaggaggcgaaggccgcggccgccggtggcgggtggtgggccggcgtcgcgttggagatgttgaagatcgactggtgtcacgccctgaagtttcccccttttcttgctttaaaaattggttaaataaattgctcgaagaaattgtttaaattaacctagagctaaaaccctaattaataaatgtatttaataatcgatttcggcgtggtgggatttttcttgagtaccccatgtcacaatatattaacaagatttttagtggaattttcagagccttggaaataattttaaccaactaaaaatgagcaagcgcaatattataatccaaggaaaatcctttttctctttttttcttttcttttccctccttttcctttgttgggccgtcggcccatccctctcccgctcggccttcctcttgttgggccggcccatgcgcccctccctcctctctctgggacgtcgacaggtgggccccacctgtcggtcgtctcccacctccagccgttggagccggagctccaactgctgccgccgaaaccgcgcgccgccgcctcctccgcgtctcccgcgcccacgccgcgccgctcccgcgtcctcctcacgtcgccgcctcttcccccgcatctcccggcccgcgcgcgcgctcgagagggtgggattctctctctctctcctccccacgtcgccggccaaatcgggagggttcccggccacgtcctcccctccctcgcccataaaagcactctcccgagccccctctttcattttccctcatttgccacgctctcccgtgcctcctatcgcgctcgcgccgctcgctgctagcgccgcctcttgccgtcgccttcggccgcgcgccaccgccgctagagtcgccgccgcgccaacccgccaccgccgttagcttcgccgccgcaagagctttcccggccaccgcctcgcgttgccggaatcccaccggagcgcctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcatcgccggtcatcgccgccatcttcatccttcgcgccggccgccgtgctcacggtgaggagctcctctcctctctccttccctctgtcccgcacgcgctgccgctccctgcgctcgccatcgccttcggccgccgccgccgcctcccgcgccgtcgcttgccgttgccggcgctcgcgcgccgccgccgctcgccatggccgaccggccggttttgaagccgagccgagccgtgcctagccgccgccgtgccgtccgatcggcctcccggccgatctggaccgtcggtcccgtggaccggcggtggaccacccgcgtggtcccggtccacggtggaccgaccccctttgagccactgacccgtgggccccgcctgtcggcgccgccccctcccctcgctgacgtcagccctgggtattattgcgcaataattgattaaggacttttttctttattagtaaaaacacagtttatcttctaaaatttataactaattcatccgagctcagtttaagtccattcaagtctcagtaaatcaagaaaaatgcaaagaatccattaaaaatggttttgtttcctgtttcagtagtcttatagcatgttttgcttgtgtgctttgtttgtcgcgtagatttcggccgtttcgtcgatccgcggtttcgttgctgaggtctcatcagtgcgagagcaaggcaagtcatgcattataattgatcatattgtacccaatttacaaatatcccgcatttctattaaatgttgcattcttttacaatgtcatgtgggatgggtcctattacccagccatatattgtttaccttatgccattgataacttgggtatcaaaatgactagatgttggtttaggaaatgcttaaccatgcttagttcaactagcacacacatggggatcacattattacattgactttgaccatgagcatagctttggattggtgccaccgcaatggtgttagttaattaaaatacactgaatggtgggctgtgggtgcatggttttgctggtcgcacccatggcaattaaggaccggttcacgggaaaccctgggagacttaccgtgcttaccacaagcgggagtgggtaactgcttgatctgaggtatagctcaaccctttcctaggcaccggtggcgagggtgggcgtgatggagttgggtcggccggggtatccggttgtccagctgccggattcaccgcggcgcaagaagggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgaccaaccagattcaccgtgattagtctcaccccaagtttagtttaataaactggtgtagttcaggtggttggttgggcctgttgcaacgtggtgtagcgttggactgtttaattactactactgttttattgctttcaactactgtttttaaatgctagccttatgcaaaagaacccctagcctcctttggttatatcctgcatcatacctcctcttccggtatgacttgctgagtacagtgggtagtactcagtcttgctctcttttcccacacaccagagctgaagatcttactagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctgactggttctggacagggatttaatgcacattcagcttagaaattctggttcgagaatttctaggcgtgacaactggccggcgcctgcgaaggtggtgggcaccacaggcgtcgtgctcggcgtcatcgcgggctccaccgccgcgctgctctccgtcaacgcgctcctcgccgagctctccgaccgcaccgccgctcgagccctcgcctgccgccggctcatgtcaaggggagagagagagaaataagggagagaggaggaagaagggtggtgagagagaggatgatatgtgggacccacatgtcagtggggcccacaattatttttgtgtgaatgacaaatgggccccgcatatatattttaattttaatgccacgtaagcgtcacgtcaatgccacgtgggacgaagaccaagtacgttaacactgccacgtgtgcgccacgtcaacaaaaccactaagggagtcaaattgtaccggttttgtaagttgagggtttaagatttctggtattgtggttgagggatacgatttagattcggtggtcagttgagagagtcaaagtgatcttattcctttctcactctccgccgccggagtctggcgagagaaggaaaagaactcgccgtcgcccaccgcgggcgaggtggccggcgacggcgtcccctcgagcggcgctctcctccacctccgcggcacatccaatctttgtccacgaccgccttcgccgcgccctcctctcctccccggcgacggcgcccgcctcttcttggctcttccgccaccctcagccccggccactggttccttggaggtatatatacgcatatatgtctcgtctcttctcctataccctgaactttcagttcttgtttgggaactcgagaatcgagatgaccgaggaagaagccagtgcattctgaaatagacaaaaaaaaaaaagggataagtccattttagaccctctaattctttagcttgtctaaaacacaccccacaactttaaaaccgggcatttgaccccctcaaactttcaataccgtgcaaaaggcccccttgagtggttttctacactgtttttgtacactaggatgccacctatatagattagttagtcccaaatgtcagtccggtccttcttcctcctcccccactgtctctctctctctctctttctctctccttcgacatgggcgcatggctcatccatctgcccagcgaggaccgccgcacacccatcgacaagctcattgctacatctcgtccctgacggagctgcagattcgccgcctgcaaccaaatcgagctccagcacctacggcggcagtgggggcggcgttcttcggcgaagggagcggtgcagggacgaagcagctccgagtggagaggcagagctcgccgaagatacacgcgtggggaggagctcgagcgccatgaccaccgcgagtttggcgcacccatccgcctagcttggtggaagcaagctcgagatttactcaatgaggagcgggctcgcctccatcagactgtggtcggcgcgaccggcgtctacgagctagctctgtcatcgctggccgcctagctcctcctctgcaatcgagctccatctccgttgccgcagaccagcgcattctccggctcagtcgagtactactcctgctcctgctcctgctcgtgctagtccgtcgtctcctgcagtcctgcttggaggcatggaagccgaacagctttagccttgggattgacatgctcatgactgcaaagatgagtagctagcagcacaacgtactagcttgccgagattagtaatagtatatatgagtagttgtgataaacaggagaagcatcacacacaggtcacaagcgacaggtcgaggtgacgaggtctatatcgcgcttgtgtcggagctgcttcttccttgctccctgcttagccatctctgcggtcgtgcgcggcttccgccgacgaccgtgcgcagcggcttggagctgctactttcccgcgacaactcctccgccgacgaccgcagctgcttgttggagatgcgcgccactgaccgctcaaccctgccttcgcagtgccgctaccgccgccgctcgtgaaaaagcaacgtcaaaacaacccagcaatatgggcttagcccgcataatcataagtgctgacgtggcgaagggttgatgtggcatcctacatttcatccacgtgtgtaaaatccatggtaaaacagcccaagggggtcaagtatccggtattaacagttagagggtgcattatacctggttttgtagttcgggggtgtattttagacaagcataaaagttcgagggtgtataatggacttttccaaaaaaaaaaccctactaatctttggttcagttgcatatggtggctttacttgggcgcttccaaatataacgtccagtggattcttgttgcaatttttttctaggcttctgttagttgcaatttttttctaggcttctgttaaacctagtctgctttgtttctaaaaccttggattcctcaattgactcatcaattacagtttattttcccaaatatatcagttccaggttttagcttgtataaatgtagatgcattttattagttgattgatggaatgcttatttgttactctgaacaagaaattccaaggtttcaattcgtttagcagtaaatcctttcgtttcaaattggtgctgtaaatcatacatagtttgttagactaattcggttctaggtttgaaaagttgctctatgttaactgattttgagagtttctatcttaattaatcatttcgtggatgaataaataggttacttctttaaatcgaatcgtgaagcacaaacatgtacagcaaaaggaaaataagttttaaatttcgttagtataaatacgttatgtgaattttccatcatgtattcatgtggttcattatgatttcaataattttaatccagggatctggacacctgctacaccttgaaatacctactagctagcagtgctgtatttctcaatggaacatctctccgaggaactgatcatagagattctcgaggataacacggacaagcgatctgaattctctttccctggtgtcgaagcagctctacaccatcgatgcagagcaaagggctactattcgccttgattgtggacttgcaacagaggctttcccaacactttgttcccggtttcccaatttgctcaaagtagagattgattactctggttggacatctggtaacgggagtcagatcgacaaccaatgtctcctttttctttcatctcgctgtaccttgctcaatgatctcaccttaagcttctgctcaaacatcagtgatcctggtatcgcttgcttaacttactgcaagaagttgatgtctctaaggctgaactccataccagaattaacttcaagtgggcttctcttgttagctgttggttgcaaggctctatcttctgtctaccttaacgattgcaagggaattgctggcagcactgagtggttggagcatcttggcgctaacggatcattggaagaacttgcagtgaagaattgcaaaggaatagggcagtatcactttttaaagttcggctcaggatggatgaagcttcggaaatttgagtttgaaaacgagcaaggcttttggagttttttccaccgagattgggatccatcatacaaggctgatacttataggtatgatctgttgtgcgagagtttgaaggatttgaggttggcgcatcttgtaacagagccagaaggcccagaaatcggacttcgttttctgttgggcaagtgcaaggcgttagagaggctgtgcctggagtatgtcagtggtcttattgacagtgacatgattgcactatcccagacctgcaagaatcttaaaagcatctcactttggctgaatcccgaacactacaatgttggtgatgatatagttttcagacatcaatatgaatgtgagaaatgctagaatgacttacattgtgaaacggaggaagtagcacttaattcctgtggtcagctctagagtaagagcatcttatggtgtactccctccgtttcataatataagtcattctaacatttcccatattcatatggatgttaataaatctagatatatgtatatatgcgtagattcactaacatccatatgaatgtgggaaatgctaaaatgacttacattatgaaacagtgggagtattttggaaaggatccttcccatgaatgaatatcctaaattctgctaattttcatattttgcattgaagttcatatcattcagcctcaggattttcattttgcactacttttggagtcaaaactcagctactccccatcgtcttctgatctaatttattgccgtttttaataggaatatgatatatcaataatcagtcgttgaaattgttcggtatgtatgcacgttcaatcacttgggatgaagactttgcgcataatgtatttgcagaaatttacctgattcctgccgtgcaataatttttgagatttaagcaatagatacattttgaacggaaattttcatctcaaattttaaaatccgagtataaattctactaataacctggaactttgaacccaaaatttgaaactatgaattcgaattttaaacttacaactcaaaaagtatcaactttgtactaaatattctttaaagaaactcgaggcaaaatttattttttttatagaaagttattaacatggttaatttagagaaaaatgtcgcttggtgtatctgcatcgtggaagtgacatagcgcgtatactaccgcctctttaaaagtgaatggagattagtaacattatgaacctctctatgggaggtgttttatttttccaaaagaaaatgagtttggagatgcaggtaattaagaggctacattttattaggaacagtttggacctacttaaaaggttaaaattgaaacaaagggcagtttttagttcatgtgaaaataggcttttcacggtgtaaggattaaaaaaatagaatatttatttttgaagaaactttacgtgtggttcctttgcaatatattatcaaaattctcattttatttggagaaaaacctatgccagtattttatacttgaagaagcaaaggagaggggaaaaaatggaaaatgaataaagagaccagagagggccacgacccaacagagggcccaggaggcccagtacccaacagaaggcccaggaggcccaggacgcgaggcgatggttttattagcactctcctccgccgccggagttggccggaggatggtggccggcctccgctcgagcgattcatccaataatcgagcagcactcttcacacccagaaattcgctatccaaatttcaagcagaatgtgtattaaaatctctttccagaactagctagagtacagaaacgacaaattgataaatagatccacgtcttatacaaaaaatattaaataattcttacaaacacggtggaaaataagcaaaaactctaaactctgatcttcaggataaagcatagcttcctccgtaaaccacaggcatccttaacgtccgaaacaaccttaatcctcatagaactcaccatctaaataattctctgcttctggggaaaaataaagcaagactgagtaccaaccaccgtactcaacaagtcataccaatgagaaggtatgatgcaagatattcacaaaggataggctataggatatttgcataaaagcaacatttataaatcataatttgaatatagtttaaataatagatataattaagcaatattaaaatatcactacccaacactaaaccacgttgcaataggcccaatgttggtatttcttaacgacattactagaaatattcattcccagcaatgacgtagaaagtcatgatatatttatggttacagaagtaatctacaagctcatggatataccatggtagcatttcacccggatgtattctaaggtatcatatttatcttatctcaagggaagatttgaaagagagaaccatgctaatagtcatatacaaatataatatttgccttcatcaaagtctaagtagaatgacacaaagcaaagcttttagattcattctaataaataattctaactaaatagaagaagagatggaaagtaatcaattcttatacttctaatacacgctcaatctctaatttacatttgctagtatataatcatgtggccaataccccctaacagtgcgttcctggtgtttcaagagaccatcccgggttgccgtgtttatgacgacagcctgtcatggccgtccaatcggggctaaatacggaggagtaccctccccaagaatttgtcttagaaatatatactaacgtggaggaatatccgtactgagctgtcaccatcaacggcccacctctacagtcccgtagcatatatgcccagatagtgatatttagtaatctaagcaccatgcttacattaataaatactactctacatgtttgcagatgatatagagcaatcgataaatcagacactaaacccacaccaacatattcaagaatcttttacaacacatctaataaacactactttcacatatatagatagctgtcattattagttttattacaacacttctaataatgtttgaagtacctacttatagcattacattattgtcttgagggatctttgtccttatgactaatgttggagctagatcttccacctccataagtattgaagaacactcaaacctaacacaagcgtacaagcatacaaagtaaagcaatcaatatagcacacacacaatcgatcatctggcaaattctgtgctcatcacggttttcttctcaagatcataaactccggtgctattgccctcggtgtacaacaaggaagttgtacacatgctacccatcactgcaaagttgagaccctcgagaaccagaggcggctgtgggcattgctgcacttcatctgatagtgctaatcgacgaagctcctttgcgacttgctccatcaccggccttgacattccaggaagagccaagcattgaatcgccagaaccgcaatctgatgtaggactcccatgcttgcttcatctattatttcgctatcaagaagctcatggaatgttccatccatcatagcctcctgaaacattgacgccaatgtcttactttcttttgacaatggcctcttacttgttagaagctcaagaagaatgacaccaaaactgtagacatcattcttggctgtgagctgatactcaagcaggtactctgggtcaatatacccaggtgtgcctttaagcatagattgtgttttctcatcaatagttgaacacccaaagtcagacacctttgctaccaatccttcagcaagaaggatgttggctggctttacatcaccatggagtattgggtgtggtagtgagtggagatgcccaagtgcatcagctgattcggcagctatccttaggcgggttcccagcgtgacatggaacctcttgcttctctggaggtcaagcagctcctgtaatgttttattttccacgaattcatagacaagcataggcgcctcaaactgtaggcagcagccgagcaacttgacaatgttaggatggttgacacgacaaagtatgaccaactcttgcatgaagtccatcttcctactctcgtcaatctccttgcacttttttatcgcgacaacagttccatctaagactgccttgtagactgttccttgccctccttcaccgatgatttgtgccttgttgaagttttttgttgcggtctctatctccactctcttgtagagtgtgaacccgatattgccttctgctttcatcatttctagcaatagttggcctccatgttgttgaaaaaactcatcagtctgtcttaacaaagcttgttttctaatgctccttttgtgccgaatcacttcccatccaaggaaagcaaacaggccagccaacacacatgcagcaattcctagagagcgaagatttatcattagtaaaaaaagatttaagcaagcattttagcaccagtacagtttttatattgatgttattgagaagtccaggaccagatcaagcagatcttaagatgcaacagcaactaagttggaataatatgtgccctaccaattgccagctgtgcttttagaggtaagaagtccttccgacatcctccaggaatagttgcatttccacggctacccgcacggcagaaacaatcaaaatcgccaggtttgttatggcattctccgtgacaagggtaattattagaatcttggcattcattaatatctacaatataatcaaattcaaaggcatttagaaagaaaatatatagttatacggtatacttataataagtaaagaatgtatgtacaaactatacagaactgtaaaatattccccccgtcccaaaaaaacgagtctagaacaggatgtgacacattctagtacaatgaatttaataaaggtacgtgcatattcgtaatactaaaatatatcccaaccagtactacagtactaggttagttttttattggatggagggagcagagaatagcaggaaacaaggtggcccactctgctaactgttctgccctctctcctttcacgtctttagaaaatatatagaaaaataagataatttcaagaaaaaagttgaatgcctagacaactaattgaatcaactatacgtttctgaaaattatgaaaattatttataggctccttgcgtgacatagaagtttatgtatatatattttatattttttgcgagattaattattttggaaatataatttgcctcttatatgctacacaaaaatattttcattgttttcgtgtacgtgaatcatctttcataagctgcccaaaaacattttgtgctattatcattggtgcaaacgattgctcttcatatgctgaacaaaaaatctaattaaaaaaacaaacttaattaacaaatatacaagacttctatactgcacaaattggctacatataatattttcttatttgttggaaatatgtatactgaggcattttagttgtcaatatgtagtggaaatcatatatttggtgcaaactcgtaaacttttgtctagacttcaaaaaaaaaatcaaaatattcacacatatagataagatgatattagacaaccatatgcatacaaaaatgtactaccaaattcaactttgtctgtgagatataaattaaaattatcaagccgctatgaaataacattattcctaatgtttctctttttcttcactatttactatttttatgtcacaacagtcaagtttggtcttgtagttttgtatgattttctaatatcatattatctttatgtgtgaactttttgagatttttttagaactttttagatgttgtttgcatggttaccaccaggcttcaaagatgtggtctccgccttatatttgccccatttctatttacaaagatatttgaacatctgcaaggacaaattttatggttcttcaaaggtactggggaagtacccagttttaagttaccaaaatttatactacctcctcaacaaccattaaattttgttttctaaaagatcattcactttattggcatagattagaaaaattgacaaactatcactactacataaactttctgtacgaggacctctttagacggcagacggaccgtaattggcggcataattcgacctccattttcgcatacggttccttaagagacccgcatgcaaaaatctattttcataggcggacctcttaaggggtcgcatgtaaaaatgagtctattttcgcatgcaggccttttaacgatccgcatgcgaaaatctattttcggatctctttagggtccgcatgcaaaaatttttccctcctcaccacttcaaaatttttcacctcttatcctcttctctctcaacactcttgatattttcccctctcttacttcccctctatctctctcattttctcctctccctctcattttcttcctctcctccctctctttctctcaccgagcgggaggcgccgggagcgggcaccgcctcgcgacgcggactccggcgcggcagtgggcgagggccacagcaggggcgggcgtgggcggcggcggcggccctcccccacccggatccgctggcggcggccctcctggtgcctcctcgccgtgacgggaagaggacaatgtcgacggtggtggcggcggcttgaggatgacggcgacgattggaggataaggatgatggcgacggtgactggaggacaatggaggaatggcggcgggtgtattaatttttctatgtttggaatttttattttatttcgcgatttttccttttcgagtgcggccggtgaaaatcggatttttgcatgcggttgcgcgggccacatgtgaaaatcgtgatttttgcagaccttttcttccatgcagcccgcccaactgcatgcgaaaatacgttttgtccgtttgcaaaaacgatatttgtagtagtgtatgtgacgtgtattacatatatagagataaattggagtatttaatatgtcccaaaattttgacaaattaaccgttttacccaacatatttgaaaaatatatcgtgccaaaaactaaatcctaaaataaaccacgagctctgcgccaaactcgatggtgcggacatataacgtattggtgccatagatattggcactgagctatggtatgaggtagcgtggttttgtcatgcttgttagcagggctgatcacctctttacagtataaaaagctctacagccagtatttaccagatttactgacctagccaggtgacttgtgatttttgctttcatccacgcctagccccctttttcaatgttttgttgtagcaagcatatacttatactttacaccgtgactctaaccaattatctctctaaaataacaaattctgtttataaatttactttatttcgaacttgagaaactatgaaaaggtcatatattacatgttctagaactttattgagatatttttcattcattataacttgataactacattattttttgtcaaaataaatatattatattatgatataaatatgaaagagatcacaactttcagcgtagcggtagaaaaaatatgcatgtaaagaaaaaaatgatacagttcgaacttttttaacaacatcaatctcgtttggtgaatgtagctgaattttttaacaaccgcagtggaccagaggtcagtgccaatgcttctaccactaaccccatatgacatggcaaaacaacctttcacctcatactatcagcgtcaacatttttggtgctaatacgttatagatccactccatcgagtttgatgctgaacacgtggttttttcttgaaattagtttttggcatggtttattcttgaaatgagttggttattttgtcaaaattccggtatatttcacctgtatgttatttttgaaatattctgctctgtaaaatcctttaaatttattatactgcatgaaacatgcatgaataatgttatgcttttactcactggctccttgccaacagggaaaatgagaacggggaggtcagtaggcttggcaaaggacatgatgtccttccttgagctcgagctccaactcctctgatccaccaccccaagggctgagctcaaccttcgtggcttcgtccctttcgcacgaagccatgaatgttgagctcggccctctgggacacacaggctcatccgccttagcttcacctgtttctcccgagatcgagcgctcaagctcattatttggcagtgaaggaacgaacctcgccaatgttgtgagaagaggggctcaccggcatgcaccgaatcgggcagagggtcctctatttgtggctccagtagtccaaagcttaaagtttttttaaaaaaactggtctaaagtgtaatcaactctttaaacatcgaccatcaatttcctttatatatttgattcaacttttgaaaggtgacatggtttatatttttttttataatttattttacaacaattaatcttaactcttaccctctctgtcccaaattatagcgcactctctgtttaagaaaaaaatcaaacttgataacttttaactaataatcatattaaccatgctaaatattatgctatatcactagattcatatttttaagttactttcatgtgatgcaaattttatatttgttgggaacataacataaaataaattaattgtcaaagtatatcaataaagaccgtgtaaaaaatataagcctataatttgagatggatggagtactatgaaaatctaatttatagtttatttatttataattaataaaatattgtgttggtacataaaaaaataatacactggggcaaaatcttttcatccatctactaacgttatggacgactaacaaaattgcaaataaataaaagacaaaagttgactacaagaaaggggtacacgagccaattataggattgaaaataattaaccgaaccagtcaacttgggcaaagagaaaaaaaattctcagaggaaagaactgtgcaattacaatttatattaatctttcactaacatgtactccctccatattttaatatatgacgccgttgactttttgacaaacgtttgacctttcgtcttttatgtaattataatttattttattgtgacttgatttatcatcaaatattcttcaagcatgactaagacgagtcatacattaaaataaagaaacgttggttataaagtcaacggcgtcatacattaaaatacggagggagtatttgttataggcataatatttaccttgacagccgttggaatcttgaaggtagggattgccttggtatccctttttgcagttacatatgtatcctggtccgttggtggagttgaggcagacgctatagtcacctttgcacgcgtacgacgcaggatttttttgtgcttccacgcagttgttagcagtccggatagc

SEQ ID NO: 33271 - DNA, 9405 bp, Oryza sativa
ggtgttgaacgcccgtgaagttaggtaggtggttgagaaggtgaagctagacgattccatgagcaccgcgtagctacagggggtgcggttgtagatcccggatgtgttcagggtgtagtcgaacatgacctcgtaatagcttaggcccgttgagatgtttgtctggcagcagcctatcccgacgcagctgccgttgatggcgctgctcaagtcacctcgccggcagacggacacgcacccgctcatgtacttgcccacgttgtaatcgtcgaaggtgtaggccagcgtccggcacccgatgaccgtgaacttgttggccgagtcggagagcctgtagggcgtgcccgtgaggttcagataccacacgtccgcagggttcatctgtcgggacgtgcggttgtagcaggaagaagatacgtgattcattacccgggcctgaccattgctgagggatatgacttcgacatttccaacgaacggcttaaaaccgttcgccgtattgttgcagtcgacttcgaagctaggcgccatagcgcagccgcttgagctgatgccgaacgggtatgggatgcgtacgccgccgcagacggagtcctggcatgatcgggcgattggcccgcccgccgcgagctttatgctgatgagaaatagcactattagtaggcaaatatgtccatcgactgcgccgcggatagctgcatttctgtggggaggcatgggtgcatggatgaactactactttttatttggctacctctctcgtcagttcaaatgagtggtataagaagatgagagcaaggtacagcactgataatttctacttggatgctaattaaccataattaacaaaagggaaaatacatccgaagacttggactaaatcaagtcttcgcttatcttcctaatgatctgtacccatcgtcttccactccctccctggaaaacttgatggcgttgtgattaatgtccatgcagaaattttccacctcacgacacttgtacagattcagccatccttgacgagacatctgtatatgtcgagctaatgtagctcgacccgttcccgataactcatttctaacggttcaaaaggtatcatgtttaagatataattatcggggataatccgtcaccgatataagtcacatttgtcatgtcataattctaacacatcacggatgacctataacgggtcacaaccatgccccatcacggacaatatctcatccgtgacgggtgtaatgagatgacccatcaaagatgagagcactcatccgtgacgggttttaattaacacccttcacggataacgtaatctatgaagggtgacagttacgaactgtcacggatgagaaaaaactttaaatttttgaaattttcaaacaaccttagacagaggcataccctatatgaaagttgtagatctcgagatctataactttaaaactgataacatttaaatttgagatagtttacatgcccgaatttttccagttacgtatatgaaagttgcgcacaacattcccagctcaggttggccacctacaatacatttagattcttggtttcttctttggtgttagcttccttggagacgtcctcctatgggttgagaatttggtgttagctcggggccagctggatccggccgtcgcgacaataggggaggctggatcagccgacgacaccgacgggggaggccggatccgccaccgcgacgatgggggtggctggatctgctgcgcgatgacctgggaggccggatctgccgcgccacgacaacgacttcaaatttttgtgatgctcgaatgtttgggtgaatgtaaatttttgtggatttttttaatgcttgggtaaatttttgtgaaatttttgaatggtggagcattgacagaggcggatggagccgtgtcgctccgtccatcatttttttaaaacttggccagcattaacattagtggctgacacattggcttaagacgaccgccaacgaaaatgaattatcgctggcggtcaataaccgctagcaaagatcttgatttttcacttgcctttgctttgtggcggcttcaaattccgctagtaaaaacccaaaatagccgccacgaaagatggttttcatagcagtgattctcggtctgctaggtcttctgcacatgtttcgggtggatccagccatcttggtaactccttcctttctttatcttcagtcagtttacaatttcaattgatttggctttgtgtttttttaagaacataggagcttgaatttaacagtatgattcattagttctcaattgcattatatgcactaagtcctgtcagttcatttttttaaaacatgttagaaatcgatttttttttccattgcatggaaaattattgagtaagatctctctctttcgtatgtctattttgtccagggaagttcacaaccacttctgaaatggtttggtgtttaatgtttaatttactgaatttttaaaaagaattcaatcttctttaagagcaagccatccttttacgaggagggtttttactatttgttttgactgggttatctgattgatatatccatctaatagggacactatcatccctattgcactacttggccattttatcttatgctcttgaggtaagcgcttgccagctgcaatatgttccaaaatgaaattctgaaatcacgtgtgtataccaatagtaaaatttctaaatgcactaccatagcatttcctcatgtcgaagcaaagcctcggtttgctttaccactgtaggcacgattgccactgtttccaatgtagaaacccaggtgtgccattttcaatcattaggccgtgaatgttacaccattcttatgatttttcattagcctgcgtttcctttgatcaacagctattgatataagcgttttaactcaattttgtttgaacgtattgtttcatggaaaacttaagttaatgttttcatgacatttatggttactagctagcatattaattggctcgataaaaaaggatgccatcacaacgattgcaatttttcatgagctgtcaagtgtcaatactttcttcttatactacagcatgatgtctttgttttatcactaagattgacaggatccatggatgtgatctattgtaattgtatctttattagttttgaactaactgtcctatcatacaatgttagtgttgatctcttagaaattcccctaggaatacgtggaggtatcaactagttaagaatgatgtgtatagttttggagtaactttggttgaacatctgaccggtaaaaggccactgtctaaagaaacgaagaccttgacctcaatttttaatataactagatgaataccccatcgagttgctgccggaaattaagttgtatagtatgtacaaataagctatattatattttgtaaaccaaaataaaatgacttcctatgttttatataattaacacatgattgcaaatatattgcaaggtgaacatattttatgtaattgatacttatgaattttgaataaaaacaattgaggtttgtatggtttgaggagagaagaaagaagagactatttttaccatagatctattatccaaagactaaaaatacttgggatgatgtggcttcatgagataagagagaaataatattaactacatttagtagggataaactatataagtatatatatatatatatataggatgaggctgtaacggatggcaacgagctccttgatagttacataattaatgaagacaacgtgagagtgatccatcgtgctgcagcgctagcggtcgagtcaattcttgactattctaggtacgacaaggccagagatgaggcatgtggcagaggagcttgaccaactagcattagctgatgaagtgcagcaatgtccacagccactgctggtgcttccgggtcttaattaggtttatgacagagatggcaaatacacgttcaacgtcctcatggcaaactgatcgacagcaagactagcggggtttacagccttgagaagaaagccgtgatgagcacagaactggcctagagagagatgatagatatctaactcatctgcttgatccatatcgatgtaagtgagtgtttggcacgcggccatggttgtgaacttgatgctagtgttggaaaatctgtgtggcgttttattggttaaatctagctaatgaccatctcctgtggttattgtggcaataattaccgtaccctgtggtgttgcagctgagattgaagccggacaaagcacaggcagtgttcaggccaccagacggataattaaggaatctctatgccgctccaacttctctcgcagttggctgtaggcctctactctccctatcccaataatagacaaatcgtagttatgtatctcatgttcaaatacataaccaggatttatctttttttttttttacagacggtacgttctagttcatcttccattctactgatcctatcatggcttggacttgttctaagtctatatatgcatgtcttctagtagtagcactactacaatacccattattccgggcggtaggatagattatcctgtgcggtcacccggcctgcctgcagctcctcgtctgggaaaatctctatctccactctcttgtagagtgtgaacccgatattgccttctgctttcatcatttctagcaatagttggcctccatgttgttgaaaaaaactcatcagtctgtcttaacaaagcttgttttctaatgctccttttgtgccgaatcacttcccatccaaggaaagcaaacaggccagccaacacacatgcagcaattcctagagagcgaagatttatcattagtaaaaaaaagatttaagcaagcattttagcaccagtgtttttatattgatgttattgagaagtccatgaccagatcaagcagatcataagatgcaacagcaactgagttggaataatacgtgccctaccaattgccagctgtgcttttagaggtaagaagtccttccgacatcctccaggaatagttgcatttcctcggctacccgcacggcagaaacaatcaaaatcgccgggtttgttatggcatattctccgtgacaagggtaattattagaatcttggcattcattaatatctacagtataatcaaatacaaaggcatttagaaagaaaaatattatattttttgcaagataattattttggaaatataatttgcctcttatatgctacacaaaatattttcattgttttcgtgtacatgaatcatctttcataagctgcccaaaaacattttgtgctattatcatttctgcaaacgattgctcttcatatgctgaacaaaaaatctaatgaaaaaaaaacaaacttaattaacaaatatacaagacttatatactgcacaagttggctatatataatattttcttatttgttggaaatatgtatactgaggcattttagttgtcaatatgtagtggaaatcatatatttggtgcaaactcgtaaacttttgtatagagttgaaaaaaaaatcaaaatattcacacatatagataagatgatattagacaaccatatgcatacaaaaatgtactaccaaattcaactttgtctgtgagatataaattaaaattaccaagccactatgaaataacattaatgttttatatcattcctactgtttctctttttcttcactatttactatttttatatcacaacagtcaagtttggtcttgtagttttgtatgattttctaatatcatattatctatatgtgtgaactttttgagatttttttagaactttctagatgttgtttgcatggttaccaccaggcttcaaagatgtgctctccgccttatatttgccccatttctatttacaaatatatttgaacatctgcaaggacaaattttatggttcttcaaaggtactggggaagtacccagttttaagttaccaaaatttatactacctcctcaacaaccattaaattttgttttctaaaagatcattcactttattggcatagattagaaaaattgacaaactatcactactacataaactttctgtacgaggacgcctttagatggcagacggaccgtaattggtagcatctgtaaaattcgacctccattttcgcatacggttccttaagagacccgcatgcaaaaatctattttcgcaggcgggcctcttaaggggccgcaagtaaaaatgagtctattttcgcatgcaggccttttaacgatccgcatgcgaaaatctattttcggatctctttagggtccgcatgcaaaaatttatccctcctcaccacttcaaaatttttcacctcatatcctctcctctctcaacactctgatattttcccctctcttacttcacctctatctctctcattttctcctctccctctctttttcttcctctcctccctctctttctctcacagagcgggaggcgccgggagcgggcaccgcctcgcgatgcggactccggcggcggcagtgggcgagggccacgtctggggcgggcgtgggcgacggcggcggccctccccctcccggatccgccggctgctgctctccccgtcctgatctgccggcggtggccctccccgcaccaatccgccagcggcggccctcctggtgcctcctcgccgtgacgggaggaggacaatgtcaacggtggtgatggcggcttgaggacgacggcgatgactggaggatgaggatgacggcgacggcaacgacgactggaggacaatggcggagcggcggcgggtgtattaatttttctatgtttggaatttttattttatttcgcgatttttccttttcgcgtgcggccggtgaaaatcggattttcacatgcggttgtgcgggccacatgtgaaaatcgtgatttttgcagaccttttctaccatgcagcccgcccaactgcatgcgaaaataccttcgtggcttggtccccttcgcacgaagccatgaatgttgagcacggccctttggtacacacaggctcatccgccttcacctgtttctcccgagatcgagcgctcaagctcattatttggcagtgaaggaacgaacctcgccaatgtcatgaaaagagggctcaccggcatgcaccgaatcgggctgagggaggaccctctaggccacctatttgtggctccagtagtccaaagcgtaatgttttttttttcaaaaaaaaaactggtctaaagtgtaatcaactctttaaacattgaccatcaatttcctttatatatttgattaaccttttgaaaagtgacatggtttatatattttttttataatttattttacaacaattaatcttaattcttactctctctgtcccaaattatagggcactctctctttaagaaaaaatcaaactcgataacttttaactaataatcgtactaaccatgctaagtattatgtatgttgtatcactagattcatatttttaattacttttatgtgatgcaaattttatattcattgggaacataacataaaataaattaattgtcaaagtatatcaacaaacaccgtgtaaaaaaatagaagcctataatttgagacgggtgagtactatgaaaatctaatttatagtttatttatttataattaataaataaattgtgttggtacataaaaaataatacactggggcagaatcgtcttttcatccatctactaacgttatggacgactaacaaaatggcaaataaaagacaaaagttgacaataaaggggtacacgagccaattataggattgaaaataattaaccgaaccagtcaacttgggtaaagagaaaaaaaattatcagaggaaagaactgtgcaattacaatttatattaatctttcactatcatgtattgttataggcgtaatactccctccgtttcgaaatatttgacaccgttgactttttagcacatgtttgatcgttcttcttattcaaaaacttttgtaaaatatgtaaaattatatgcctacataaaaatatatttaacaatgaatcaaatgataggaaaaaaattaataattacttaaattttttgaataagacgaacggtcaaacatatttaaaaaagtcaacggcgtcaaacatttcgaaacggagggagtatttaccttgacagccgttggaatcttgaaggtgaagctagacgattccatgagcaccgcgtagctacagggggtgtggttgtagaccccggatgtgtaaggtgtagtcgaacatgacctgataatagcttagacccgtcgtgatgtttgtctggcagcagcctatcccgacgcagctgccgttgatggcgctgctcaagtcacctcgccggcagacggacacgcacccgctcatgtacttgcccacgttgtaatcgtcgaaggtgtaggccagcgtccggcacccgatgaccgtgaacttgttggccgagtcggagagcctgtagggcgtgcccgtgaggttcagataccacacgtccgcagggttcatctgtcgggacgtgcggttgtagcaggaagaagatacgtgattcattacccgggcctgaccattgccgagggagacgacctcgatgtttccaacgaacggcttggagacgccgttccccgtgtcgttgcagtcgacttcgaagctaggcgccatggcgcagccgcttgagctgacgccgaacgggtatgggatctgtacaccgccgcagtcgtggcatgatcgggcgattggctcagccgccgcgaggggctgatcagcagcaagctttgtactgatgagaaatagcattattagtactaggcaaatatgtccatcgactgcgctgcggatagctgcacttctgtggagaggcatggggcatggatgaactactacgactttgtttgtgtgtatggtcggtcactcgagctacctctctcgttagttcaaatgagtggtataagaagatgagagcaaggtgtacagcactgataaattctactccctccgtattttaatgtatgacgccgttgactttttaactaacgtttgaccactcgtcttattcaaaatttttgtgcaaatgtaaaaatacttatgtcatgcttaaagaaaacttgatgataaatcaagtcataataaaatatattataattacataaattttttgaataagacgaaaggtcaaacgtttgtcaaaaagtcaacgacgtcatatattaaaatacggagggagtacttggatgctaattagccataattaacaaaggggaaaaatacatccgaagacttggactatcaagtcttcgcttatcttcttaacgatctgtatccatcgccctccctgccaaacttgatggcggtgtggttaatgtctgatg

SEQ ID NO: 33272 - DNA, 1353 bp, Oryza sativa
atagccaatcgtacctttcaccacgtcatcgtgtccatcagctgccctaattttggagcacccaaaatcagaaatctttgcaataaaattgttactaagcagtatgttcatcgacttgacatccccatgtaagatagggtggtccagtgagtgtagatatgaaaatgcttcagcagattcggcagcaacttttaggcggatctccagtgttctgatggatggatcattttggctgtggattagatagtgcaaagtcttattggggacaaattcgtacacaagaactggaacttcaaattgcagacaacaaccaagaagcttgacgatgttttcatggttgactcgagaaagtatgagcagctcctgtgtaaattctgtcctactattctcatcaaatcccttgcactttttgatcgcaacagggttgttcacttgatcaagattataccctttaaaaacagtaccctgacctccttcaccaatgattgatgtcttgtcaaagcctttggtggccaactcaatgtcatctcggtcatacagcttaaatgaaatgttgttctctatgttcatcatatctgttaacaattggcctccgtgtagatgaaaatactcgcccctcttcctcatgatgtcttgccttttgattcgttgtttgtacttgatccattctatcccaagtaaagtcgttagagcaaccacaagagaggcacaaattcctagcgaggagaaggtaaaaatgcttaagccaaatatatatgtacagggaattgttcaaatgaatcaatgcaaaacatgaaattcataatttattcgaatatagcaatcaggcaaggttgaaaattttgtgtataccgatagctagccctttgtcgcatggtccattgtaggcattgcctcgtgtaccaaacggacaagtacaatcataacctccaactttatttctgcattttccatggcaggggtacttatatggttccttgcactcatcaatatctgcaacagaataccagcggtattaagaaacggaatttagcgttgctttgttagaaaacagagcaattcaaatcatgagtatatagtgtgtacatgtgaatgtgtatccaaatggacttcctaaaaaatgtttttttaaagattacaaaatctatgatttagaaatcaaaatattttctaggaaaatattcttatactgcaccttataagttaaaggcacatggcagatgcaatggaaataatttaaggtatgactctaagcaatacaaaagcaagactttcgcaacatctaaaaattatctctaaactttagcgctatacattattattcatcattcaactttctaataaacaatttaa

SEQ ID NO: 33273 - DNA, 13170 bp, Oryza sativa
ttttgctgatgcacgtgtaatacacgtgctacatcacaggtctcatttccgatggcccaatccacaagcagcggcgctcgcccacggtaatgatcattgaacgatgaagaagtagggtagttcttagagaagttgaagctggatgcctccatgagtgccgcatagctgcaacggctcatgttgttgatctccgtcgtgttgaagcccgagtcaaacatgaccccatagtactgtagccccttggggatggctgtctggcagcaacctatcccggagcagacaccgtctgggagcctcaagaggtcgtctgccttgcatgtggccacacacccggttgttaacacatcgtctgctaagaggtaagcgagcgttcgacacccgatggccgtgaacttgttgccgaagtcggataatctaaatggtgtgcccgttaagtttagcgaccagcccgtaccgttcatcccgccagaagtactattgtagcaatagttagctatgtgcatcctcattcgtacctgaccttctgtcagcgagatgttaagcagctccacgtctttgtaatacggcttgccatctcctttgatgttgcaggtgaggttgaagccgggcagggcgcaggcaggatccaggccgaacgggtaagggatctctaccccgccgcagcttctcacgcaggtggctgcagaggcggccgagcaatatgccgcgatccctccgcagagccatagtagtgaagctagcatgtggaatggcatggatgatttgtgaatcttctattcttccacgctgttgttctgggtaagtttcttcggaacctatagctagctaaatatatatgagtcggcgattctaaataattcataagtccaattagctagagcttagctcgatctttcataaagacgcgcgtaggaaacgagagatcaagctacgtacaaccgtgtgatgctttgacttggacctgttctacttctaggcttctaggtaggtctatgcatgccctcgcgtaattctacaggtctatgcagagaagtatttcttactagataactgattactaattcaaagtttctaacttggcaatttcctattaattagctagtggagtactcaacaaataatttttcaaaggcacgtgtcaataatttttatgataaatatgcatagtctatcattttgcaaggatttctgatttcttccataaataaatactatgaaataacatgtctcacatcaaacaattattcattgtgcattttacaaatgtgctaaagcaatgtaaaaaagagggggggggggattttatgtttctctataattatgacatcgatggaataaagaaagagatatctgtattgttcgatctcgatggctccagacaaagaacggttgagatttatttgttgtggagaaactataaaaatattcataagaaaattcaaataagtccaaacaatctaatttcaaactttgatagagtgtccaatctatcaacaagacaaatctaaaacctcagaatattccctcttatggatgttaatcggatcgagaaaataagtaaggtatacaccgtttgatatattgcgattggttcaaagctccatttgcatatttaattagattcaaagtataatgtcttgtggaatcaatcaaactccatgtggaaccggtaaatcaaaagggccctcataaaaaaggtaaacaaagaatgctacatttttatttatttttaatttaaacatgggaggagccgcttcctgttggctgatctctgttaattaggcgcccggccgctgctcaccgtggcaaagtaatatacgtgatcaggtctactcgttttctaaattcctctgtctctctacatacttgcctccgtcctaaaataagtgcagtcgtcgaaatccgtgtccaacgtttgaccgtccgtcttatttgaaaaatttataaattttttttaaaaaattagtcacacataaagtactattcatgttttatcatctaataacaataaaaataataatcataaaaaattttcaaataagacgaacggtcaaacgttgaaaatgaatagtgtaaaactgcacttattttcggacggagatagtattatatatgattctcagtgacaagagacacgatactatttcgtttctctgccaaccaaatatacatcgtcgccgtaactcgaaaatgttaaagaagacccgcggagcttgctttggagtttggatacaccacccttaattttcatcgatctgtgcatgcgcatggttaattccctgcgagctgagcctgtattcatctagagtttgttgctgttgcttcagaataattacaaaaatggccttttgaacttgtctcatcattgctgcttctaaaaaactgtccgtgtttttttggttgctaccggatcatgagaaaaaccggaagtacagccggccgaagcatgtaccagaccacccaagttaacgcgaaattaatggctgtgtccctgtgtcctcaaactcgcactatctctcacgttccctcgtctcgttctcacctgtcaaacgccgactctctctcagcgattgatgaaccagaacaaaaattactcaaaatcctctaatttttaattaataagaactaaaacaacttaaaaatagataagttaccaggtatccgtagacaccgggaaggtacacataggaatgccactccgacagctgttccgaatgtccgccgtgtgacgctggtgatgccccctatcgagcgacgccatgtcgtcctggtatcaaataccggctccgtttcatattataaataatcgtttaactttttttaggtaaaatttcttaaagtttgatcaaatttatagaaaaatataatagcatttttaatacaaaacaaacatatctctactagtataaaaattgaagctgtttctgcagtccgtcatctgtgtttgagtcggttagaaaaattgaagatgtttctgcggttcgtcattcgtctttgagttggttttaattttatattttggttttaatctatatctcttctttatttctactattataaaaattgaagttatttttgccggtgttttggtacaccactgtgtatgaggcggtttttaaattcgttcacttttggaaatatatatccgtatttgagttgtttattaagttcgtttgcttctcgaaatacatatctggatttgagtcgtttattaagttcgtttgcttttggaaatatagaagagtcgtacaggaaatctctttaaaaaaaactcacatgctaacttgacgatcggacactaattacagctcatgattttaagcgaactccccgaataaaattcaccttaattaaactatataacaataataatactaaaatagccttcacccgtcgcaacgcacggacattttttctagtctctaatgttgtaaaaattgaagatgtttttaccggtatttcagtacatcatccgtgtatgagtcagttattacgtccatttgcttttggaaatacatattagtatttgagtcattttttgaatatttgagtcatttttaagatcgttcacttttggtaacacagaagaaatcatataaaaaatctgtttaaaaaaactcacatgctaacttgagacgatcgaactcctaactgcagctcatgattttttaaaaatatatatccaagcgaactcttacagtaaatttcatcttaactaaaccatataacaataataagattaaaattaacttcacccgttgcaacgcacgtgcattttttctagtattataaaaactaaagatgtttttgccggtattttggtacgtcatccgtgtatgagttggtttttaagttcgatttcttttagaaatacatattcatatttgagtcggtttttaagaccattcacttttggtaatatagaaggaatcatataggaaatctgtttaaaaacactcgcatgctaacttcagacgatcggactcctaactgcagctcataattttctaaatttatatatatccaagcgaactcccacagtgaatttcattttaacttaaccatataacaataataagattaaaatagacttcacccattgcaacgcacgggcattttttctagttatgaaaatatactaggttagattcagtggtggatctaggaatacttttgagcctgggcaagtctaacaacgaaaaacaagtatacataaatcaatacaaatatgtataccttttatcatatacgtatgtaaaattgacggtcatcgagttctaatttaggataggaaatctagtgtacgagaatatatcaaagagacgatggatatataggttagactatggagtttgtactatcttattgaaagaaaaaagactgataccagaaagttatataattttgcctttagatctcagttgtgatggtgtgaaattgaattaattatcttgaaagtaataggcatttagttaagcatggtaatcaaccactttatacctactattgtatgcagattagctggtgactaaacagcgtaactaagtgcggataaactgctgcatagtggtagagcccgggcacttgcccgcgctggccgggccctagctccgccactgacttagatttaatgacactaatttcatattttagatgttgttcaattttactataaacttgatcaaatttaacaagattcgactatgaaaaaattcaaacgtaagcgtacacactaccagaggttcctgcaacctgatcgaggtggtgcatttttttcaccggctctggctcggtttgggcttgcaaattcccttcttggagctaatcgctatccgatgcatcgtcaggcccaacaaggccattcaacgttgagtgcaaagtgggcctcaatcacgcctgttcaccgtcctaataagtctcaatctaagtgggtagtggggtaactgacactttcaatatgagaaaaggcattgtgagtgtaagatgttagacaaaactaaccgtgtaaacagatgtgtgacattgcgtgattaacactaagactactacagaacatcacataggtgccggttcatagttatcgattcatttaaaaccgacacttgttaaacgtttcccactttcacgggacaaataaaaagaaaccggtacctttgaggaaatataggtgctagagtattatatgtgtcaattctttaaaaactggcacctataaaacaaactgagccgatcgagctaagcccatccttttgacacaccttcaccgagtcacagtccacatccggccttatcctatctcgttgcactcgctcacatcgccatctcccacgccttcttcttccacatcaactccgccctcaactcggccgccccgagcacctgtgccaccccaagcacatcctcgcccttctcctcttctccatcctctctatcatcgccattgtcgtctttgttgctgcccccatcccctcctgcttgccccaactactcccagatggtggcacggatgaaaccatagtgttttcactccaactaactactcctagctagcggtgttccacagttgcggcggtggcgtccccaccccggtagctatgacgttcccacccgagcggcggtagcgcggtgtggatcaaggtgctcgatggcatccccacccaggctgtggtggcatggcacggatcgaggcacttagcagcagcacggtgcggattgaggcacacggtgatggcgcctggcagatgcttggtgcggagggacttctctatgacagtgggtgcatattttactctatggcgtgcaaatggactccattttgtttctgatatatttatcttgttctttccctttgatgcatgcaaataatatgtgtaatggattttaattgcagtgatgcaaaattcttcatttgtaccaaaatttgcgatattgaattttaattggagtgatggatggatggtgatatgtggatatgggatgggaagttactcgatgcattcgaaactcctaaatggcgatcgctcgctaggggcgatcgggtcgccctcctctcctccacctagttttctttttagcaccgcagtactttcctattttagtaaatttatacacctaaagtttgtacacctcaagtttacacatctaaagtttagagacccaaagtttataaatcaaaagtttatatatccgattcaaatttgaatttgaattcaaatattttttatatatagtatttctatacatttaaagtttatacacctaatgtttatagacccaaagtttataagtcaaaagtttagatacccgattcaaatttgaatttgaattatattcgattcaaatttgaatttgaattcaaatatattttatatatagtatttctatacacctatataagtcaaaagtttacatacctgattcaaatttgaatttgaattcaaatatttatatatatatatatgtagtatttctatacatttaaagtttatacacctaaagtttatagacccgaagtttataagtcaaaagattacatacccgattcaaatttgcatttgaattcaaatattaatttatagacccaaagtttataagtcaaaagtttacataaccatttcaaatttaaatttgaatttaaatatttttttatatatagtatttctatacattaatttttctaactttattttttattttttttaaaatttatggtgtagtaggaagagaagaaagggaggatcggagagaagtgtataggggggcatggggatcaatcactccaagcgatcgatcgcccattagccacgccccgatgcattggcttgatttgagccaatggatgcatcgagcctaaatcggtacctttgattcctcttcatcagtatcgcctgtagggtgctggctgggaaatccaacacacatgaagattttccaaccggcagccatctctgtttatgtatagtaggaacaaaatgtaagttctacaaaaacgacacctgtaggtcgacacacgacactcaatggcacaaccgctccaaacatggaagttgtcgacttatttagagggggaaaatggtaacatattgtcgatgagaagttcctctcatgtctgatgcaattctccaaggcagcagatggatgcgaatagagattatttggataaacgagaggatcaatgcgccagtcttaaagaaaacaagatatatttacgattacttcatattaactaggcacaccttgtgatacaacaaagttttcagagggacatactactacgtaacaaacataatctatagctactatataaatggagatacagtaagacaaatgttattggcatataaatagaagcactcgcaatggaacaacaaaacatgtagtaattgtgcggtcatctagcaaattctatgttcattgaggccaccctctcaaggtcgtaataatctgtggatcgttcacctgtgaaatactccgatgtgtttgcaccggaacttgctatcagggccaatgaagaactaatacctgtaagtaccccttggtcttgttgtacttgtcccgccattcgccggcgcaattcatctgcaaccgtgctcattgttggtctgctctcgctagtcattattaagcactggcttgctagagttgccagatcacttatcaatcccatgttatcttcgtgcaatatttctgcgtctatgagctcaaggaagtggccttctctcatggcctcttgaaatattaacgcgaggctgaccttatccacggataatggcattcgccgggttaagagctcaagaagaactataccaaagctgtaaacatcactcttatcggtgagctggaagttccgaagatactcaggatctagatatcccattgtccccttcaccacatcatagttctcatccgcggtcctaattttagagcacccaaaatcggaaacctttgcgataaaatttttgttgagtagtatgttggtggacttgacatccccatgtaagatgatagggtggtcgactgatgagtgtagatatgcaagtgcttcagcagactcagcagcaacttttaggcggatctccagtgttctgatggatggatcattttggatgtggattagattgtacaaagtcttattttggacaaattcgtagacaagaattggaacatcaaactgaagacagcaaccaagaagcttgacgatgttttcatggttgactcgagaaagtatgagcagctcatctgtaaattctgcccaactatcctcatcaaatcccttgcacttcttgattgcaacagggttgtctggatgaagattaatacatcccctataaacagtcccctgacctccttgaccgattactaacatgttgtcgaacccatttgtcgccgactcaatttgatctcggtcatacaacataaatggaatgttgttatctctgctcatcatatttcttaacaattggcctccacgtagatgaaaatactcttccctctgtctcatgagttcttccctctgtctcatgaggtcttttcttatgattcgttgtttatatctgaaccattctatcccaagtaaaatagttagagtaaccaaaagggacgcacaaattcctgtcaagataggtaaacattttaaacgcaaataaatcgacgaggaattaggcgataagtagtgacaacaaaagataaacatatggatccatgttagtataaatgcaagaacttcataatttattcaaacatatatatctaaacaatgcgagattaattgaaaaagtttttgtgtaccgatagctagccctccgtcgcatggtccggtgtgtgcattgcctcgtgtaccgaaggggcaagtacagtcggagcctccatctttatttctgcattttccatagcaaatatacttatttggttccttgcactcatcaatatctgcaaaacaaaatacgcgtgatgttgtggaatggaattcagtggtgctaatttctgtcgaaacccttgcaatttatcgtactacacagactaatttcacaccatgcgtttaatattagtattccctttgttattgacatggatgtaaccgtcagattataatagtagacaaaattgactacatgtatcccacacgcatgccatatatatactttgtgtaaactttatgtagaaattccatctgtagttagaaagtttagtgcgtaaattttactagaaataataaaatgttgacagattttttttaaatgaacaatttactaggaaaatttctatgtatacactttctatatagagagaaactttatatatgtaaattttgtatatctaaatttacaaagaattatatctataatttgaaaatttagtgcataaattttactaaagattaaaaaaaatactccaagatggatttgccggctctgtcttcgaagttgctcataggggtagggtttgcatgagtacgtttataggggtgagtgtgcatgtgttgtgtgtctgtattatactgtgtaattcttaaaaaaaatactgatatcactgaaactttttcaaaaaaataataatacaattagaacaaatatctgatcagaaaaaacaataaaaatgaaacgtcgatcttttcccatggcgtggaaggaaaagaagaaaacagaaaatgcgttttttttctgtggcgcgccttttcgtcgttttctgttcgcttttctgttcgctgtccgcggccagcccatcttaccaccaccgtgagtgtttccacctaatattgacaaatccaaaactctttttctttaaattaatgaccaatcttacatcctactccctctacctcaaattataatacctataatttttttacacagtattcaataatatactttgactagtattttatttctttctatgatcccaataaatatgaaattagcatcgcataaaagtattttaaatatgaatttagagatataacatgcataatatgcatacttattatagatatagttagtacgattattagttaaaactatcgagtttgatttttttttaaaaaggggtgactataatttgagacgaatggagtattaataacagaacacagatggaaatgatcctaataacttctttatacggtagagaacagatgcggacgcaaagctgataggaaacgcggcgcatgagatcgactaattcgccagcaacgcactggccgctccagtcagtacatcctgatttattggcgacgaatcggcccactccaatcgaccaggctccgatcgctcttcatctttaatcagcgcggcgattgaaacccatcgacgttactttcattagccatcatcgatatcaactacaggtctacagtttatttaccaagtaggaaggtagcccgcgtatatgcgcagacacttttacttagtggtgtttgaaattttgttatgatgtttatgtataggttctttttgaaaaatacatctttttttacttttaaatatctgcatttatcaataatttgttagggattgttttgaaagttggtttcgttcattggacatacggacgtgcgctaagaggccaagaggggggcatggttttagacatttgtctacatgcatgcgtacctatgcaggtaagttggaccgacgaggacgttgggacatttgacggttgtctgtgacatcctacttctcttagaatgtggcctttgttttttttttaaaaaaatgtgacctatgttgctcataaacattgtgtgtgcttgagtacaaccaacttgtaagtcattgtcccttcaactatatcattttcgggctaactattttacacaaagtgagaacaaaagtgtaagtggggtgatatttgaaagtgggcgtactagttggatgagctgggctgtgttgttatagaggataggttgttacaaattgtaaactaaaattacttgaatcatgtcgtaatatgtcgcaagaatggagctggttcatatgaaactataatttatattacatgtgtttagatttttttaaaaaaatatcatattaattaaaaccataatatattttttatactaaagatgttttttagatattaggatatattagtttaagaaattttttattaaaaatgtggtaatatgatatctttatctaatttattaaattaagacatacccacttactcttgtttgcttctcctacctccatccataaatcgaaggatttaaattttatggtagattatcagggattataaatactactcgtaccatccaaccatctctcatttaatttttacccaatattactttaaccaccttataattctccaactacccctatttaatgaaacttatttaatgagggcaaaataccccctgttgggcttcttagtatttttttcattcctccttatttcctataaaattatatgatccattttaggtagaagatagtaattaaaaagagcttaattcgtagacggatttatttgtacctttgtggattgatttagctttacctatttgacctcatatacacgatgagagaaataattaagttggtagaaagtcgtcacatgtttagtggtacatagtaatgtgtccaccaattgtattttttaaaaaaggtggttattttgtcagcggtaatttttaggattttcttttattcagtggttaacttaattgccgtatggagaaaaagaggcgacaacctatgggctcgtctcgtccgtgaggaggaaagtggatacatgctcgtccatgaggagggaagtggatacgtgcattgtacatatgaaatctgacggtcttatcaatcaataatctttttaagatatagatctaatagtttaaaataaggtacacaggtttgggtaatacgattttttttctcagaatctcttatatttactttagtttattagagcatcatgtggtggcttaggaacattcatagaaagccatgtggtatcttgagagagtttataggacatttaatgaaattttagtatataataatagataatttatgtcatattaattaatatattaatcaataattaaataatttgtatgtgtagtgccaacataattttttatgggttcgccactgaacaattaagttggtacaaattaatgagtccaccaattttatttttaaaaataaggtggttattttttcagcggtattttttaagattttcttttttcctatgatttacttaattgccgtacggggcaaaaaaaaaagaggcgacagcttctgaggagggaagtaaatacgtgcgttgtatatagagactttggcagtcttattgatcgataggttttttttattaagatatagatataatagtttaaaatatggtacatcggtttgggtaagacaatatttttctcaaaatctcttatatttactttattttataagagcatcacgtggtggcttaggaaagtttatagaaagccacgtggcagcttgggagcattagtaggacgtttaatggactttcagtaataataataaataattcatgtcatgttaattaatatatcaatatataattaaataatttgtaggtgtagtgcccaaatatattttttatgggctcgccactcaaaaggaagggtatatatatccaattgatgtcccaataatttttttctgagttcccactgaagattaaggatatatagatctaagtgacgtattataattttttatatagaagcatatatactaagagaatatttagctatctaattaaaattttatagtatgtattggttgttagctagaaaataggaaataggagagatggaaagggacggagggagtacgtacatacatgtgcaaacatattttttttctttttgaaacgtattaggtgaacgtgtgaacggagaggaaacatacatatttttttcttcaatataagatttagtggtgaaaattaataatttaataggttaaaatattgggtccaccggtttaaatgaaagtgccacgtggcggtatatgagcgtttgtaggagtgctacatgtcaacgtaggagcgtttgtagggagtttaatggacttttagtatataaagatagatagatagatagatagatagatagatagatagatagatagatagatagatagatagatagatagatagatagatatgtatatatac

SEQ ID NO: 33274 - DNA, 20128 bp, Oryza sativa
  unsure (1)..(20128): unsure at all n locations
actttaattttcctctgatggagaaattattggtccactttttcattggatgtataatatgttagttagagataagagtcaaatataaattatagagataagatatatcctagagatagaatcctagagataagatagagtcctagagatagaatcctagagataaatctactcttacttgtattgtactctaagtctctatcccctatgtactcctatatataccccatgagatggtcgatgtaatagatcagaaaacatcagaatataacagtttagatttttccacatggtatcagagctgtagacaaacgtcgatcgatcctcggttccagctaggttccatccacgctgccccagggagatgagatcaatttctcactggggcaccgcaccgcatttgctagctagcatctccaatcatttacagattagtttactgcatatcattagatgcgttttccaataattagttttagatctattagctagccacagaaaaccatatgatcgtcaggagcaatgcggcaggtgttacaggagcagacaacgtcaacaagcatcataccatccggcctcgtccatggatcgatctgcatcggctacttcacaagaagcaagggcctgatgctgttcgtcgccaacatgtgcacacgcctgtgctgcacacctgcatcaagacaccggccgatcatctgtgacgtcttcgcggagtccaagtcaagccgccgagctctccaggacgatcgtcttcgccgattctacatcatcagtggtcttcatcaacttgccgctgccgactcgtccacatagatggacacctcgcgtcctctgatagattaatctgcaagacgcttcatcgacgacatcgaccgcatcctctacgacggcaacgaccgcgtcaccaacgacggcatcgatcacgtcatctacgacgacaacaactgcatcaactcggcatcactattatggtgaccactacacggcacaaaaggaacaaccaaaatggtggcctcatcgccaacgacgtcctctgacatatgcaagacgtctctaatggcatcatctgacatctacaaggtgcaagatgctaacaattgcagtttcgtcttcacaccatggtgtaattttttttttcgccttcggctatatgcggctacaccgacaaccacggctactacatgatcggctatatcgacgaatgtctacaacaagaatcatctacagaaactccagtccaagcgtccgtgtcatcgctatcgtccatgacactcccgctatgactgcgggagggaatagaggagagtcaagggacgacacagaaggggacgcaggcaccaggtggaggaccgtccatcagagatgcaatcgatgatagtgagtcgaaaaagatggagaaaaagatgaagaaatagaagattttaaatccagtcgcaatcgttcgcttcgctcccgttacgactgagggggaatgttagaagtataatatgttagttagagataagagtcaaatacaaattatagagataagatatatcctagagatagaatccaagagataagatagagtcctagagatagaatcctagagataaatctactcttacttgtattgtactccaagtctctatcccctatgtactcctatatataccccatgagagggtcgatgtaatagatcagaaaacatcagaatacaacagtttagatttttccacagtactatgttaggtttatttagttttgaccttgattgtttctccgcatatgtttttatgtgaatcatcatcaaagtcagatggtgagtcgaaaaaatgttgtggcgccgcctgtccacatgcatggaaaaagaaaaggaaaaccagcacaacaaatgaatgaatttttgtgtactgtaatgcaattcgtgactgtttatttttcatgattatactgtaacgcaacaaatgtgccccataatacatgcttaaatggaccaagaatacctgtaaatgtctaaccgcaccgaaattctattatattaaagtgcaccgcgagtgcacaagcgctactacagaaacgatttttctagacgagacactcgttgtattgcagacgggaccataaatgcccgcgtctgaaaaaatcgacctccatttccacatacgacaccttaaaaggccctcttgcgaaaatcgacttttgcatgcggaccctgtttttaccctgttccgtcttccatctaaccctgtttttaccctgttagaccctcttccgtctaaccctgtttccactacaccattaagatttggtttaaaagaatgaaataattataattaaatttcataatgccaaaatatccttcaggaaaccatatccatcccaaaccctatccacatatgtatctctctctctcctgctggcgagttgcggcaccggcgcttggtgtcttaagggaggaaggggatggtgccggcaggaagcgcgcggaggggatccgcaccggtgcccgcttgtggacgcaggggtggcggcggcgggaagcgtgtggaggcgatccaggccggcgcacgctagtgaagggaaggaacggcggcggtgagaaacggacggagggttccgtgcctgcgtcagatcacgaaggaagggagcagcagcgccgagcctcttcgacggcggtggcagcgccggcgcgtggtgaagctgcgcgcacagtcgggtgaggcggcgtcggcgtcggagaaggtagggaagggagccgtgctggagggaagaagcggcgccgccggcgcacggaggacggaaggaggcagcatcggcgccggcgcaggcatgtggaaagagggaaaagacggcggtggcgataggcatgcggaaggagggaggaggccgcggcgccagcaggatgaggaggcaccgccggcatgcacgaaggaaggaaggcggcaagcccgccgatggagctgtgacggctagatccggggagggaggggcgaccacagggcggttttccacagctgctggccggtgccggctcaccctctagacgctcgccgcattctccctgcgagtggagctgtggaggagagcagaagagagaaaagagaaaagagtagaagacgagaagagagaattgatgggtgggtcccacatataatagggtcgaatgattaagggaagaagcaacattttgtgcttcagtcaacgtcattagatgcccttaacagaatagggcataccatatcttcggatttgataagaagggccaaataagcaaagttgataaaaaagggtcaaattgatagttagctttcaaaagagggtcaaatgcgcaattgccccttaaaaaaagtcccatggtaaattgctggtgttatattgaagataaggactgaagagtatagcgaaaccatacaattcgcggttaattagggggcaaatcagaatgagaccacaaaatttagaaactaacaccgtagtcagcttaacactactaaacaatagttttttttttctgatgaccaaaatcaatcttggatgacggctagactaaaccacctacgaccaaaggccagagaaaatacactatctgcatatgcgggcttcatctgcgataaaaaatctatttttactggcagcaaggttaagtggaccgtcaaaaaaaattgacttttgcaggcggcaacattaagccaaccaccaacgaaaatgattttctaggaaaaataaataaattcccaaaaataactccaccgaatccaccgctcgcaacccgcactcgacctcctgccaccagtggcctgtttgaccccggcacccacaacccacgctcgagttcccatcgatggtggcccacacaaccccacctcccacaatgtgcactggagatctgccgccggtgccccgcgcaaccccgcgcatctgtggccccatgctcgagatccgctgtcagtaacccactatcgagatccgccaccagaggcctgcgcaacctggccatttgtggttcgtgcttgaaatccgccgccggtggcccgtgcgaccccaccacccgtagtcgctgtccgttcgcgtgacgccgtgagagaaaagatatggttaaggtcacttagtcctgccaggatctgcccgcccggcgctgccctgagttaggaaaggaggaaaggagggaggagggatcgagagggagtgagagaggagagggatgagaggctgaggataagacatatacaattgggaggaggaccatgtcttttatgtaggctgaaatttattttttatgtcggctcattgagaactgcttacgaaaatctatttttactaaggcaaattttactataggacgccgtgacttcatggatttagctgtaggacactatcagggttacgaataagatataccctctatccttggatgtacgttgtatactgatacggtatacccgcgcgtgtacggatagtttccgtatatattaaggaaatctatcacgtgatagggatggtatctacagatgaaaggagttctactcggacaagactgggtcaccatatcgtgaggggtccgatatcttcgagtcctacttggagatcaactgacccgcggtatataagggacccctgggcaggaccgaaggcatcgaatattaccgccaacacacccaccacagcctacggagtcggagcgtgcaggagccaagtcgccgggagatctagtcggaccaacttgactatgatctcgtcgatatcatcgagttctgctattctctttgtaatctgtggtttccatcatataattccataccaattggattatggctattacctaccaaggggcctgaaccagtataatccttatcttctatttgcttgatgtcgtactacgtcgatcctcgtaccaacggatcccaatacctttttatccggtctacgggtatcccccgtcgacagacacccttatcttctgtttgcttgatgtcatactacatcgatcctcgtaccaacggatcccaataccctctttatccggtctacgggtatcccccgtcgacagacacccttatcttctgtttgcttgatgtcatactacgtcgatcctcgtaccaacggatcccaataccctctttatccggtgcacatgtcagatcctcggcccacatgtcagatctccccttcccaatttcgagctcacgcgacaagtccgaccaccgcggcgatggatttctccggcggcgacggcgcaacattgtcggacttgtaccagagcacgcggcggctgctactccgcccgcgatgatgtggcccgcgtcaagcgcctcgcatcggtgcccacctcgtcctcctacttggcgctgatgaggacgtgcagcgggtggtgcccacctcgtcaaactattctaagtttaactaagtttataaataactacacaccaaattatttcattaaatcaataattaaatatatttttataatatatttgtcttgtgttgggaatgttattaattactttttgtacaaactaggttaaacttggagaagtttatctttgaccaaagtcaaagcgacttataatatgaaacggatggtgtagtatatatacattactagcaagactagtgcagtggcattatggaaaaaggttattgcatatttataaagtacaagatggagaaagtactttaaagcccaaacaaattaatgtattgtcgatcaatcatcacttgcattataaatctactcactagtagctttcaagaaagacttagggtaatcgtaattttaaaattctagctatgatgagattagaaggaattttaccttggcaaccatcctgtcgataaggatttccttggtacccgtttgtgcaattgcatatatagcctggtccattggaggaattgaagcactcgctcttgtcacttttacacgcgtataacgtgagatttttttgtgcttcgtcacagttgttcacagttcggatagcccaatccagtagcattggcgcccggccgccgtaggaggtgttaaactccggcgaagtcaagtagcttgttgagaacttgaagtcggacgaatccatgagcacagcgtaactgcatagggtggcgttgtagatcgagtccgacgtgttgaaggcttggtcgaagaagacctggtaataagggaggcccttggggatggttgtctggcagcagcctaccccagagcaggtaccgttggtggcgctcgtcacgtcacctcgccggcaggcggacacgcacccgctcatgagcttgcccacgttgtccttatcggcaatatatgccagtgttcggcacccgatgacggtgaacttgttgccggtgtcggacaacatgaacggagtgtccaagtcactctgaaatgtatttggttccatcaacttagatgcaggattgtagcagaaagaagatatcttattcagcacccggagctgactgagctgaagggagatgttgacgacctcgaaatctccgaggaacggcctggagttcttgcaggctagctcaaatccaggcatggcgcagcggcctgggccgatgctgaatgggtaagggatgtccacgctgccgcacttggtgtccgggcattccgccactgcaccgccggtgatgaggccgagctccaaagaagcgaacgctatggcgagccatagcattgttcgccctctatggcaagcaggcatggttaatttctttctggtggtgtacttttcttttttgcgaggtgattgcctagttgtgtgcacctcatacagttcgacgactgctcgtatatatatgaaggcaagcgtagccgctagcatccatgaatcatcttggatgtgtcgttcaccacaaaagtacaataaaacaaaaagatccaacgattcgtaccaagtcttcgcatgtactatatatttccgcaaaggtcgctataatgggttgacccgaaatctttatgaatgcccccttgctctctttgcccatggaaatattccaataatgttcagaaattggttaattatcgggttagacatggacatatagaacgacatttctgaacaatatggccatgtctaaatgacatgacgttttaacaaagaatcccacgtttagaccaaagcatcttattagagagcaagaaaaactacgggaggcaactcaacaagcatatggattaaaatttaacaagaggttgagtgtgacgtgaattttttatttatttcaacaactggcactactacataaacaattttcctaaaagaggcccacgttaggttgcaaatggatcataattgaccgcgtctgcagaaatcgacctccattttcgcatacggacatgtattgaaaaaaaaatcaattttcgtatatgggcgtcttaacaggcccgcacgcgaaagtaatatattttcgcaggcaggccacttaagagacccatgcctcttaaagacccgcctgcaagtctaatcttcctcctctttccctctcaatctattcaacaaaaagagaaaaatctcttctcccatctctctccattatcttctcctcacttcctcccctccactcattctaacctgctctcatcctcacttcccaacgacattcccggtgacagcgggggcagcgacggcgttggcaacggtcacgtgctcggggagcaacgtccgggagcagcgactgcgggctttggagaggccgggcctggccgggaaatgtgcggtgggctcaggaatggcagcgcgtgacagtaataggctcgggaagaagcggctgcgagcggccagatctgccgcctccagccccgcgacggccgtaatcggccgctgccgggccctcattggccagatccacgggcactagcccctgcgacggccggcaggcggatccgccgccactgggcacgtgatggccggatccgcgggcgctggccccgcaatggctcgatccgccaggattctaaggttttcttacttttaatttttttagaattttattttagtgcggacgacataagcacccacacgtagaaataggatttttacgtgcgggtgcgcagcccgcatgggaaaatgacattttttcagaccttatgttacaagcggatctccgttcacgcaaaaatgtgttttcgaccatatggaaaaacgacttctgtagtagtatgttggagcgcattttatatgattccgtttgatgtaaaaagaatgaagaaaatcttatacaagtgaattaattagggcaacgtaaatcttcgttagaacgagatattgttattttcattgcctttctcgagcgcactcctgactgcaaaattaagttatccatcgatttagcacacagataatttagacgccgctttttacttgcactcaaaatcaatacgtcatccacgaatagatgcacaattactttgatattaaagtcaccggtgaccatttccaggaagatgatccaacaaaattcttcgacggtctaagtcatctttgcatcaatcccacgatttttcaccatgtttatttaccacgcaaaaactttccactctatcacatcaaatgtttgtacatatgcatgaagtattaaatatagaaaaatactaattacacagatttcgtgtaaattgcgagacaaatcttttaagctaaattgctccatgctttgacaatgtggtgctacaataaatatttgcaaatgatgaattaattaagattaataaattcgtctcgcagtttacagacggaatctgtaatttgttttgttattagcctacgtttaatgctttaaatgtgtgtctatatatctgatgtgacatgctaaaacttttcacccctagatctaaacacagctttagtgcaaatcatctctttctgtaaatttacaatcactaaatcctaaaacttaacatacaaagatatcacattgtaatccactaacaatatgccacatcatcatccactaataattattaaatttaaatatcatgtaatccggctatattatttataggtttataatttataaaattttagagcttctaaattgcaaccacgttaaatcatcatcgcacataattcacacaaagaaaagtacaaattatcccctaaactattatggtcgatcgaattatcccccaactattgaaaccggacaaatatccccctgccataatccggagtggttttggttctacatggcaatccagtcagttaattttttattaaaaaaaatcaatgggtccatgtgtcatagtctctctcccctctaacttacttattccccttacacctctctgtatctctctcgggtcggaggctgtgaaggagccccgcgcactagcagaggccgagaatgagccgcgcgccggcggctgcaagcctgcgcagcgggggccggcctgtcaagctcactggtcgtgcctcgtcctcccgtgctcgtggaagcggcagctggcgctggactggcgtgaggaagatggaaagcggcagccccaatcggacttccacgggtagatgggcgatggtcgggggagagaggcgggcggcgctggcttgatcttcttcatcttgagcagcttcttgccgattagcgtcgacgcgaagctagtgcagcagctgctcggatagtggcaggacgaggggacacagcgtggtgatgttcatcttcagcgcgttgccggcgactgctatgaggtccttggacagcgagactcccgacgtgccatcgccatcctcctgctgtcgtcgccgcccttgtgagttctcaccgtgtgcaccagctcgtacttggatctcttcttcttcgatcgcttgttggacagcaggatcgccacgctgcccatccggaagagacagttggcgacttcgatggagagcaggccggcgctgcagcctgcagcccatcctgtcctggttgtagctggtgatgttgccctggatcgaacttgtagtggttcacagctatggcgaacagggacgacgtcgggttgaacacaggctgcagttgacgacgagtacgccaatgtccttggcgctcacgcctgtctggtgcagaagacggcgccgaacatgatggcctcggcctcgatcgagccacacctctgccatgcaagggttcgatggctcgatgagcacggcgatgaagctatgctgaggagggcgcgtctcaacactgcaacaacaagtgaaggtggaccacgggcggcagcactgcagtccgaggtggcaacgaaatggcaacccgaagcttgatggtgtagcgcatgctcgatgacgatcggttacagaagtcattgtagccgagaacttgaacggatgatcaagccaaagttgcgtggggctagacgacaaagaggaaaccggagtcgatgctgaagtcggagacacacagatgtcaacgaggcggtgggagacgcaaacccaatctttgatcgggaaaaaaaaaaggtgatacatgcagaagcagccgcaaacagtatggcagtgcctaacttttttttttttttgagaactcatgcactttattaaaagaaagcgttttagaaacacaaagcatgagttacattaactgctccattaggagtgaaggaaagagctcttttagtaggacaaacatctctggaacaaatgtgagaaatattagagcaatcaaaagctaagcagctgttagtctgagcttgtcttgctgactttgcaaggccatctgcaactttgttgagctctctagagatccaaatgattcgaacttgttgatcctgcagaaaatttttaattcttgaaagaattggtctcagagaccaatgtccggggttttgtatgtagtcctcgttctgcacagcattcactatctcactgttatctgagagaaaaatagggtcttgcagctgaagatgacgagcaatttgcatagctaaaaataatccttcagcttctgctagcaaaggagttcctgcattgagactttgagctttgatgacaatagcattgtgattgctagggttgtggatgaagatccctactcctgttttctcttccgtccaagaggcatccacataaactcttgtccctgcaggaattttaacaacagaatttcttatattattctcttcagcccgattgaagtcttggcaactgtcttcttccatttgatgaacactttcatatgtctttgccattgcctgcgcagcattgcacacttgttgtggctcccaaatctttgttttgaagttgatatcattccttgctttccaaatctgccaaagcataattaaaagattgtatatattgatgccattagctgaaagataggcaataatatcttgaacagagcctagagaagaaagattatcagctttgagattaaagtcagagatgaaccaacataaacgactgaaattacagagaaagaagagatgcaagtcatcctccctttgaccacaggtccgacaattgggactaacggttttgatcctgtggtgcattctttgagcagttgggagagcattactcagcagcctccatccaaaagttttgactctgggaggcatgtacctgtgttttcagattaatttcaaaagattttttgttaaattactgacctgattttgattggggtacatttcattgtaaattgtcttgtaagcactcttagctgaacaaactcctgagggtgtgtacttccagcaaagcctatcttcctcctctccctgcataatctgaacctgcataattgaatgttgagctgcactataaaaaatttgagttattttctgagcatcccaattcttattctcatcccaaagatcagaaaccttatcaggcatgtgaaaaggaagattatcaagattaagatgatcatgaatgttttttcaaatagagcaccagggttggctccaaatagaaatatcacctttagaaagttgccacactgaagcttcctccaagacatcccttacctgaagaatagaagaccagaaagcagattttggcatatctgttctagccttccaaaaggaagtgtttggaaaatattttgattttaggacagaggatagaagatcatttggattagtaagaattctctaggcagattggacaaggatacttttatttacagccatcaaatctcttatgcccaagcctccctcagaaacaggtttgcaaatgtctttccaagacctaagagccattccttttttgccaccatctgcttgaattcctgtccaccaaaatttccttataatagcagttagtttagcaatcaatttttttgagaaaagcatgatggacatgtaataaataggaatggaagcaaagacagatttaatgagggcaagcctacctgcatgagaaagagaattagctttgtaagtagtaagcttgcttttaaacttgtcgacaatgaaactgtaggcagcatttctgtcttttgccctcaccagaagaggatgccctagatgctttgtgctggagttcataagagaaacaggaaaaattgtaagaatattttgtcttacctcttcaggagtacttttgctgaacaggatggaagatttgccccaatttggagtctggcctgatctgagacaaaaggaattgattatttcagaggttttcctgacttcctcttgttgggcctgccccacaatgattagatcatctgcaaacatcagagaatgaatggaaggatcattttgtcctaactttattcctgaaatgtggttcctttgaattgcatctgcaagctggtcagaaagttcattaatcgcaaggacaaaaagataaggcgataaaggacaaccttgacgaatacctcgatgagctgaaaagtacccgtacgattgaccatttataacaacagaaaaattagcggagttgatgcaggaaagaacaagacgaacgaaattagcatgaaaccctttacgacaaagagcgtccgctatgaatctccattcaatcctgtcaaaagctttagacaagtctatttttaaaagaaaagctttttgattaaaagaggtgagattaaaagagtgagcaatttgctgagcaagcacaatattattagagatgcgtctccccttgacaaaagcctgctgagtgtcacaaataaggttaggaagtttattctgaatgtaattagccaaggacttagcaatgattttataagaaacattacaaaggctaatgggtctaaaatcagcaggggacttaggattagaatttttaggaacaagaacaatattagtagcattcatacctgattgaagcttacctgtttcatagaaggagcctaccatggcagtaacatcgtcttttatccaattccaggcagctctataaaatgcaacattgagaccatctggccctggggaggcatctcttcgcatttgctttagaatttccaggatgtcattttcagaagggatttcagggggaggaaaaattacatcattgtcattttgatccatagaaggagtggcatcatctgtattggagctttgaaagagattttcaaagtaagaagtgaagacagttgctatctcctcaggatcattaattattgaattattatggataacactagagattctgttctctctccttctcttctgggttgctttttgaaagaaagaagtgtttctgttacctttctggacccaatgcttcttacttctctgtttgtgataatcggccagcttctgcatggtaatatcatgttgttgcacaatccttttctcctcaaagtacaaatgttctctgtcgggggaactctgaattttcaacagatcttcttccaactgatccaattgctgctgaagaggtttcttctttttgctccaagaggttaaggatcttgctaacaaggttgttcttctctgaaaatgacagtttacagactgcagccaggctgaatgagcatgctgattaaaatctggttcaagcagccaccaattttcaaacatgaaagatcttttaggcctcctgttcttcggattgagaatggcaatgatgggagcatgatcactatacaacatgggcaagtgataaacagtggtatttggataatcaaaacaccattccacatttgcaagacatctgtccaacctttccaaaaccagatccttaccctgttgcttattggaccaagtgtaagctggaccattataacccatatccataagccccagattattgacatgatgcttaaaaatattaatacgattctgattaggaggggccaaaccatacttttcattagcatgcatgatctcattaaggtctcccatacaaaaggtaggtatgtgactactatgtacaacaaaagaggagatttcactccacatggcactagtggccctgtgactaggatcaccataaatacaaagaagattgaaaataggaccagagttcttatagactccataagctaagatataattaacactagactgaactatagtaagatccatgtcttcatcccacatcagccacagaccaccagaagcttgatcagcaggaaccacatgactattagctacatgaaaatgatggatcagatcagaagcagtgactttagagctttttgtttctgaaataaagattaccttagcattagtagagtatattaggcgttggaggtgttgcattttcctactgccgaggtgaccccccatacctcggcagttccagcttaaaagactcatggcgcccttgacgccttatgggctggcgccattgcccatccatcattctttccacttccatctccaccgtttccagcactgggatcaacaagctgaatctctgaaacattgcattccctaggatctgtagccagtatcagcctggagctagctccagcatcacttgcaccacccccttgagtatctccggcagcttgatcaacaaagatatcatgatgcacctccaaagcactccaagtatgcttcctgctatgaaaattgttaatgctttgaggggatcttggagcatctctttgaatgacatcagaatgagcagcagcaagaggtctccaagaagtggaggtcaccattccaccaccataacctcctctctgatcccatcttgtagctctctgcccacctcttctacttggaaccctgattggtgctgaatgatggttagttggagaagcacttcttgattcaatccctccatgttcttcacctcccacaatcgagaaggaagaggcagctgaagtagttggggagcaatggcgtttggtagattcatgggctgcttcatgaaaccctctcttcttacttaaatgttgtgaggctgtctcataaatcttggtagctcttgtgcttcttctgtgttgcacttcgttggtgccaatagcagggttaactaaactgttctgatgggcacttgcactgggtgaaactcggtgaaccaatggaacagactggactggttccatctgatgcaccttaccagcagtattgacattctttgagttgcagctgacatgatcctctatagtacttgaaaccagcttctttttctctgtacttccatgtaccaacatctcttcggtaccaacttctggtatactttgtatatcaggttctttgtcttttttctcacattgtttgcctgctgtggtagtgtgaacagcttgacttgggggcccttgaacagtgctgcagccagctaaagtcaaagctttctcactcgcttttttccaatctagcttgggcattaatgactggctggtcccacttcctctctcttgctgcttctgctgttcttgaatgttcttgaattgaggagaagaaaaatgttgcctgaatttttccacaattgaatttttgttggattcctccatatccaaaaatgcctctgatggcatataatcgatctgagtgatccactttcccagtttatccttaagatcttcctcgaatgcatctggaaattgaatgataattctttgtctttgaggacagacctgaacattatggaagaggagaccacaaaaagtacatattctgggagttctttcataatgcagaaaagctttaagttcagatttatcaggaagctccaagataacatgatcaggaactggtttttccacatcaatcctgattctaacacaaacaaatttctgattcctcagcaaactatctggatctattggttcagcttttgagatttgacctatgttttcagcagccaacttgacattcttaacatttctaagacttgggggaatgccatagatacgcacattaaccataagatgcttgaaagtgtaagctgacataggtttaattttctcatccaaagaaacccattcaagcagaaaaacatcactgccaaaagaccacggttgcttttgccaaacccaggacagatcttcataattacgaaaatgagccataaagagattgctttctacctgagagatgtcaagataaactctttgccaagcttttgccattgatttcttcaaagcctccaaagggatctgcctctgctggcctccagaatgtccaaccttcatgaggaggttgtgagtggtttgaactgttgccgtttcaggagactgttgcaacctcactctgatctcctttgttggtgtgattgtcatcgcttccagagaggtggcaatctctggaagttgagagtggactacttcatgctcatcctccaggggtggatccccatccagatccatgaccccctacgaacgccaaagcagaacaaaacaggaaggggaagaagaaggtaaggaagagggattgaacgagggaatgtggaatagaatgtggatgaggaggactaggttagcattgaagaggaaagagggaaattgaagaagatgggaatagggcagcaaagggctgactacagtatacactgacttaggtggtgtttagatccagggacttaactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgtaaattagtccaagattatggatgggttttattaatagtctacgtttaatatttataattaattttcaaatatccgatgtgatagggacttaaaagttttagtcccatctaaacagggccttacggcatagagccgaccctcgttagcgcagtgcctaacttcaatggtgcaaagaccaagtagccgagcaggttttcaatttcgaaattggtttttttctggggtggaccaaaatttcagaaattttttggctgaaattatttaaatgttttactgattttgaatgaatttaaataaaatttgaccaaattcataaaaatttaaaaaacccgaaattttcggatgagatatgagcttgccggtcatggacgaaattaccgaaatttcggaaatctcgaaacaaaatttcaaaaccctggagccgaggcggttggtccatggtggccatccccacgctgcggcggagtccagatggcgcctgccgcttcccgagagggggaatggaggaggtggtggctagggcgaaacgactagcacgcccccacctatgtctcgctgttccgggccgtcgcgctccacgcccggaacggccattgctattccctatcgcttccgcgtctattgattgcgtcgccgacgcgcggcgggtcatcctgttcgacgagttcagcttcaggcctggcggcgtctcggccgtgtccgtccacgggtgtcatggcggatggccgaggcccgagaggccgaagctccaggccgccgaccctggcctaatggggttcatcctcatctcaaactccctcttctttcagatcaacaaacgagtccgactacgctgaggccaccggcggcgccttctgcccgctcaccatcgacgatcggcatggcgctgccggaggccaacattgcgcagttcagctcatgcttcgccggtggactgaagcagctgtgacgaacagcttgttgcatttcctgcttcttactgctacgaattgttgcagagttcagaatttgttcagtttaggtgcttctgtaatgctagcggttggattgcaatcgttgatcaatcacataagcgattgcaaatttgcaattgtcaatcaatgaaaaagtcagataagctgtaaacttttctacatttttttcagagatggggcagaataaggcctgcttcgatcagcttctgttataaaaagaaaacactgaatattcggttgtatactgcatttcttcttagtaaatgcacttttctaaagaatcttgctcgcgcctcttgcagaagacggaaggggagaggaagagaaagaaagagagaaaggatagagggggagaaaaagaaagacagagaggatgatatgtaggccccatattttttttttgcgaatgataaatgggtcctatatatatgtttttaattctactaccacctaaacgtcacagacaagtcaatactgtcatgtagatgtcacgtcagcgaaaccgtcctctggagggttgagatatccagtattgcggtttaaggattcgaaatagatttggtcacaagttaagggagtcattgtaaacatatttcaaagaataaagacaccataggtcccgggcccaacagaggcccaggacgcgagggttttatcactctccgttgccggagtccggtgagaaaaggaaagaactcgccgtcgccgaccgcgggcgaggtggccggcgtcccctcgagcggcgctctcctccacctccgcggcacatccatctttttccacgaccgcctccgccgcgccctcctattctccccggcgatggcgccgcctcttcttggttcttcagccaccctcaaccccggccactggttcctcggaggtatatacgcatatatgtctcgtctctgctcctctaccctgatctttcagttcttgtttaggaactcgagaatcgagatgaccgaggaagaagccagtgcattctgaaacaaaaaaaaacccctctaatctttggttcagttgcatatggtggctttacttgggcgccttcggttccanatatgttagtccattaaattcttgttgcaatttattggatgcttctgttatatctagtttacttgtttctaaaaccttggattactcaattccctaatcaattagtacagtttattttcccaaatataccagtttcaggttttagtttgtataaaatgtaggtgcattttattaattgatttgtggaatacttacctgttcttttgaacaagcaaatccaagattttaattcgtttatagctgcaaatcctttcgttttcaattggtactgtaaatcatacatagtttgttcgactaattcggttctaggtttgaaaagttgctctatgttaactgattttcagagtttctaccttaattaatcatttcgtggatgaatagataggttacttctttaaatcgaatcgtgaagcacaaacacgtacagcaaaatgcaaaaagttttaaatttcatcagtataaatatggcacattaattttccatcctgtattcatgtgattcattacgatttcatcaattttaatccagggctctggacacctgctaccctttgaaattacataactagcattgctgcatttctcaatggatcatctctcggaggaactgatcataaatattctcaagaggattgcaaggacaaacaatctgaattctctttcccttgtgtcgaagcagctctacaacattgatgcggagcaaagggccactaatttgtgttggtagtggacttgcaattgaagctttaccagcacttttttcccaattccccaatttacacaaagtagagatcaattactctggttgggcacctggcaatgggagtcagatcgacaaccaaggtctccgtgtgctttcattctcactgcccttgctcaatgatctcaccttaagcttctgctctgaaatcaatgactctggtcttgcttgcctgactaattgcaagatgttgatgtccctaaaactgaactccacaccagaaataacttcaagggggcttctctctttagctgtt

SEQ ID NO: 33275 - DNA, 12416 bp, Oryza sativa
ggcccaggatggatgaagcttcagaaatttgagtttgaaaacgaacaaagtttttggagtatttcagaagagatcgtgacccatcatacaaggctcacacttatagatatgatcttttgtgcgagggtttgaaggacttgaggttggtgcatattgtaacagagccgaaaggcccagaaataggacttcgttttctgttgggaaagtgcaggtcgttagagaagctaagcctagagtatgttagtggtcttattgacaatgacatgattgcactatcccagacctgcaagaatcttaaaagcatctcactttggctgaaacccgaacactacaatgttggtgatgatataattttcaggacgggttttactgatgaaagtctcaaggcactagctctcaactgtcctttccttcagaaatgttgaactgacatttacaggttgtgagcattggcttccacctgaaataggcttcacacaggggacttgtgatgttcgttcaatcttgtccgattcgtgttctcatcctgaacggcgccctcttcttcgatggtgacgggatggagggcctctcatctgcaccgttcctggaaacactcacccttatggattgcaaggacgtaactgatcatgggatgcgctgcattgcacattttccatgcttgattaatctcactctccggtattgtaagcgtgtgagtgatgttggaatgaccaagctggctcatgcacagaaattacagtctctggtcgttggtggctgtcctaagatctctgagaaaggcgtgcagggtgctgccaaatcagtctgctatgaagtcaattgtgaaaaccttgcccattatttgcgaatctggcaaagctgtcatgccgttgcttagagcacattgtcatcgttaacctgctagccttttctcaccttacttttcaccatcattttgtacttgatagtacttaaattgctgtggttagctgtagcataagagtgtcttttggaaggcatccttcccatgaatgaaaattctcaatgacaaccttcttcaatggcttccagcattagtgttcttgaagttcatatttcatcctcaggatttttattttgccctttttgagtcaaacatgttattcctcttcgccatctgatttaacctgatgcggttttcaataattgtagacatctagcaaatcaagggaagagagattattcggatgaatgaggagataattaacctcccaatcttaaaattaaacacaagaagatatctttagcctgaattattcataactagtgacaacacctgatccaagatacacaatgttttctttagagggacatgctaacaacaacatcattatcgtctatatatctagaacagagttacaaatgacaaatataatattagcatataacagaagcgctcacattcaaacgacaaccatatagtacttgtgcaatcatctagcaaattctatgctcattgcagccaccctcctaaggctgtcgtaaccattggtttcacctgtgaaatgctctgatgtgtctgcagatgaacttgctgacaatgacaatgaactaatacttgtaagtaccccacggtgttgtcgtacttgtttttctattcgtcgcaattcctctgcaatcctgctcattgttggtctgctctcactagtcattgctaagcactggcatgccagccttgctagatcacctatcaatcccatgttatcctcatgtaatatttccgtgtctatgagctcaagaaataggccttccttcatggcctcttgaaatactgatgcgaggctgaccttctgcttagataatggtgttcgacgagttaaaagctcaagaaggatgacaccaaagctatacacatcactcttatcagtgagctcaaacttcagcaggtactctggatctagatagccaatggtacctttcaccacgtcatcgtgtccatcagctgccctaattttggagcacccaaaatcagaaatctttgcaataaaattgttactaagtagtatgttcatcgacttcacatccccatgtaagatagggtggtccagtgagtgtagatatgaaaatgcttccgcagattcggcagcgacttttaggcggatctctagtgttctgatggatggatcattttggctgtgaattagatagtgcaaagtcttattcgggacaaattcatacacaagcactggaacttcaaactgcagacaacagccaattagcttcacgatgttttcatggttgactcgagaaagtatgagcaactcttgcgtgaattctgtcctactattctcatcaaatcccttgcacatcttaattgcaacagggttgttcacttgatcgagattataccctttaaaaacagtaccctgacctccttcaccgatgattgacatcttgtcaaagccttttgtggccaactcaatttcatctcggtcatacaacttaaatgaaatgttgttctctatgttcatcatatctgtcaacaattggcctccgtgtagattaaaatactcacccctctttctcatgaggtcatgccttttaattcgttgtttgtatttgatccattctatcccaagcaaactcgttaaagcaaccaaaagagtggcacaaattcctggcaagaagatgttaaaaacgttcagcccaactatgtatcatgaggaattagcccatgacatgttcaaaagaatcaataagtaacacaaaaaaatgtattgatctatgctggtacgaacaagagattcaaatttgttcgaatgtatctaaatattgcaagattgaaagttttctgtgtaccaattgctagccctccgtcgcatggtccattgtaggcattgcctcttgtaccaaacgggcaagtacaattatagcctccaagtttattcctgcattttccgtagcaaggatacttatttggttccttgcactcatcgatatctgcagcaaaataccagtgacattaagaaatggaattttgtggtgcttagttagaaaactgtacaatttaatggattgcaaaaatcaatttcatgtctcccgtctctgtaatacagacagtattacaggaaggcatggaagaaaaaaaaatagaattatttggacgattttctttgttttattccatcagatcccttctttccatatagttaaaacccaaagctaatttatggttaagccacgtcacctgttaaatcttagccgttccatctaatctggacgctcgcacacgcgtgaagcccagcgcacttcgtcaagccattggttacacacgaaaaggccaaaaaaagcccaatacacaccctagtaaataccatccggcattcctcctaacctctcctcgtccgtccccacgacaaagaagtggtgccgccagggaagcgcaaccgcacgccgcctctcctcccccacctgtggtgcttcctctctgatgcttgacgccggcaagtagcacggccaccgtgacgatggcccagtggcgcctcccctgccccacctcaccccgcgatggttcgtctccctttgcttcccctaccccctccccaaacccatagcaaagccagaaaccgcctatgcccttcatggttgtcatcaagacattaatttcatgcgactgtaatgtcatggcaaaatcatcgccgtttttcacttattgccggggagacgcaacttcaatacaaacaaattcaggtcctcggtcatcctctacctagttcattccattcaagcttctacctgtatgaggttctacatttgcattcgtgctgcataggtaccacttcaaataatcccttgtatcttttgattgattctgtactgttgcagttttctgaaagctcttactcgccagctctttcacatgtaaagaagggtgattgatgatgcagtatctacagctttctttgctgaatgtgttgttccgctccaatcttattttcaatctgcagaaataaggctggtatgtaacattttccttgtacattgagccgaattttgttgatattctctatgccatatgttcaatttgatttatcctacactgattgtttagaatacctaatcaccgatgaataccttataatccaaactacactataggacttttctaaggcatggaagcttctctaaattctctgcttatttgaattacattttagactttactgttttctgcggctgattttgcagatttattgacgttcatattggattttcacctgccagactccagtgacctttttactagcttcttgctgcagcgccaagtgaccctcatttttgcataggtcatgcagttgtccaggtaagccttcttcatttctctatcgccatgaccccatcaattgatttaattttgtggtttcctaaagaatacaggaacttgaattgaaaattgatttattagttttttatttattgtgtgctcctatgtctaccatcctatttttgttccatgtagagttgacattatctttggcggaagatgtacatctatacaaaattgtggacataatcaggtaagataactcccttatacctgtaaaatggtcagcttaatgttcaatttacttttttaaaaaaaataaaaaagacctcaatcttctttaaccctaaatcatgttactcatccttttacgagcaatttttttactatctgactttgttttaccacatttacaaatcctagccatccacgtatgcaacaaagcctccctattaaaacacgtagaatactgccttcattgccggacaagcacattgtctctttcaagaaagcacattatttattttcgccattctactgagcaatcattatatttatcacttataattcccgcagtaatacgcatgcatgttatattttgagcagtacatgtttgaattaaattccagaaggtataggcacaagcttgtgcacaaattgtgcgcgcgcgcatgaactgactagaactttttttttcaggtttaacaatctatagatgagaattcagaaaaatttgcttgggacacattcctatacatcttttttttaagagaacacagcaggggaggccaccgctgttaagacatatttattaaaggaaaagggtgcaaattacaataagtttatccagcttacgattacatcgtgatatctcgcattgattctaaacaatataagaaagaggtcactcttcacgagttgcctccaagaagacagagaagaaattttttggtcaaaaatggaactattcttttgcttccaaatattccaggcagcatatagaaacttctccataaaacagctccctgataattcagcttagcccttataaacataccctctaaagaaagggtagtatcccaagtaaatacccaaacgattccaacagttttgggcaaaagggcatgtgaagaacaggtgcattaaatcctctatggtagccgattgacaaagaacacaagaaaattcctatacatcttataagctgaaggcacatgactgatgtaatataaataatttaaggtataattaactcttagcaatccaaagccggctgagtaacgaaaatgaaataaaacaacattttacaccataaaatttttaaaaaataatgtaaaagtcgtcctaactttagcgatatacattattcatcctttaactttccaaataatttaatttgcactcctcggcataaaaccaaactagttttgacttacttacttcctccgtctcaaaatataaacatttttagcatagtgccaagtcaaccatttttaacttcgactattaatagcaataaaataaaaaagatcaaccatgtaaaattgatgttactagatttatcattaatcaaactattataatatacaactctttttacttaaaacattttatttttatatatattgtttgttatagtagcatcccgaagactttgacgaggtccaaaagtgcttatatcttggtacggacagagtagtacttaaagcaggaacaatagcaggctataagcctactataaacatattttttaaagagataatagaggagagggaagagcagcgggctacaaatttataatcagctatagcacgaactccaagacgcagtatgtgtatgataagtggggctaagtattaatagtgtagtatttaactattatatgaattagctattaagttgactataggtgatttgaagctagtagttagctataccattaaactcgctcttatatggaactccaactaggaatggtgccattgagtaataagcaggacatggctatgtcaatggatggcaattagtcgagtcaggtatggatggagtagaaacacacctgaccaatgcccgcaaatatcgaccggcagaaaccagaattttttattttctgaactttttttttaattttaaaaatagaccagcgtgtctagcgtggcaatacaaaactgccacgctgtattttgtcttgccacgacaatgagggtggcatggccaaataatgttgtcatgctgtgacactgttattttgtcatgccagttactactacagaaatgattttctggacgaagctctctttggattgcagacagatcactcgtcgcgtctgaaaaaagtactcaattttcgcaaacaactccttaggagtaacgcacacaaaaattaattttcataaacaggtctcttaaaggtccgcatgcaaaaataattctatttttgctagcgtaccttttaatgggctgcacgcggaaatatattttcgcaggcggacctcttacagttccacctaaagtccgagttacctcctcattttccttacaatccttcaaaatttttcatccttatccactcatctctctcaccttctctcattatttcctctccactctctcacctcttctcctctcctggagatggattctaatctctcgggtgtacgttcacccgtttcttacatgccacctaaataattatgaaaaaaattcaaaaaaaattataagataggttaatatgtaatatatcattccacaaacatgcaagttcaaattcgacttctaaaagttgtaacaaaaataacaaattaaactctaactagtatacgtatattcacagtcaaatttgttatttttgttataacttgtagaagtcaaatttgaacttgcatatttgtgagatgatatatattacatattaacctatcatgtctttttttttgaaaatttttcgtaatcatttagatgacatgcaagaaacgggtggacgtccacccgagtgtttaaaacagtttcccctcctctcctctctcacttttctctcacgagacgggcagcgagcggcgggcggcagcaggtggctcggcccttgggtgcttggtggcggtcagatccgcctccaccgggtggcgcggccaacggtgggtggcgggcgacacagccgacagcaagctcccccgctcgttgaagaagggtgacaacgggtcccctgtacggaaccggcaggcggcggccgtgccccgccaagattcgcgtggatccggcgacaacggcaggtgacagggacagagcacggtggcaacggacagcaacgatggagcatggcggtggggggtggacgagccccgcatggatccagaaaccaaatacccatcccatatcccaagggcatgagtaacacaattaacaaggtagcaaaattatcagttcaactttcaagtttccaacaatcaacaaaagatttaacaactttatcaaagttcaacttttcatcatctagcttcacgctgcagttttcacaatcaagcaacactgatccaaaaatattcagtatatcttcacatactacagtcatccaaaagtaattgttatatcctaaatagtgtgcatcaattttgcagtttttcacacaaacatcaagcaagctaggttgtgcccactagattcgcaggtcgggtattggttgctcatgggcaaaataaaaaaccttgctgcacccgctaggttttcgggtcttgggtcagatgtgtccataggtgaaaaaattagttgctcaaaaaataacttgccaaccatattattttcacgtcaaattaacttgctcaaaagtgcatgaaaggatgggattgtatgcaacatcaccttggcagctgtcgggatcatctgacttcaggtaaggatttccgtagaatcctttggagcagttgcatatgtagcctggtccgttgagcgagttgaagcaatcgctgtatgtgctgatgcagctgtaattggcctgatgccgtgcttcctcacatgtcttgttcccaatggcccaatccacgcgtagcggagcctgcccgccataataatcattgaacgctgaagatgtagagtagttcttggagaatttgaatctagatgactccacgagtgctgcatagctacaaggactaaagttgtagatctccgttgtgttgaagcgtgggtcaaacgaaatctggtagtactggagccccttggggatattcatttggcaacaacctatcccgaagcagtcaccgtcgttgaggcttgaatagttaccttgccagcatgtggccacgcacccggttgttgttaaattgccagctgtatccaaattgtcgatgtacgcaagtgttcggcacccaatgaccgtgaacatgttgccaacgttggataatctgtatggtgtatctcttaaatctaacccccaacctatatagttttcatccatgctgtgtaaagtgtcgttgtagcagtaattggatatgggcatcctcatgcgaacccaaccttctagcagcgagatgttgagcagctccacgttgccggcatacagcttgccctctgtggtgttgcatgtgaggttgaagccgggcaaggcgcaggcaagctcaaggccaaacgggtaagggatctctatgccgctgcaatttctctcgcagctgggcggcggatcacttgccaataccgctatgcagagccatggtagaacaaaaagtatgtgaaacggagacatggacgatttgaggttaatgatcagtgttgtgttctaggccttggtttggttgttgcttacttgtgagcaagtaactctgaggtaagatatatagcagtggccacttcttccaatagatgtaggagaaacgatctttaactccagctaaaatgattttaattttacaaatcctgccttgacctggacttgttcaagtcttcatcttcacatagggatagcttagcgcccggagtcgatcgatattcctatttgtgatctagacaaatcctgccttgacctagactagcttgttatatataactgtacacccagcatgttgttgtcatgtggtggtacaatgattcatgcacatatggttgtaatatgtggacaaaaactataaatattgataagaactgcctaatccaacagccaaaaaagtaattaatgtgatatttggaaagattagctcgatcgtaatttgatgtatcaagtaacctccaacaaaatgaaattaaagttattggtgtggttccgacaatatacatactacctctgttcagttttaactggcgtccgagaattaatctatgccgttcatacatttgaaattataaaaaaaatcatatacgtaaattgtaccaatagatttgtttttagaaatactttcatgatattacaacttcattagcatatcttgatataaaatcatgcacactcaaagtcaacctcacgtcttaaacgctctaataatttaaaaatgtctagaacaaattaaaagaacagaggtattagtacatgaaaaatcattaaagtagagtaaagatatcctgaggacttatgggagcgtcgcgacgacctcttccaccaatcgacatcttgactgagccctgagtaattaatcctggcgtcagtcccctttcaaaagtttagtaaaatatagaacacattatggagaaatgcaagttgcattatagattatttcgacatataaatactggatagtcaaattggcttcttaggcattcaattctatttgtcacacaccaattatatatctcagataatttgatcaaactattacaaaattacaaatatgtagtatgataaaactatatatttagcatcaaatttatcacaaaactatatatatttaagatgaagaaccataaaactatagattaggtatcaaatttatcataaaactatcgatttatagctccaacataataatagttctaggtatgtaaactccaaaatctatagttttgtgataacttaaatattaatttgtatgttgtgatacatagccctaaatttatagttttataaaaaaacctggcgctaaatttgtagttttatgataccacgccttatatctatagttttgtgatggtttgattaaagtatatgtggttttatgaaatttactctatatcttttttttcccttgccaaattttccaaaggttaatcatttttttagagttttaatagaaatcaaaggttgaggtcacaaatgattgtgattaggtgagagatagttgttatgggttttgataagaaagtatgcagagaaatattaagattattgtacaaattttgaatcctaaaaatgtttatatttttgaaatggaaagagtaggtcataaaaaatccacaaagcaacagagaattttgtacgatcttttttaaatcatttactagttttaaaatttgagagtagttttctctgcctcatgccacacaccagtgttatgtaactttttaaatctattttctaaacatttgtaataaatttataatgatacataattaaataaaaacatctatgtatctatctatctatgtatctatctatctatctatctatatttatatctatactaatcggacactttctacgagctctcacgttaactagaaaaatctaaccgttgattaaataaaccccatcatcacaaccgtagatcttaaaatctaactgattatgtttaatgtacggtgggccacctttaaattccgtgcaatctacgttacgtaactaacgacgtagccaatcgtatatctcataatatggtgactacaaacacacgtgacctagccatgctccagttgccctttgtcctgatcagcgctgattttaaactccaatagattccacacctgaaagacctgccatcggtaatttttttctttcccgaattttttttcccaaaatcgacagtacacatggcatggagacgtattttctttttctttttctcataattctgatattttctttttctttcgtaatttttcgtcaaatcaatctgataattttctgcacgtcaattagatatcgcatattagcgatgagagtaaaattgaaaaattactgcacagatagttttgtagatcgaaattaattcaagtacctgcagaattaaacgtggaactcaacaataatcccggctacgaggcgggatggcgggactatctcatgtacacatgcatacgacgttggagacttccccagcgttaggcatggtgatgcaaaatatggatcacagaagtttgcatgcagagctgcaggcagatgcatctaagtacttgatcctggtcacgatatgttcgtggccgcaggagcagggtggatgggttgattctgcagtggtgtcggtaagattactaacaatcagtgccgccgcttgccgccggtctgaccgccggtatatcaccggttagactgccgaaacccgatgaaacacaaatcgaagaactcttaaagtagatgacgactttattaattctctatgtgtttacaaagtgcaccaacagcacttcttacaaaatttcgactaaactcgaaaccctatctcaaaactcaactcaattgctctaaaaaatgataccaggaagcctcacactccccctttatttatacccgaggtaggcagcctaaagccacgaaccaaactcatactaagagtcctaaacaccttaggaaaccctctagtacaggaaacaaactttgcataaccaatcatgtcaaatttggactccttccaaattctattccgcatcccatacgcacacaatacctccatcgtatgccatatggaatctccatcaactacgtgcatcaactctagcctaagtatttcgcatgatctctgaccaccacggacgtcgtcttatccccaagccgactcccggtccatcaccgcaaatactctcccgaggcatcgagtcacctacacatgaaataaacaaagaaacaatattccgagaccaagctatctccaacttgactcattagtagcaaacaacagtattacatacgtatagtatccatctagaagccataatcatgaaataatcacggatatccaaacaaataacccaaaaacgaaaccgacacagagtcggccag

SEQ ID NO: 33276 - DNA, 1396 bp, Oryza sativa
ccaaagattttacaattaagcttgaatcaataatcaaaattcataatttcatacgatttataatgcaacatcttaacaagcacataggttgaagaataaacactaaacacatatacctattgcatttatcactctttctcaaataacctttagcacaaaacaaccaagagaattttttaaccttttctttttcttgagactttttgctcatatttgttttcttttattccgggtacgtccctatcgtcaagactatttccagagattcggcacccattattttgctcacatcgaatacgtccttgtcgtcaagactgtttccaaggattcggtattcatttttttttatattttttattctcttttcacaatgagcaattaaagctatttaaggaataacaaatcaataaagcatatatatagagcatttaaaaatcaaaccatatgctaggatcaacattgcatatttgcttaatttaagtagaatttaagtgtcatgcatcatctcccttaaaagcaaaatctaaatctcatgaaaaggctagaatacatacaagctatgctatagacaaataaaccttcaaagtattgctagcatgcagaagagaataccatatgtataaacaaagctctcttttatcattttttctcattgtcatatttttacttgataaaaccatgaggtacaaactccccctcaaaccatgccaaaaggatgaattattcccaactcaccacgaagaaaagcaaaacgattagaatccaaagggtttagtgaaaatatcagcaagttgcaactttgtgtccaaaaactgcaattcaacatctcccttctcaacatgatccgtcaaaaagtgaaaacgaatatcaatgtgctttgtgcgtgagtgttgaacaagattcttagcaatattgatagcactagtattatcacaaaagagaggtactttctcaaaagtaagaccataatcttccaaagtagataaaagccaaaaaatctgtgaacaacaactagcagcatcaacatattcagattcagcagttgattgagcaacactagattgtttcctagatgaccatgcaatcaatgatgtaccaagaaaatgacatgttccactagtacttttcctatcaattctgcaaccaccaaaatcaacattggaatatccacttaagcatatagaagatgaagtagaataccaaattccaaactcaagtgtatgattcaaatacctcattattcgcttgaccgcttgacgatgtgaagcacgaggagaagcttgaaagcgtacacacaaacacacagcaaattgtatgtctggcctagaagcagttagatacagcaatgatccaatcatacttctatattccttttgatcaacagcttcacatgggt

SEQ ID NO: 33277 - DNA, 407 bp, Oryza sativa
atgctgtgcaaagatactaaaactcctgaaagatcatgttctgaaaaggtatctaaatagaaatactttgcaatgaactacaattttaatcctaattttccagtttattaacatttcattaatattaaattttaaattccaaatttgtaggataaaaattttgatgttgatggtataatgagaaagctttgtaagcctggtatgtctgtttccttttcaattatgattatttctttgttatttttttgatagtaattctgctttttgattcatatctgtttcttaagaaaaaaatttatattactgatttaattttttatgcaggaatgatttctagtcctccaaagataactaaagcaagatttgttggtttcaatgaaagaaaacccatctattttgatcatgag

SEQ ID NO: 33278 - DNA, 666 bp, Oryza sativa
aactagtaacctcagctatgttcctctacaatttaacctcggaattatatatacatccttgctggtgccaattggcgccaacaagtctggtaaaatgtcctacgaactactcctttctgccggttcttatgtttcctccttcctaagaaattatttcagccctatcttcctcaagtccacgaactagcaagctgttcaatgatccaatggagagataactcatatatctatttatccagttttagattatcgcagagatggccaagttcaggcctggcctccatccatgatgcaaatgttggctcacgcaaagatgaacagtagaggtaggatcggaaggtgatcaggaagaagtaccgcctgcagttaaacagttgaaatcataatattaataatttggaaacatattgggaagagattgaccatctggaactggaaacatatactcctaggacacagcctataggatactgtaaacatgtaggaccgaccgtctaggatactgctacacccaaacacaatgctatacatatagcttgtatttattcagctcagaaaaacccaacatatttcttcaaagaaaatgtctcttagattttttgttacattccacaggacaagtgctttccccttaattttgtgcagtgtcattctttttgatcaagc

SEQ ID NO: 33279 - DNA, 2255 bp, Oryza sativa
  unsure (1)..(2255): unsure at all n locations
aggtgggggtaagtacacaaacttataaagtgttcattttggtgtaagaagtgtagtgcatgcaaaccaactaaccaaggccaaaacggcataccgtagctaatcttgatgaaatgggtgatgattagggcgccatgtcatggcccacgtgcacatgtaaggaccgtgtgttacatgttatatcaaataactccttgtttttggcttttttgtccttcatctattcctatccatacattcttcaattatttctatacaatgtactattttattgtacaaccatcatgcattatcatacggttgattgaacatgtatgttcctatgactcttcctcatttatacatctgcatggcatcctaatcactgtccaactccacaaaattaaccatggtgtgcagcttggctttattcgcatggactacataagttcatgtactagaatgggcattttgcaagtctgtaaactaaattgcaaatcaatggtcgaatgatagaagatcataaagaaggccaaacaaacaaataaactattgcaatagcatgcttccaccaaagctgatgctccatcaaaacatactaaaaatatctttgccactgttagtgttaagcaggaggcacaacatcaaagctccaaaatttggaaatcctgtttgttactgaggcagaaatattgatgactcaattatgtttttgcagaaataactgcaccatggagtgtagacagaaatatttgttcgctactaccaattacctatgatgggtcagaaagttcgaatggcagagtttaattggcagaattgatcaataacatgaataactagattaaaaaatgcatatgcattgaataggcaactattaaatgcaaatttttgttacaaataaaaataccttgaaaacttgtggtgcaccacagaagttaatagtgcttgaccttttctgtccaggaaagaagtacattttgagtattgatccctttcccaaaacagaaccattacgagctttgacaatggcttccatcattacgtcaccttgtgaaggctgaaaagatgctttggattcatcctacaaatagtaaattataactaatggtgccatttcctcaaaggtgcaaaaatgatatttttggttagaagagatgaggatatttacattaacagtgaaaaaacgcncaggtcgtaaccgtatgctccatttcatgctttggatctctggcctctggtgtatccatgctttaaatgacatctttgcctctccttgcccgcagaaaccatcaaatgcttcactccaaagatatgctgagaatgcaactaatttcaagtacctctccaaatattcagcaccacgatttaatgcaaccctcttaactctttgctccacatgctgttggttaattacttttgtgtactgcaaaacagcctggcgaatattctgtaaagccgagcatttgtcaataacattatccaaagtttgtctacactcgattccgttgtcaaataatcttgtaatcttccgcaaaacaagtatgtcatcaattccaaatctaggatgttgttctgtcacagtatgaggtcttggtgaacttgaattaaggtgaccattgtgatccgttgtttcttctccacttgagtaacccaattcatttggatcttcatggttatattcacaagctggcaatctaataggtctgccatgatcaattcgcaatctcagcagacaagcaatcacagtacctgtagttgttcttcccctgcccatctacaaaaatcagtaagttaaactcaacctttgtagcctttcatataattcaagagttgcctaacatagaattctggactaataaaacaaatgaagtgcagtacctggcaattaaaaacaaatgcagtatccttgtgagcagctgccacatttaaggttattgtgtcaaaatctgaacttttgggggctttgccatcagtgattggcactcgagcatacttgattggaagaccttcagactccagaagtttgtacacctccaatggagtcaggcacagcttcattatttacattttcccatgcatcaaatatctcaccattgtcagtttcatgaataaccattatggccccactatagcgttccgcttcccgtaaaatatcctccttcaaacgagcttccattcgttccaccctatcacgatcaattccctggtgttggtgcattgtgtatcatttagaccaacagaacagttttgggaataagctcaacagagcacat

SEQ ID NO: 33280 - DNA, 2714 bp, Oryza sativa
  unsure (1)..(2714): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagatatcaaaatatttcgtgtacacccaaccattgaccctttgctttccttccaagttcttatgctaattatatttgttgaaatgtagtctacatgatcatttacatgtattgtatacatctttacagaagagtgagggaagtgctgttcccactccatgggctccaggaatgggtaggaacatcgaaaagtatgttttgagggaccaggtttgttcattctccgtataattattgattgacctctcttgtctatgtaaatgctaattactgtgagttctttgtcagcaagtaaatacattgtcggtagtgtgattaatcataattaacaaatatctaggcggattttaaggttctggatgtgcatatgtgatccgctttgttgtatgcacaacaaaatcatttaaatttagattgaggcagctatgcaatttagtgcaaagttagattcaggtggatgaactaatcatgggatcagattctatctgaacaagtggataggtggcgcatgtctagtccattaagagagatttgcaatgttcttaaaattagtgaactcatttgctgacatgaatgccatatttggcatgctaatagaaatctgtccaattttattgactatctcatgcattcattctatttaaaaatctgcatttctaatttacatgagcaaatcataaatttggtgcaggttgctttaagtagcttgatcactcagtgattatcaattatatatctgtcttgttgcctttggtgcttagtagcgatttgattatcaattgtttgtcttgtgatatcaggaaacccgatatcgtcaacgatatcttgatctcatggtaaaccatgaagtgaggcatattttcaagacaagatcaaaagttgtctcttttattcggaaatttcttgatggtcttgactttttagaggtgggcctgtgcaatctattctgttattcttcttttgtatattcttccagtccttcaaatctgaatattctatgtcttttctaggtggagactccaatgatgaacatgattgcaggtggagcagctgcaaggccttttgtcacacatcataatgagttaaacatgaggctttatatgcgtattgctcctgagctctatctgaaggaattggttgttggggggctggatcgtgtttatgaaattgggaagcagttcaggaatgaaggaattgacctgacgcacaatcctgaattcccaacatgtgaattttatatggcatatgcagattacaatgacttgatagagcttactgaaaccatgttatctggtgattatctcttgatgtctctgaaacatcttttttttctttttattttaggaagtaatagtatcttcatgtcaattttgtatgcaactgcaaaatgacctaaatgcattttccttgttccgtaggcaattcatgatttgctattgttctgtcatatcatttttttgccgtcctatcttgtttttactgaaatcaacatgaagcagcctgttcattttatctaatgatctgattttatggttgacaggtatggttaaggagttgacaggtggctacaagattaaatatcatgctaacggagttgagaaaccaccaatagagattgatttcacacctcccttcaggtagagacattgggatgtatttggattacatgtattgctctatatgcacttttaactggtaatgttcagttgctacaatgttacttgcccttaccctgctgcagaaagatagacatgattgaagaattagaggctatggctaaactcaatatacctaaagatctctcaagtgatgaagcaaacaagtatttgatagatgcctgtgccaaatatgatgtcaaatgcccacctccccagactacaacacggttgcttgataaggttgtttctttacccactacacattctttttacactgtattttgatatgattttcgttaggtgattttgctatcttataatatcttatttacatatatgataagctagccactttgatatgaagaagaatgtccggtgtaatcctttttgttgcttccataatgtacagtacatttctgaacattttcacattagctcacaaacaaataaaagatctggggtatattgcaaaatccaacctgaagctatttgcttaaatttaatataccttttgcttttgtttcccttttggtattccttagccaaattaataaggtatatgctctgctctaacagctagttggccatttcttggaggagacatgtgtgaatcccacgtttattatcaaccatccagagataatgagtccattggcaaagtggcataggtctcgacctggattgactgagaggtttgagctctttgttaacaagcatg

SEQ ID NO: 33281 - DNA, 2133 bp, Oryza sativa
ttgtaccacatcctacccgattgttttaagccataaagtgacttctacaacttaacacaatacatgttatgatttaccttctaattcgggatgtcgattccatcaggaaccttcatgtaaatatcaaaatcaagtgacccataaagatatgttgtcactacgtccatcaactgcataaatagacgattttgtactgccaatgatattaaatatcggaaagttataccactcataactggagagtatgtttcattggaatcaacgccaggtttttgcgtaaaaccttgtgctacaagccttgcttcatatctcaccacctcgttattttcattccgtttccggacgaaaacccatttgtatcccacaggaaagataccacgaggagtaggcattacagccgagaatacatctcttttgtaaagcgaggctaattctgcatcaattgtgtccttccatttgtgccagccagagtgcttttggcactcttttatagacctaggtcttccgaattcctagtcccagcattgtgcaccaccgagctaggttgcagactatcacgatctgcttgatatatagtatcaatttggtgtgtaccaactaaaggttggtttgcgtttaccgtctttctttgcttattacaattgtttctcgctgagtggccatacttcttcctctttttttagtgagtggaagttgagtggttttatttagtacctccactcattctggcgcattctgagcgggaatgaaagatttagtcacacctttataattggtaaatgcatctagcatgctatttgcaagtctttgcaaatgtataattttctgaactcgaagttcagtttcagtagtacgtgggtctgaggctggaataccctaggcatcccaatcaatttcctggcattctttctggtacttgaagtctccccctaatgccaggaaatgttcctcatcaaagatagagtcagcgaaccgggcagtaaatagatcgcatgttaagggttctaaatactttatgatcgacggagatttgaatcccacatagatccccactttcctgtgtgggcccatagcggtacgctgtggtggtgagatcggtatgtatatagtacaaccgaacttacgcaaatgggacatacttggaggatttccacgtactaactacattggagaagtttcatgatatgcagttggtcgtagttggacaaggtcagcagcgtgtagaactgcatgaccccaacacgacgaaggtaatttgcaattcatcaatactggtcgagcaataagcttaattattttgattaatgattcagccaaaccattttgtgtgtggacatatggagtgctgaacctgaattcccaatgccatacaataatcatcaaaagcatggaatgtaaattcggcagcattgtccatacagattgattgaatcctatgttcagggtaatttgccttcagccttataatttgagacattagtttggcaaagggatggtttcgtatcgatagaagacacatatgagacaatctagtagatgcgtcaatcaaaaccataaagtacctgaacggtccagatctgggcacaatagggccacagatatctccttgaatgtgttcaaggaatttaaatgattcggctctgattttgagataagatggtctcaaaatcagtttccagtagcacatgcagtgcatacgaaatcagaggatttgggaaatttgtcaatgatcaaatgatgaccaatagagttgcgaataatttttctcatcatcccgataccggggtgcccaagtcgatcatgccaagtgtggaatgaatcaacattttgaaaaattactttgtacgcaacatgtgcaatgggcttaatgtatgtatagtacaatcccaatgtgagagatggaattttctcacaaatgcgtttgccatatccgttttgtttggttaagagaagaaattcttctcgattatgcatatgggtttcaatgtgaagcccattttgacggatatctctataacttagtagggtacgggttgaatcaggatacaataaagcatcctcgattgtaatttgtgtacccattgggagtgtaatagttgctcgtcctgaaccaactatcacagtatcgcgccc

SEQ ID NO: 33282 - DNA, 7252 bp, Oryza sativa
ggttgctctctgattcaacaggagcctggtgagaacttgcaacctcagggcgctcttcatgtgtaagattgaagtgggcttcaaatcttgggttcttagaagattttttgtccttgagggatttttagtacaagagaacaagatgtttcgggatgcggcagtctttaccgacatgagtgtcagatccacacctattgcaatgcctgttgccattgctacaaggttgtggtgccttacccttcccttttcctttctttcgacccttgaatttgcgcctgttgttgttgcgtttgcgctttccagtcagattcataggattaatattcaaagaatttcccttgaatcctttcttattctcagcattattctgtacattgaagtgcacctcaggcagtggagcagagcccggggggcgctgttgggcattctttaaagaaagctcatggtgtctttctgcctgagtcaatgtatgtataagcagagaatgtttctggaaattgttagcgcgatactgtttgttgagtcagtatcttgtcttccagaagtatagttgatagagttttctctatcttctctgcctccgttagctcttgttcgcaaaacttcaacctggagcaaatgttatgagtagcatggttgtattctgccacagatttaaagtcctgtaggcgtaaatgaacccactcataattagccttaggccaaatgagttccttttgctgatcataacactcttttagagctttccaaaggttgagagggctcgtctctaacatgtattcatgtttgggatccttgtgaatgtagagcctcaaaagaaaaagggatgtattgagcttcctgtgctcaatttgtgggtccccatcattgggttcctcaattatatttaaaatgccctgagaggcaaaattgatttttatatcggaagcccagatgggatagttagtcccatcgagggcgagttcgtcgaactcttttgttgccatgtcccttcttctttcttcaatttccttagtttcttctatttcttttgcttttctcggaatcaaaagcgatgtagtatctcttcgcttagagcgaagtgctgataacgttgtcacgtcctgataaattcatcccgaaataaaaatcattctctaaaaggaataatagaattaattaaaattcaaaaagaaattggcaaacattaaaatacgtacaagaaaaattcgaatgtggcccggagaatttttgttaaattctccttggtctaaaaggagccctcaaagtttatttgaatttccagagcatcggaaataattattaagcaacaacaacaattatcaaagtttattaaaaagaaaactaaattaaatcctccttcctcctttgggccaagtccggcccaaagcctccctctctctccctcggccagcggccgaagtctctcttccctccctctctttttcctttcccatctctctcttgggccacccctccctcctctcctcctgcctgggcctgccccagcccaagtcgagccgccaccctcccgcgcacgcgtgttgaccgtgcggaccggtgggtcccacccacccggtcgtcgtcctcctcccgcccggctcctccctctcccgtgaaaccctatccgtttcctccctcaaatccacgcgaatcaattcccttcattccaaattgattagggggaattaatcccctttcctttctcttcaattccccctaatttcccccttgaattgcgccctcagtcgcctggaacggccccgccattcccggccaccttccatggccgccggccgccattcccgcctccgttccgccctctcccgtggccggatccctccccgcgcctataaaatggaaccccctctgtgcgttctctcgtttttgcctcttcccgagctcccccgtggccgcaccgcctctccccgccgccctcctctctctcccgtgccgccggccacctccagccgcctccccctcctcacccgtgcacccgtaggctgtgccgtcgccatcctcgacgtcgaagccgcctcctctcccccggcctgccctccgtttcgcgcggtgaccaccggaggcgcgttcccgccggcgtccagtggcgttgccaccactgcaccgtctccggccggctgctgttcgtcgccggtacgccgatcgacgtcgccgtctcctccgtcgacgtcgcagcgtcgtcctctcctctggctgctcctctatttcgccggaacgctgtggcccgtgccggcctctccatcctcctcctcgtcaacgtcgcctccggcagccccttccgccgtgcccgtgcgttggccgacgtcgccgtctcctcctccagcgttgcagcggaaaggtcgaccttggcctcgtctcccctccacccgaaccccgccggtgttcgtcgtcgtggtcgtcctctcatcgttccccggtcgtagtggcgttcgttcctccgtcaagccgtgctgttcgtcgtccgtgtttcgtcaaggttgctgcagccccgtagtcgtcttcgtcctcggctccgcgtcgtcaagcgttgcgccggccgtgtctcgccttcgtccaaggatcgccaccgaagtcgttccctcgccgttcgcctccgtcgtccctgagccgtctccgccgcgcccgttcatcgtcatcgtgccgcgcctcgtcgcgtggtggtaaggatcccccttctcgctgctcccgtcctcgtcctttcggtgtcgtcctgtacccgtcgtgcggttgtcgacctcggtacccttgtacaggtgtcggtagtcattcgtgtgagcgtgtggtgaccctatttgtgttcccgctcggtagctgcgtggtttccacgtgtgcagctcgcgtggtgtctagtggagtccgtttgtcggcaacttgcctcggttgacatacggggtccgcttccgtcgacccgtagaccgtccctgtgtactcggtctactgtggtcccttaggttgacatgtggggtccgcatgtcaacggcgcagccttcttgtcttttccaggctagcgcttacacatgttttatagttgcaaaacttaattataataatccacaaatctccatgtaacagcattaaacttcggatgatcatatcttggtcatatgagctccgaatcgacctgttcaagtcttttaatgtttgttataacctaaagaaccctgtgctttcattttatgtattgttattgcttctttatagggttgtagctttgcttgtgtgcttcgcgtagcttctgtcgttccggaggttcccgaagtgtggttcgcggtcgtcgccgaaggttcggaaggccgttctctctgagcaaggcaagtcgcttcacccttgagcatattgaatcccagtttataaaattattttgatttaaactattgcattaccgctttacttaaattcccgcgttatcactgttttatttagccatacctatttacctttgttatgaccttattatttttgctattgttattattaccttgttcaccctaggataaacaaaaccccaactagtgggtactctattaacggttccactagtatgaatttaggtagatgcttcgctgattaattaggcaacactgggtggttttataactttagactttgggagttctcatatcatttggacactgtggaatggttggcttgtgatggaattgaacacacacctcccccccctctattcaaaactcccaaaatggttttaggctaggctcgaggtgcatggttccgctagtagcacctcggccactataagcaccgatcttcgggcctctgttgcaaagcactaccgtactaaccacatgtctaatgggtaaggcttaactcggtgctcagtctagtccaagcaagagtacacggatggagatggacaaagtcggggctcaatggacatctctagggcaaatgaaggctacacgggctgcggctcggtagtcgagatgtcatggcacagggccggtgtcttgctgctaggggcttaatcttacctacctgtctcgggattccggccgtaggcgaggttgggtcggtgcttttgtcatggctaggatgggtaaaggggttatgtcagatcctttacgacgggttccacggccgtggaatgcagagtaaagatgtgtcttgtgggtaaagatgtacacctctcatcagagtataatctattcgaatagccgcgccctcggttatgggcaagcctagaaatgtacccaagttagtggtttaattcttaaaacttgcttaacaactaaaatgtggaatggttggcccaggtcgggttgccaattcggtctgaatcatcgtaggccttgggttaaggcaggttcgtgagggttcacggccttgattaataatattgtgtagctctaggatcgtgtttacaaaatagctttgagcaactaagtgacttttaaatgctgtttactgcaaaacctaatccccatattattacccccttgtaccccttgcattaatcatgcagcttctggtgtgacttgctgagtactgtggttgtactcattcttgctcaatctttcccccccttcagtaagagaagctttggagaagaagtcttaggtggagtcccggcttataccccagttgagcgcctgtggagatggagccgtaggcccgctagtccgctgttgtttatttttgattgtcaggcctgaagcacctttgtaataatgtaagtattatcgatataataaagatgtgtcttttatatcatgtttgtgtggtgtaccctggcttttcctgggatagggattaatacagtagcattcgggaaaatgcaaattttctcagtcgcgacaaacgtattgtaaataagattgattgtagcgagggagattgagcgagagcgagaattgatggaatgaatcagcggatcctttattgataataatggttacaatatataggggggaaagaggcggcaacagaaggcacgatggtttgggaaccattacgtccgttgctagaatcgccgtgaggcgagaagaggtatggggcacgaccaaccgtcatgtccctaagttggttgctactctatccatatatatggatgagatcacccaaatatttcgtaacaataacaacatggatattcgccaatttataatgtgtttaactcacaagcgcatatgacgatcaaattaattaaacattttatttattccttccattctgaaatttaaggcacattcaactaccagtactgattttctttttataaaatgttattaccttcttttttatcaccataataaatacagtgcacgtatccaattagattaaggccacgttcgagatacatcaaaatggggattaagtaagggcacgtaaaactaaaacaacgttagcgtacgattaattgagttttaattattataattttagtaaatatatttgtttgatattttagagcaacttctagatagaaagttttatatgaaatacaccgtttatcaatttgaaaaaaaagtgctaataaaaaccaagataaaatctacaacttaatcagaaaagaatacggtctagagattgcatttatgcatatttttggaaaaaaaataatttaattgcatgtatgatgcgcatttcgtattacaaaacattgaaaaatatatatcaactagaaaaaatacctgtgcattgcagcaggtaaatactattttaattttattattgttatatggtttagccagagtaaaattcaccgtggaaattcgattggatatttttttcagaaaatcatgagctgcaattaggagtatgtatttcaagcatgcaagttttttcaaaatatttcttatacgactccttttatacttccaaaaggaaacaataaaatctaactcaaacacggatatgtatttccaaaagcgaacgaacttaaaaaccgactcaaatactgatgacgtacgaaaattttgacaaaaacatcttcaataattataataattataatagtagagatatattctggaactgggaaagtactactagattaattattactcttgcgaaatacccgagcatgtctctactgccggtacatatatacaacgtcggatggattttcagtgccctccgtcgccgcatgcattggtaatgggcttccaccccctccgcccttattcacgccctctccccttctattctctctcatgttttcattatatattactacttaggaaccctaatttattataatcttttaaaataaatagctatttttatcgacttatgtcgttggactgatattaactatatttgaacttctaaaataaatattttattttgggttatattctaacttttttcatatcatttaaacaattattaaaataatatgccaaaaaaccaatgatatatattttaccagctgaaaatatttttggtgaattttctttacatctatgattcaaaactgtaggcttttttactattgaaatatcaaccaaatatttttgaaaaattccaaaataatttgagaatgttaatctcacacgtattaaaatttaaattggaccggctttaaaaaaacacaactaaattacatggtttgcattcttacatagttcatattaccgttgtatatctcttaagtaatatttgataccataaagcatatagtatgatgttattatttttgaaaagttgttatggaattaagttgttatcacactactacaagaatacgtctttgcagacggacggcaacgattttcgcatgcggctacgtgaaatcttctgcaaagattgtcatctttgcatacggctagagcaaccacatgcatcccctgtaccaaccgcatgcgaaaatgaattcaacaaaataaaaaaaaacaaaaaagccgaaccctagcacaccgccgcccaatcctgccggcctccaggccgccggattcgtcgccgtcgtcggccaatccgccactccaaaccctagcccaccgctgcccaatccagccggcctccgcgccgccagattcgtcgccgtcgtcggccaatccgctgctccaaccgtcattcgtcgtcatcggcgccggatccgcatggggacgggccgccgccaccggattgacgtcgaggtcgcgccgccgccggatccacgccgaggtcgcgctgccgccgccagatccacgccgtcgtcgcgccgcgggggagggcggggaagtcgacgacgacaacagatggaggtagaggccgcggatcagcgcgggac

SEQ ID NO: 33283 - DNA, 4565 bp, Oryza sativa
catttttccatacaggccacttaagcagccgtatggaaaaatgactctcgatttttgtagacgccactagttatggtccgcatggaaaaatgatggggcctcgtacagaaaaatcacttttgtagtagtgtcatctgccgcaatatattttgtgctgaaatatagccaacataagctattaatgtaaaatcataataaaataaatagtaattacgtatttttattagtaagatgaataattaaacatacgctcaaaagttaataagttaatagaggaaaaaagtaatataaaaatactatagagatatcctaggtaaaaaagaaggggtcgtgaatgggaagagaaaaaaggaatgggatacgtactacctgcttaagtacgtacgtgcgagggaggagtatgtacgtgtactgagggatggaggagtacatgtacatgctgggagaggagaggaagggcaaactactggttttaatcttacctaatggtgcaaaataatgggtctaccagtttaaataaaaattgaaggctagattttcccgtctattaaaatgtcatgtggcggtttatgggcgtttataggggtgcgacgtggcggcttaaaagcgtttggtagaaagtttaatgaacttttagtatataatagatagatagatatattcaatgttagtttttataaaatcaatttattactgtagaagttgctaaatatttttttaaaacttgattaaatttggctggaaaagaatcaaaacgacatttagtatataatatttctacttctaacgacatttagaaactcctcgacaacgtgtgttgtttgtggttttatgtgtgaagtcatgggcgagtagtagaccttgtggagattaaaaggtgccagttggtcgcattgatgatagtcttacattcggttagaggtttgcggatgagttaatttcggtatgggcgacaattgtcctacttgaattttccatgtctaatgaattttgccgaaattttcacatctaagcacatgcaaccttctaattccaaatatgagcaggtaatggatggaattctatttttaatcaagaagcccacatgtgtgtgcagtggtcttccatcgaacttaatgtcaaacgaaatataacaaactaatggctgctgatcattggacaaatcactagctcgtagcgacttgcttaggtctaattgattgtttgtcttcagaaaagaaaatcttattaccatttgcaattggttggatcaaccattacgagatagggcaccgtgccatcatgccgttagtctcgagctttcttcgtcttttttttttcttaatccatatatgacttggatgttgttttctttttgaaaattggaactgtagcggtcggttgaaatataatcatctgcttggatcatcaaaatcataatattatgtgtgctaacaaatcttgatttgtttcacatagaagctgcatcaacaaaaggtaattgtaatactagcgaaacatgttaatggatcatttgctttgtgcctgctagctagtttgattagaaacagaattcaggacaatacatgctcacatttggaattatgaggtcgcatgtgcttagattaaaaaaatctgtgaattttgtcctttcacatcaatataagagtaagtttaataatatagtcaactactagctttaaaaattaaaatattatcaataaccaacctaatagcctacttatataatagttatttgtaaatatgtactgcatcatcaatacttaatccactcatctctcacatggtttattgaagttcgtgctacaactgacatataaatcagtagactacttttattctttctcatttcttctcaaatatttacaatatgatatgccccgcaaaaaaaatacaatatgatatgacaaattatatagcccgtttacaacttattgtattcgctctaacaataagtttattgaactcttcaaaacttgtctcgacgacatctatcatccactaagagagagagagagagagattagaatcctcccttgcccccaaccacacccctaaccattaattataaataattgatgcacctttggaacatatgattacagaacattcggcatgaaatgaattgagaacaattggtaaaatatgtatatatatatagacacacactagcaaaaacgcatgtgagttgcaacaaatagataattttcacaattgataaaaactctgccaatttaaatgataaaccggcacaagacgaagaaaataatggaaaacaaagtaagaatcatatatagtattggacccagttgcgtaagtttcatgcatcatcacatggagaatcccttatatagacatttccatatattaacaaacaatcgggtggctattccctaagttgacgcatgggtattttgctataactcatcgaccaaagattaaaattttcatttttcaattagtgaatttttttttggtacagatggaaagcatttgtaaactaacaacttactgtatacacatcttaagcaatgataattttaaaaggaaaatatttatgagaagagaaattgcaaagggaaaaaatgaggaaaataagaaaaggagaaaataaaggatattggaaggagagatagaggatcaggattatcaggagaaattaaaaagtgaaaatgaaaatgaaaaaaaaagatgagaggaaaaaaaagatgttgatcattggaggaggggaggagtgtgcgagacggggtagtgggatggtgtgacctggttgggttgggttggggcgagccagggttgggctaggagggcatgtataatagttattacaggatcatatcgaattggatgtggttcaggtacaactaacttaaatacggatgacgtatcaaattccggcaaaaatattttcaatttttataatagtagagatagcagaaaattagattatctttttaataatagtacagtgtcataaatttatatatccaactggatgattcccaagacagaagttcaacgtatatatctttactaattaaacaattattaataactttccgttcgtcacttttttcccgcgtacacgctattttttcagccatatactcaaaattttttcgtgagtgtccgctttgctcacgatcccctctacccctacacgtcctttgtccgtctcgccgtgagaaaccgaccgaatcagatgcacgacagtacaagggaagaaagaaggaaaagccaaataattccctaaatttgtaaatcaaattaacctgtatcaattcgggttactataagcctctgggaaacccgaccgtggtgtgggttttcaccgggaagcggcatcaccaccgtcgccatgcgggcctcatcttcgcccgcgcgtgccccggcaccacgcttgcctcctcctctctgacctgccggctttgccttgcgtgcgccgtcttggagccgccaccatcaccgtggtgccaggacaggaaggctcaacttggcaccgccctaagcagcgccacccagccgacgatgttggagacgcacgacggaatcaccttcacccgcacatgccacttcgccggaccgccatctctgccattgtcatcattcactcgctcattgggagagggaaacagtgaagcgaaggggatcgagagagattgaggtagggttagggtttttcccctcccccgatgcttcaacggtgcgggtgcgatctgaaccatccatcagatcggacgattcagctcgccctctcgttgggccgtcgcagttggtggaccgtgcggattgcaagctgtggaagcgcccataggccgcgctcggcgctcgctaccgcttctcaaataaaatggactggcccattttgggccgggttcgggagccctaggccataatttttctttatagaattgttgtcaaattaaatgtttattctttccagaaattcatttaaatgccttcttagctaaataaagttggtgaaaattattttagccaccaagtatacctacttaaaaaatgggagtgtctacagatcatgcaacagattttgatgtcttccatctgtcgaattttttgaccatctgatccagatccaacgaacaacgtttttttgatcaaaatagaaggaaaaaaaataaaaaaaaacacagatcgggccagatatatgcccgtctgactcgatccaaattaaatggaggcccaaacaaaaaagtctaaaattcaagcccaatgtaataaatcaacaaaaaaagcccaaatagatgagcacaatacacgtgacacatgccaggtgacttaattagaaaacttggcacccaagaagaaagtgtcacgtgatctggagataaaaagcaaaaagcaaattcaacatagggggaatcaaaatctgaagtcagaagaaaaaagatggagattaacgagaaaattgacgatagagaagcaaatttacagtacgcacagaatggaatcacaagtttgagcgatttggagaagggaaaaggtgaagagcaggaaaaatcaacaggtaagtgcaccttttgattcctcctttgaaatatctt

SEQ ID NO: 33284 - DNA, 9782 bp, Oryza sativa
cacattgtagacagtgcctctctcgaaacttttgaattcctgttaaatgaacatcacagtatcagaacagaagagaaaattttaggaggataaacagaatcattacaattttaggaggataaacagaatctcttgggtagaacatcagcaaattcatgcaactcataaacacatctcattcaaaaattttacatgaataaggaaacttaaatcactgccacaagtaattctctccactgtcatgaaagcaagtcatctcaaactttcagaaaattaaaattcaccagcaataaacatgattgtaaaaaaatcagtgtgaactattcagtttgtaattaaaactattcagtgtgaacagaacactaaagcatgtcatgtcaaaatttcatgtcaaaatttcattacagaacactaaagcatttcatgtcaaactttcattgtttaaaaaattcattgcctactatttcattttgaaattaaaacaagtgaaattcaatgtagttcatgtccttttgtactaagaaacagaacaagtaaatacatcaaaaaattcagtccaccagaaattgttgtcaatctggcaacattttgtattcatgttgttaatgagctgatgtacttcaatgttcaaaaacaaatcaatccagattcaaacaattccattacaaaccaaagcttagacaaacaaaaactttgaaatataaaaactacagtgaatttgtaccataattacatagaaaaaaaactgtaatttcaatattgaaatcatgtaactgacattgtagatcatatagatcaggagaatcaaaatcattaaaaaaaagacataaatacaaaagtggccatcagataagtaaaaaaacaccccaattctctacacatcatatggacaagaattttaatcattattttaacttagcatgattaattttcttgcctgatgatgtgcagaaaattgatttgcttaatcaaaaaaatatttatcatcatctggccaaaaaaaattcattaagggtaatgcttctattttcaggaacaaaagagaagaaattgaaaatatcaaatgtcctaaagatggcggatgaaaagcaattcgaagcagggaaaacatcaagtggtaaatgcattactctgtattattcatgtttagttctgttttttttttgcactaatcttctataaaattactttttttgtattgaaacagattaggcaaaaaatcacagggtctgaagataatgaagcaattagcaggtatattatgctaaattttataatattatctatttatcaaattaacaatagacgagagaaaaattatgtatctgatcttaataataaacttttgcaggaaaaattgaagctggaactagtactaattctgttaattcaaaatcaggtttgcaaaagaagtccaaaactttatactaatattacttgaaccacaaaagattcatatagaaaattaaaaaaaagacataaaaacaaaagtggccatcagataagtaaaaaaacaccccaattctctacacatcatatggacaagaattttaatcattattttaacttagcatgattaattttcttgcctgatgacgtgcagaaaattgatttgcttaatcaaaaaaatatttatcatcatctggccaaaaaaaattcattaagggtaatgcttctattttcaggaacaaaagagaagaaattgaaaatatcaaatgtcctaaagatggcggatgaaaagcaattcgaagcagggaaaacatcaagtggtaaatgcattactctgtattattcatgtttagttctgttttttttttgcactaatcttctataaaattactttttttgtattgaaacagattaggcaaaaaatcacagggtctgaagataatgaagcaattagcaggtatattatgctaaattttataatattatctatttatcaaattaaacaataggacgagagaaaaattatgtatctgatcttaataataaacttttgcaggaaaaattgaagctggaactagtactaattctgttaattcaaaatcaggtttgcaaaagaagtccaaaactttatactaatattacttgaaccacaaaagattcatatagaaaaatgaaaaaatggcataaaaacaaatgtggccatcagataagtaaaaagaacacctcaattctctgcacatcatcaggacaagaattttaatcattcttttaacttagcatgattaattttcttgcctgatgacgtgcagaaaattgatttgcttaataaaaaaaatatttatcatcatctggcaaaaaaaaaattcatgaagaggaatgcttctatctacaggaacagaagagaagattttgaaaatatcaaatgatctaaagaaggctgatgaaaagcaattacaagaagtaaagacatcgagaggtaagtgtgttactgtgtaaatttcatattaagtacttttttttgcactaatcttgataaaaaaaataacaaattttggtttcgaaaggttttgaaacagataccgacaaaaaagcacagggatttaagacaatgaagcaattaccaggtaattataagaataattagaagaataactaaaagtaaaaaattatgcttctaatttgttttataatcttttgcaggaattttcaaagatggaacttgtactgctttggttcaatcaaattcaggtatacaaaaagaagtccattaaattcaaattatttttttagaaaaaaaattcatagaaagagtttaactggattctaacaaatgtgagtctttcattttaaacaggtctagcattcctagagaagaagtacaacacaactcaatcatataaaatgcaagaaaacagagacaacataaaatcagctaattaatgaatatgttacaagcactcaatgtcacgcccagaaattcactagtaatttccgaacttatttgtgcataaaatcctcgtccaggaatcagccgaggtacacaaactgacaatttaatatataaatccatcataataataacattacatacttacaaaagaaaagaaaatagcagcggaataacagtatagcgatagcttcagctccactcccacaggcagctcaactggggtataagccaaacgtcttctccttcgcaacttgtcttcaactgaggtttgattgattattgcaaggtgagcatatgacatactcagcaagccacacagcaaatatgcaagtacacaaggataccaaaggatggcataatatagggctcatttgcaaaagcagcatttagcaaacatttgagaattgtaaaacaatagagtaattaatcatcaatattaatcaatactgaacagcacacccatgctgcacaggcccaaccattctgaagcaaccatacccggctgcacagatctatctccaaaccaggaatataccattccaaaccaggagctaatcaaattattaccagttatagcatcatttattatggttaaagtgtgagactaatcacgaaagacattgttagacccgcccatgaccgggggcacggctattcgaatagttttattctggccagaggtgtaccactgtactcacaagacacaacccaccagcatgttaccgtgtccgcgcagacacgtcaccatgttgagtgattgtgacaagacccctcgcataactcaactcaaagcagtgcacctttcccggatcatagtcacccccttataaacaaggcatggactccccagcgacccccgtgggcttatctccgccacttctcagtctggtgctccgcaatgagccttgttatacaaagtgtccagtcgttgcccattctggcttgtggttggcacggttaatgtttcacaaccgaaaatcgtgaaccggtccttaattgtcatcagcacgaccatcaaaaccatgtgctcacaacccaccattatcaagttttagttggcacattaattaattaaccaatcacgattgaccatcgtgagctacaattaaatatccatcattaagtaatagtgaaacattagttatcccaatggtgtgctaatgtttctaagcatggctaagcaattatgtctaacatttagctgaaccaatatatataaagctcaactagtcaaattataatatcccaaggtatctaggaatagagtaatcaatgcaaacaggccataacaaaggaatagattcacaccacccagtgacattcgaaaataaatgcacagttgaaataaatagagaatttaaatataggatcaacatgctcaacggaacggtgtttgggatctgtgtgacttgccttgcaataaagggtcttcaattaatcttcttaacacttccggcgcactcgcgaactttcgaaacgacagaaacgacaagctaacacgcaaaacgagaaaaaagactaataaaaaccaaataaacaatacataaaaagtaaacaaacatgtagatcataattttagatgaattatgagacgtgaacggcctcattctgacttcaaatgaatttattacgaattttacaagattaaatctaattaaagcccatttaaaaaggattaaataaatttaattcaatttatggataattttaatatgtaggtctttattttatacaacttttgcaacttgaaccacattaaactgagttacaaagaattagttatgaatttttaaagattaaaccggattaaagcatttatatggattttaattgaattttgacgcaataatgaattatttttgaaaaggaaaagggaattattgcgtcatctgctagggttcgcggtggaccgggtgcacggcggcggttcacaagattggacggctgggattcatccatccaaaacggacggccaagatccatcggtccacgaccggaccacggcagacggcaacaatgacgtcggcgacgaggaaaagcggcggcgacgatcgggtcaacggcggcgacggtgctccggcggtcgacagcgacggcgaagaggcggacgaggacggcaacgagacggcgatcacgacggcggcctccccgagcagtgacgacgacccaagcgacggcggcgcacggctggagcggcggcggcgacgacggcgcgaggcagcacggcgctagagctctaccggcgacgagaggctaaggcgagggtggtggcgggtagaggggagctcgggggtcaatttataggggctagagagcggcggcgaaggcccacggcgaccggcgacgggaaggaaggtttagggttcggaggagagaaatcgatccgaatcgatctcaaatccggcgatttccaaagcgatttagacgatgtttccaaaagggaaaaggtagagaagatctcgggaaacatttctcctcaaacgatttcaccggagaaggaaaggcgcggccgaatttggaatggcggtggcggcgcagctcggctagggtttcggcgagaggaagacgacgactgacgggtgggacccacctgtcagcggcggtcgcacgcacgcacgggcggctcggcttgggccgacttgggccgagggagagagagagagcggtttgggccggctttcggcccaaaaccaaaagggacttttaaaaacctttttccatttaagttattcatgaaatgcaattccatttattaaaaatacttccttggctcaaatgaatcccagaaaaatctaggaactatagaaacaagagaagtatttaacaaaattttatctagcctacttttatattgagatttaacaaattaaaattagatcttctctctaggcttttaagatcatttctaataattcccttttagacaacaatttataaattaaggatttttaaacaagaaaagcacttaacataattatatgattaaataattactgaactgttctttgtatcatttaggaattgagctctgaaaaatccgagaaaatttcagagagtataattaatcatggagaatttaataaaaattaaatccatccatgctttaaatttaggaaattttatttcccacatttaacttcacttgtaaattaatgaacatttaatataaattctattaataatttattagataatttataaatcctaaaacgaaaatctggctgtgacactcaatcatattttcatcaaaattgtaaatgttatacaactatggattgacaacaattttcttttaaaaaaaacagggaacaggggcacttatcagatataggaagttagattgagaagaagaacacaaccaatcagacaggtaaatataaataaatgtataaaattgtttgacaactttcatactgcattaactattttgtgaaacaaatttaatagtttatatgattgaaaacaggtttagcattgcttgaggagaattacaatacacattacaaaaacaggtaagggaaaaattatgaagcaacttgcaggtatgagtaatagtaaaacaaaaaaaatcagatattttcctcatatttattttcaggtaacagtaaaaacttctcagaaacagaagctaaacttgacaagaccaaaaattcagaagcagacattggatgtagtgctttgaatgaatcagagaaaagtaaaaaatttgcagcaatatttatattatttttaagagaatttttttgattaattaaaaattacactaacctataatactggtatcaaatattgcaggtattatagaaaacaatgacaaaggaactataagttgtatgaatatgcaagaaattaattcaggtaaaaagttgaaaaaattcaatcatagttcttcagtaaaaataaacaagaaaaatcatcaatctagttgttcaactacgttaattttagaattgtagaatagcactatttctttcatataatttcttttatgattagaattttcaaaatttctgcagaaaatggagctaacaatgcaaaggttgattatgaaaacaatgttctatctctgttggaccaagactacattgcagtaagtttttggactttgacaaccttaagtttgatataatttcttttattttctttgacaatcaagactacattgatattttgttttttttttatcaaacaggattcatttatatcatacactagtctaatggaacatattatttcatcacaaccaaaacgttgcaatgaattgaaggtaaatttttttttgaaaacaaaagtattgatttgttgttcatttatgtattcatgtgttcaattaagtatagtttttttgaaaatctttcaaaaactgtttaattaaggttgaaggaacacaaaatgataaaataaagactggaattggacaagattatcaaaaggttgatgaaagtttgaattcacacgttgaatatcaatcagaacaaagatgctcgatggatattttaaatttgcaagaatctgtgcaggtatgtaattgctgtataatattttttaaaaaaagtactaaaacttctgtctattaaatttaaaaaatgagaaacctttaatttattttttttttgcattttgttttttcacaggataaaagtttagagcaaacaagtgaaattggttacagcaatgttgacaatcagtcacaacatgcatggtcactagatattttcaatttgcaagaatcagttcaggtatgaacttcttacaaatataagtttttctataaaatgaaaagtaaaacattattctaaataaatgtgaaaaaagttttatattttgtttaaatcttgtgacaggaaccaattttagaacaatcaagtgatattggtaacatcaatggtaatggtgttgatgatgctgttatgaatgatgaattgctaactgaggaagatattgaacaatttttagaagaagaacaacaagaagcattgaaagggaataacgcaaacatagatagaaagtacatacctgaattagatcagaagttcaaatcgattattgaggcacagaactatttcaacttctatacatacatggctggattttcaattgtcaatgttcatagtgctagaactacaagtaagaaaagaaatagagaagttattagagtgacattcaagtgctacaaatatgtcaaagcagattgcaatacaaagccagaaacagtagatgagactgctactggagagagaaaaacaaatgaagttattggaacagagtgcaaatgtgttatggtaatctcataaagaaatttggaatgggttataacaaggttagatttggatcataatcatgagctgagccctccagacgaagtcagatttctaaggtcacacaagtatttatcaacagaagagtgggtgcttattcgaactttgaaagaatgtcacattcccacaaggaacatgatagttattctgtcagttcttagaggtggtttaacttcattgccttacactaagaaggatatcagcaatgtcagaacagaaatcaacagagaaacaagcagcaatgatatgatccagtgtttgacatatctgaagaaaaaacaagaagaaaatccaaatttcttttatgaatttgatttggatgaaaataggaaagtgagaaatttcttttggacagatggtagatctagagattggtatcacaaatttggtgattgtataagttttgacactacttttttgaccaacagatataacctaccatttgcaccttttgtgggagtttctggtcatggaaatacaatattgtttggttgtgcatttttacatgatgagacaacagagacttttgaatggttgttcacaacatttctgaaatgtatgaatgggaagcaaccaaagacaataattacagaccaagatggtgctatgagagcagctatcaaaaatattttcagagaagctaagcatcgaaattgttttttccatataatttcaaaagctttgaaaagatctggatccttattcaaaaagaggcaaggtctttatgcaatatacagtgatatcatacataactgtttgagtgaagaggaatttgaggttctttggcaggatatgattcaagaattccatctgcaatagataaattttctagcacaatgtggcatatcagaaaaaggtttattccagtatatttcaaaatagatttatgtcctttcattcaatcaacagcattaagtgaaggaactaactcaagattcaagaaaaatgttggcccccaatatagcatcagaagtttcttgacagaatatgaaagggttatggatactattcaaaatttagaacagcatgaccatcatgaatcaagaacaaaaaggccgactagtttttggtcaaactactccattgagtaccaagcagtgaaattatataacaacaaaatattcaaaagatttcaggctcaactcaggaagacatttgaattacaagttgaagagattgaaaagttcaagtgttatgcagtgtttgaggcagaaaatgtgatcagcaagcaaatcagaaagagaaaataccttgtgatgatggacttggatacagaagaatacacatgtatttgtgcaatgttccagaaagatggcatactatgctctcatatattgaagattatgcttcaccttagcatcaaagaaataccggagaaatacatcatgcatagatggagaaagaatcataaatcaacagaaataattaaagggaaggaaatcatacctgtttcagaatcatcagttcttagatttaatatcctgtcaaggaaatttgctgaaattgcatcaaaaggtgcgaaaacagttaaagcatacaaattcttgatggaagaatcagaaaag

SEQ ID NO: 33285 - DNA, 9425 bp, Oryza sativa
aaaaaaaaaactggaaatgtatttaccaagtgaatacaaaaaatgagaaagctgtaaaaataataattaaaattgaacataacaaaaaaaaagtaaccttcaaattgcagtcaacagatactttctttttattcaacttcagcttcaaagatcgcaatagctcctcttttgatatctcatcacaactagttttagagtcctaaaaaaaatagtgaaaattaatcatgtaattagaaaacacaataaaaaacacatataagtctcttgcttcattgtacaaaaaaaaaggaaaaaaaattaagccagaaatactcacttcactatcagaaataacatcatcattttcagaacttttagaatcagaacaagtagaatcaacaaaaatttcatcactatcctttgcgtgaaccatctattaaaaaaaagaaatgtgattacacaatgggaatagcaaacaaaagcaggagcaaatattttaaataatgctaaagtaatcaaattacatataacaagagactgcaaaagtacttggacaaaagtaacctatgtaacataattgttcaaacattaatccacagaaaaaaaaagtctgcatatagaataatgttttcagttactgaaaaagatgaaactatgttattaagtgcattgctggaggatagcaccaaatgcattacatgaaccttatatagctggataaactcacactcacacagccccccccccctcaaaataaacactgtaaggactcaacaaacacaggaaatgaaataggtatagtactattggatcaaatattacaaatgaaacctaaatagaatagaggaaatatagttagaacagattgaagtaatgaaaaaacttaaattaacttcaaaataaaactactacagattaaatcatttcatttaattatcatttgtctttgtcatttcctgaatcatggtacatgcatgaatgtgagcttatagtttatagttaactaataaaaagaggtgcaaccacatatcaacccatcatttcattaagcatgttcagcagagatataatgccagctccacttgagatgacaaaaggttccaatccaaaacaaaaacacattaaatcatcaatttaagtgacaactgatgtcacgaaggaaagtgaggatgaactttcatcagtgcacacacagacacttcatctaaggtgaattaaaaattcggtacagctatgtcttatggtgcttccaatgaacacaaatcatataaccacactcacttaggatcacacaaatcattcttagattcaaactatatatttgcaaaactacagatctgagcatccaaacaaaaaaccaaaacaaaagtaaatcagtctagggcattggtaaacagatctacatgagaaatcaaactctattaaatccagttaaaaacaacttcagatcacacatagtgttctacataatttagtacattcattttcagatctacaccacatcaagttcagacaaataactaaccttaactgaatccaccagatcgaagcttcaaacacctaagagaacacgaccctgcacaacatgagaaaattaaacaacatgatctaatcgcacatgaacaacatcacatcgttgatgaaagccaaataacacaatctccaaagtaaaaaacataagcacacacaaaatactactactcatccaaaaaaacgagatcccaaaaatcccctcctcataaacatgaacaaatcccttcctcatcaaaagcaaaaacaatccactcctcctcaacagcaaacaaccacccacctctccccccaattaacagcaaaaatcccccactcatcaacagaaaaaaatccactcaaaacctcaacagcagcaacaacccttcccaccgccccacccacctctcccccccaatcaacagcaaaaatcccacacacatcaaacagtaacaatgccccactcatcagtagaaaaaaatccactcaaaacctcaacagcaacaacaacccttcccaccccccacccacctctcccccccccaatcaacagagaaaatcccccacacatcaaacagcaacaatatcccactcatcaacagcaaaaaaatccactcaaaactcatcaacagcaaacccaaaccaaaacgaaaaaactcatcaacgcatgcagttgagcagattcaggtgatgctcgaaggggaatggaggaagaatggacgaatctaccaacgaatcgccctcacgtcgagctactcaccaacgaatcgccctcacgtcgctccgccagaatcgccgccgcggtgaaatggccttctgttgacgacgacgaaatcgtcgccgctctctgctctcctctcctaaaagcgttctctctctctctctctatgtcggaagaaatgagaaaattcagtaaatgtgggacccacagaagagacaagaaaaaagcaggcgcggatttcaaaattgaacagttgctgtgggacccacgaggaatcaataaaaaggccagcccaatagataaaaaagatcggtagcccaaacagagaagtccatcccacaacccaattattgcacgaatcttaaacatgatggacggcccaaaaaacgaaagatggagcccagcaaaatctgtcgacagaagagtagccaatccgttaaaaaataggtaagactttcgggactattttttgtccgtcgtcgttcgtaatccgcatcacgcttcatcctggtggccgctatctcatgcttaattagcacgtaccaccgtttatgaatttgaaaatcttattatgtttttcttctagcataacaagtcacgtcgcatacatttttattaggagatgtatcagatggttttgtgttccatgactttgtgtaatcgggggtgagcatgatacgacgcggtagcaagccttatgagcaaagatcataattcacaacatagagaatccattatatgcccctgactttactctagttcaatgatttgccatcttcctctataatatgccaccgactttgataattttttctacaatataccagaatggatacttttcaaaaatacctaaaatgcccttcaagacacacaaggattgccgattgattggctcattataagttttgaaaaaatatgaaagttttagtgtagccttcttatacgatataaagtttctgtacatatttcaagatttttttttcaaaaatatttttatgtggtatatgaaagatgaatcacatacacaaaacatagctacattagaaaaataattttgtgtagcatatgaaagatgatttacataaacgaactcaacgctagagtatttattagcatatgaaacataaactatattttcaaaaaaattaatacatgcaaattgaaaatcttaaaatccacacacacttcatattatgtgtggggactatgtaaaaagttttatatgtttgcaatacttctagtaggtaaattaattgtcaaccctctatggcttgaagcacactttaggcatttttaaaaaagtatccaccccagtgacatattgtaaaaaaattatcaaagtcggtggcctattatagagagataaagtcaatgacgccaaatcgtttaactggagtaaactcaggagtatagaatagattctcttgtaatatataatatataagatatcacggttccaaatgagtatcagtttcccataccaactcgcgggcatctttttctatataacaaaaggaagagattggagggccaaaacacagtacacacatcatcagagagtcctactgtacacacaagaccataaacgctacggatactaatacataaatccccacaacattattgtactacaggcaggatgacacacggccggtgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctacatcttcacaggcgctcaactggggtataagccaggactccacctaggacttcttcttcaaagcttctcttactgaagggggggagattgagcaagaatgagtacaaccatagtactcagcaagtcccaccgggagatgcatgattaatgcgagggagtacaaggggtaataatataggggattaggttttgcagtaaacagcatttaaaagacacttagttgcccaaagccattttataaagacgatcctagagctacatagtgttattaatcaaggccgtgaaccctcacgaacctgccttaacccaaggcctacgatgattcagaccgaactggcaacccgaccctaggtcccagctcgtcccaagccaacccaggccaaccattccacattttagttgttaagcaggttttaagaattaaaaaactaacttggtacattgctaggcttgcccataaccgagggcgcggctattcgaatagattatactctgatcagaggtgtacatctttacccacaagacacatcttcctcatgtgtaaccacgtgccacataccaccacggcatacggatgaaagacgtgacatagttcctaacccatcctagccataaacaagagtaccgacccaaccccacctacggccggaaccttcgggacaggcaggcaggattgagcccctagcagcaggacaccagccctgtgccatgacatctccactaccgggccgcagctcgtgtagccttcatttgtcctagagatgtccatcgacccccaacttcgtccatctccatccgtgtacttttgtttataaccagactgagtcacaaactaagccttacccactagacatgtggaagtacggtagtgctttgcaacagaggcccgagcttaatccttatagtacccgaggtacgactaacaaaacccaaccatgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaataaatcagcgaagcatctacctaaattcatactagtggaaccatgaatagagtacccactagttggggttttattttcctagggtgaacaaggtaataataacaataacaacaatgataaggtcataacaaagataaataggcatggctaaataaaatagtgataacggggaatttaaataaagcgataatgcattaatttaaatcaaaataattttataaactggaattcaatatgctcaaggatgatgtgacttgccttgctcagagacaacggccttccgaaccttcggcgacgaccacgaaccacgcttcgggaacctccggaacgacagaagctacgcgaagcacacaagcaaagctacaagcctataaagaagcaataacaatacataaaaagaaagcacgcggttctttaggttataacaaacattaggagacttgaacggatcggttcggagctcgtatgaccaagacatggtcatccgaagtttaatgctgttatatggagatttgcggattattataattaggttttacaactataaaacatgtgcaagcgctagcctggaaaagacaggaaggctgcgctgttgacatgcggaccccacatgtcaacctaagggaccacggcagaccgggtacacagagacggtccacgggtcgacggaagcggatcccgtgtgtcaaccgaggcgagtggccgacaaacggactccactagacaccacacggcctgcacacgtggaaaccatgcggctaccgagcgggcacactaacacggtcaccacacacacaagcgaacgactaccgacaccggtacacgggtaccggggtcgacaaccgcacaacgggcatgggcgacaccgaaaggacgaggacgggggcagcgagaggacggatccttaccaccatgcgacgaggcgtgggaacgacaacgacgaacgggcgcggcggaggcggccgggaacgacggaggcgaacggcgagggagcgacttcggcggcgatctttggacgaaggcgagacgcggccggcacaaggcttggcaacgcggaggcgaggacgaagacgacgacggggctgcggcacttgagggagtgaggacgacgaacgagaacggcttgacggagggacgaacgccacgacgaccgggaacgacgagaggacgacgaccggaaccggcgaggaggcaacaagggcagccggcagtgctgcacggagacgaggacggcgtggaatgcgccgctgcgatgacgacgagggtggtggcgcagcgagacgacgagccggcgaggaggaacgatgacgacgacgacgaacaccggcggggttcggtcgaaggggaggcgaggccgaggacgaccttgccgctgcgatgccgaaggaggagatggcgacgttggacggcgcacgggcacggcggaagggactgccggaggagacgtcgatgaggaggaaggagaggtcggcgcggcggcggcggtgttccggcgaatccgagggcaggccggggtggagggcgaatccgcgacgtcgacgaaggagacggcgacgtcggccgacgctctggcgcggcgactggggctactgaaggcggtacagtggcggcaacgccactattttgtcggtgaggacgcgtctccggtggtttccccgcgaaacggagggctgaccgggggagagaaggcggctgcgaggccgctggtggcgacggcgcgaccggacggcgctcgggcgaggagggagaggtggctggaggcggccggcgtgggggaaagagaagggcgacggcggggaggggttatacgaccacggggaggctcgggatgaggctaaaacgatagaacggaggatgaggattccattttataggggaggagagggagccgggcatgggagagggcggaacggcgacgggaaacacggccggcggccatggaaggcggccgggaatggcgcggccgttccgggcgattgggggcgccattccagggggaaaacgggggaaatcaaagaggaatcaatggggactaattccccctatttaattttggaatcccatgattaaatcgcacggatttaagggaggaaaggagctagggttcacgggagagggaggaggccgtgcgggaggaggaagacgaccggcgcgtgggccccacgcggtcagcgcgtgcagtcagcgcgcgtgcacgcggctggctcggctcggcctggggggcgcggcttgggccgggcggccggcccaggaggagaggagggagaggaggcccgggagagagaggggaggggagggagctgggccgaggggaaggagggagggcggcccaagagagagagggggaaggaaaaagagagggaggagggaaggactttggccgcgggccgagagagagagggaggcgacttggcccaaaggaggaaggaggatttatttttagttttctttttaataaactttgataaaggttgttgttgcttaataaatattttcggtgctctgaaaattcaagtaaaatttgagggctccttttagaccaaggagaatttaacaaaaattctccggaccacattcgaatttttcttgtatgtattttagtgtttgctaattttttttcgaattttaattaattctattattccttttagggaataatttttatttcggaatgaatttaccagtacgtgacagccagcgccgtgtgggtgaccagcgagatacagttcccatcgagcacacactgcacacctgtatcgtatatgcaataaattcagcgcaccatcgttttatatccagtcttgatctagccagttggctatggtgatgtttgaatattaagctgaaggtaagattaagtgttacatgtaaaacgaggtaataataacgtatgattaattgagttttaattattataaacttaaaaaattaattaatttgataatttagagcaactttcatatagaaagttttcgcacgaaacttaccctttagcagtttgaaaagcgttccacgagtatccaaaatttcatccaacaagagaaacgaacgcagatttagattactataaacggattattacagcatattatgtatgtaataaaaaaataaattaaattcatcgcaaaaaataaaaataaattaaatattctaataaataaatcttgaatattttaaaacaaacagtgtacgtataaagaaaggttttttgagagagcctgtttgctgaaaaatagagaaatttattaatttcagtaatataggattaataatatgaaaagacgtatttaattttcacttggtcgatctctatgacacgagtacacgactgcgctcatatgcctatatattaactgagagcacacccacaagagaacggtactttgtggtggtgataacatggcagcgtcgccgctgccgaggtgggctccgacgccgagcccgacgaggccactgagaacgccaggaaccccgagcgccggcgccggcgccgcctcgtcgtcatcgtcatcgtcatcgtcgtggcgcagctgtgtgccgttactcaccaccttcagttccgtcttcggatcatcagctgcgcggcgcggtggtggtctctccggcggggagccaccgccggcgctgccccacgccggtcgccatgacatcgtcggcggcattgcgcctctcgacggcgtggaagccgccgtcgaacggcgccggaaggacgagatgatgatgagcgccacgacggcgtgtagccgtggggtgttcctgacgtgggacgatctgtccgtgacggcgccggcagctgccgccggctgcggcggccacggccgccgcgccgtgatactcgacgggctcagcggctacgcgcgccccggcgaggtgctggctctcatggggccttccggctgtggcaagactaccctgcttgacgccttagctggtaattactgataacttacttctaaagcaacttttattcaacagtcatatataaacctaaataacttgtgtgttcattaaaaaaaagtaaacttgttttcttcacatgctgtgttaattgatgcgccgagtattatgcatgggccgatatactgttggatgtgtgtccatgtttgtgcatgcgctatgtcttgtatatattccgtggattattatagactagataatctatattcatgtaggagtgacaattaattggaatgggcaagtggacaaaaacaaatttaattaaagaaaaacaaaaacaatgcacaaatgtaccaagcaatgcatctgaccgttggatta

SEQ ID NO: 33286 - DNA, 7874 bp, Oryza sativa
ccccttccacccgcccacacttaactcattaatgcactgacttttcttcttaattaatacaattgatttgtgtctcctttgtggttaatccaacattttatgttttaaattaaaatatttcaattatcacttaattaaattgaaagttgtatttgcaattttctgaaaataccaacacaaatttgattctgcaaactacgtacaacacgtacgaccatatcaagtactggggtacaatacattatggtttatagcacttgttatatatagtatctgccaaaaggtcccccatcgggtcgtacaaaagtgatcttgacgatatcgacagttgatgattaattaatccctccttccaaaagtgtaagattaacttttttttttcgtccaagaccctgtttagatgggactaaaacttttaattccctactatcacattaaatgtttggacactaattataaatattaaacgtagactattaataaaacacatccataatcttggactaattcgcgtgacgaatctattgagtctaattaatccatgattagcctatgtgatgttacagtaaacattctctaattatgaattaattaggcttaaaaaatttgtctcgcaaattagctttcatttatgtaattagttttgtaagtagtatatatttaatactctaaattagtgtctaaatacaaagactaaagctaagtacctgaatctaaacaccacctaagactttggaggaattaactaatccacatgtaaaaaacccaaaaataatacgcaaagatgtaactaatgggtattaagatgcttactttatttcgataaacaatatatttaatttagcacaagactaacaatataactctatctcacttcgaaaagcaaaaaataaaatatacttaacacttttggatgaagggagtaatacactgcacaaacacagcagaggctgtaatatgtgtgagaaatttgccatgcatgtgacatcgttactttgtagcatgagttttaaatttagaatatttattttaaacatttcagtacgtgcagctcacagattgctgaaatagataatatatggagacaaatatattgtattcttgaaaggttgttgtcacggttaaatgcaaaaaagctaccgtgcgatcggtcgtgcgcggcgatcaggctccctcctcacattgctcccttttttttttaccatattacctattttagtaaggttatacacctaaagtttctatactcaaaatttatatacctaaagtatacacacctaaaatttgtatacctaacatctatatatctaaagtttacacaaaaaagtgtatatacctaaagtttacacatttaaagtttatatgttgaaagtttaaatatccgatcaagattatggattttgactcaaattaatgtttgacatataaatgttttatgcgatttattttagtttgtaattttatcgctgggcccacatggagcggcaaccacgtagcagggaagacgcgtagagattggaggcaagcggagcgatcgtgtgcgtgggcttttttctgttttaccatttcctgattgtgcatgcgtccatcccacaatcactcgcgtatcaggaggacctggttatatgcacgttctttattttcctgaaaactactttctaaaatgccacgcatgcccaagacgcgtgccgtgcgtttgagtagacttgacattcttctggctacctttggtatcgtattgtagctgatgcctggttgaactatcgtgctatgatcaattcaccatcttaactaatttcgttgtcactaccggagaactgatctttgctccaatgaaagatctttagtcctagttgataacatcaacccatactaaaaattgatctttagtctcagttgatgataccaacccggactaaagatattttttagtcccggttaatgttattaacccagacaaaagatgtctccatggttagtttaaaaagaaagcatctctacccaagtcagatgtgtgtagtaggaggcatggtaacgcgcgtgagggttgagataagagatcttaaattcgaatcccacatcccccatattttttttttgacttggtatgcatctttagtctcgtttatttcaatcgagactaaagatggattgtgcgtcctagttgcacaaccgagactaaaaatggttgcaaaccgggactaaagtccctttctccggcattgtgtgttcattaattagttagctgtgaagttaatttaggtgcatatatacagtaaaaataatatgatcagactttgtcattttctgtcttaaaattttttatgcataagtggtccaggctagatatagtaattgtaagtactatgcttgttcaagggagagaggacaatattcaattggattactgttggaggcatgtaggattgctatcaacgaaccgtttcaatgttaagctgttatggatagctatatagttaagagtattgtctggacaagataataatagtacctattttggcgtaattaagtacattttgaggttggtacgtatggaaatatacatatttccaacaatatcgatgtagctgtctagctacaatctaattataagctttaagttcagtaaacagtggccaatcaacttagtcttattctatattctgattttttcattacacaaaaaagaattataaaattttactactacacatactccctctcatattaacacaagggcaggaaacagcaatccatgttcaacatccgcgtgagcatacgagaagaccatgcatgcagccatgctcggtatctgatcaaatacgggtttcagaagtacgtatggcatgcatagaacaagagggactgtccatacttgccaatcactccacaggctgcaggctacagcgcgcctgcacgagatggatggagcctccgggctgcagctatctcctctccttttcccagtttgtgagtagtgatgttgtattgtgcaaaaactttcaagctttcacgctgcagttactacaaacggggaaaaggaaatatttgtttatatacataagcgctactcagaaagagtattgttttagttttaaaattgtttctcagaaagtgtgtttttgggtgaggtctactaattgacatgtttaatacttcatatcctttttcttctcgttttaaccatcgaaccagtacgttgtactccctgaacccaacataaccaaaacacacacaaatttttttgaataaaaaacacatacaaaattaaaaggattatgtatgcagacttaattagtataattgagtatcagcatcaacgaattaatgttgtaagcattaacactaattaaatatttggaccacttcctcttttgctttttgaaatgtggccaaggttaccaccaagtgtttagatttggcatatcagatgagaaacttcagatccttaaaatacatttcatttcatatagatgactgttacgtgcaggttactttctgggttgttgattaatttaatgcttgccctcctagtagattagacattttaacacgtatctatatatatgttacaggaagattaattaaacagcccatgcatatatataaacacgataatgcatctgattaattagtcatcactcatttgcacagggaggctgagccccaacatgaaaatgagaggagacatcctgatcaatggcctgcgagagaaactttcgtttggaacatccgtacgttttcacataaaatgcgatctcgaatgatttgaaacagtgtgatcttgacttgacacatgttcgtacatgcgttaatgaaggcctacgtgacccaagaaaacgtgctgatggcgacgctcacggtgacggaggccgtccactactcggcgcagctgcagctgccggactcgatgccggcggaagacaagcgggcccgcgccgaccgcgccatccgccagatggggctcggcgcggtcgccggcgtccggatcggcggccgggtgtgcaagggcatcagcggcgggcagcggaagcgggtgagcatctgcgtcgagctgctggcgtcgcccgcgctgctgttcctcgacgagccgacgagcgggctcgacagcgcggcgtcgtaccacgtcatgagccgcatcgccggcctcgccaggagggacgggatgacggtcgtcgccgccgtgcaccagcccagcacggagatgttcgagctcttccatggcctctgcctcctggccactgggaggacggtgtattttggagcagcttcagatgcaatcgaggtaacagtttgacatgtgcgactaacagtaataccgacatcaaggacctcatgagctagggatgcaagtagtcaatccctaaaaaaaatctgcttactaattcacttatcgtatggttatataaagtttgaaagaaaaaataactagaagtgagataagcggataagcgagcaaatcttgctaccaggcgattccattttcatcaccctaaccccatctcttagtgttttatgattgatatgccttagtaatttatataccactaaaagtattggaatgctaaaaaaatacctcccgaaatatatatagtactttatatgcatcaaattaaattgtaatatctgtctatagacgctagcctctgcagaggctagggcgactctttaagactatctatatatactatggacgtgactacacagctagtggtagctagctagtccatctataagagaccctatctacctatactttaaataaaattttctcttaaactactcatccgatctatgatctgattacaccgttgtgtttgtaacaattaaatctttataacaagatcccacatgattatattttgatgaaaaattataaattacttttatggtatatctaaattacttctagattttactaaattacttcttagacatataaaggtaaattcaataaagcctaaaggtaatttacataaattatagaagtaacttataacaaaaagaaagtaattaactttaatgcatgttttttttcattggtatgactacacagctagtcatagttggtttatactccatctagtgtcgcccttaaacttgtaaaatgaaatagtatatatcttttttttaatctctttaataacttatatcttttaaatcacatattgtttttaagatctatttgcatcactgtactccactcaaaatatgtgacgaaacgatattcatattgagtatattcaaacattttgttaatttaaaagtaatttattacatgctagaaagtaacttttatgttatcaagaagtaactattgcatcttatacatggttaattctcattagttatttcatcaatgttatttacaatccatcaaagattttatctttttttctcatgctacatgaaaaacaaaaatgaaagaaaaaaaacaatcggtgattaaacatatttatagagagttacttctgaaccatgcaaaagttactttcaattaacattgaagttacttttaaaaattgttcaacttacgtgtgttgatttgtactaattaaataaagttttgtagataaagtcatatttttatccctacaacgaatttacttctaatgtcgtgacaaagtcacttctgttttgttttaagttacttttataatatatgtaaattacttttagactttactgaatttacttttatatgtctaagaagtaatttagtcaaatccaaaagtaacttatatatatgataaaaataacttacgtatataataaaagtaatttacaaatataaatattttttattgtaatataatcatgtaagatcttgttgtgaagatttaattataacgaacacaatggtataatcggattgtagatcggataagtaatttgagagaaaactttatttaaaaacgaaaaagacatacatggctattaaaaaaaaggcatgcatgtagtagactttctcttttttttccctccactactccttcggtgcttcctgctacgtgggcgtatcagcctgcctgtagccaagtactagtggagaaagcgataacgttagccgaagatgagatggccggaggtgcgtcgcgcgattagactaaaccgagagcgcgcactgtttagattttatgatatactatctatttgtcaattggctaattttatcttatctatcaatcttagttttcaattcggtcaaatgttgaaagttctctatgatctatatatatacataaataaaaacacatctagattcattaaactaatacaaaaataaagcaaggaacaagttgcaggccatctgtgacgaccgataaatgagaaaggtataataacttatcattaaatgtctcttcaatccttttcgaaaagaaagaggacagtccttgttataaaccaattaccactctcaatggaagttgggagttagaactccttaaaggcatcgatatcgttaccttttttgacaactgatagtacaagtctgcactgcaatcaaacatacatattataaaattaatttgccaagtgctcatacaaatataatgttaaagttctttacaatatatacgatatatagttacacatataaatatctgtaatgcaaccttttttgaaaattttattaacacatatagccgctccttttacgatgtaaaaccgacttaaatttatcagttctatataatttcagtttttttgacggaatatagtttcagttttagttagctcaatccgaggaatttcaagaaaggaagaccaggttttaagtgcgcatgggttatacagtcttggaagccatatttcaattcagccctatattctgaattattcctagtattatcttcttggggcacgtaatgaagcttgaaataaaaaaaatattactccctccgttttaggttataagatgtttttgactttggtcaaaatttatagaaaacaatagtaatattttcgatctaagataaatttattataaaaatatatttaattattaattcaataaaactaatttggtaatgtaaatattactatatttatctataaacttgctcgaacttaaagcagtttaactttgaccaaagtcaaaatattttataacctgaaacagagggagtagttgctatcatattttttgcaaaaaaaaaaaaaaaaaaaaaaaaaaacagttccagtccatttgaacctatttatacacatttagagaaaaagaagaatggctttgaacctatttatacacatttagagaaaaagaagaatggcattgtcattgaattttgtcgcctatttacaataaacaataaaaggccagaaaaattttggatgtgacacatagattaatttagcgccttcgcacactaaccttgtttgctgggaagagcaaaagtgaaaaaggagtggcttgcaccatccagctgccattgatttcaagaagaaaacttaaaatgcaaattttattagtctcgtattaaaaaaattggattcgtaatcttgatatgccaacaataaattattagtaatacatagctgggttaattgaattgatggtttatataattgttatactaacagcacacccctatttggcatccgaagaaggtagacaaaattacaaattaagacacattcaataaatttgttgcgctatggtccacttttgcataatcaaacatttatattaattaaattggctttctggactagaataaataatttttatcatgtaatctttgtttcctatgaacaggatgtcgcatcttaatatatactcctatataatctcgctcaaaaagaataaatgagaagggggaagtatttcattgtccatatttatatggctttcatcgaatcgcgtggtgctt

SEQ ID NO: 33287 - DNA, 659 bp, Oryza sativa
atttcaaatggaaaagtcatcaaaaacaaagttgtatgactcatcaagatctacaacttttgttttggtcactgttccatatgatgttgtttgaatagtttgaatttgattttcaaaatatgacaatttcaaacaacattttcagatactaaatgatttcaactgaaaaagtcatcagcaataaatttgtataactcatcaagatctataacttttattttggtcatttctttgtccaacaaagttattcgtaagattgttcacataataaacatctcttatatagtttttataaaactatataagagatgtacattttgtgaacaatcttacaaatcactttatcgaatgaagaaatgaccaaaatagaagttatagatcttgatgagttatacaactttgttattgataactttttcagataaaatcatttattgcttcaaaatattatttgaagttttgaaattcaaatttttaactgataaaacaaagtcacaagaaaaaatagccaaaataataccagtaagaacacaataacattatagaacatgattttagaaacatttagggaaaaaaatcatccaatttggagttagatgcactagtttcaaatttttcaaattttattttcgcatacggcttcttaagtggctagtatg

SEQ ID NO: 33288 - DNA, 1646 bp, Oryza sativa
atctttgttgtatctaactgcttctagaccagacatacaatttgctgtgtgtttgtgtgcgcgctttcaagcttctcctcgtgcttcacattgtcaagcggtcaagcgaataatgaggtatttgaatcatacacttgagtttggaatttggtattctacttcatcttctatatgcttaactggatattccaatactgattttggggttgtagaattgataggaaaagtactagtggaacatgtcattttcttggtacatcattgattgcatggtcttctaggaaacaatctagtgttgctcaatcaactgctaaatctgaatatgttgctgctgctagttgttgttcacagattatttggtttttatctactttgaaagattattgtcttacttttgagaaagtacctctcttttgtgataataatagtgctattaacattgctaagaatcctgttcaacactcacgcacaaagcacattgatattcgctttcattttttgagggatcatattgagaagggagatgttgaattgcagtttttggacacaaagttgcaacttgctgatattttcactaaacctttggattctaattgctttgtttttcttcatggtgaattgggaatatttcatccttttggcatgatttgagggggagttttgcacctcatggttttatcaagcaaaaatatgataatgagaaaaattgagaaaagagagctttgtgttatacatatggtattttcttgtgcatgctagcgatactttgaaggtttatttgtctctagcatagcttgtatgtatactagtcttttcatgagatttagattttgcttttaaggaagatgatgcatgacacttaaattctatacttgaattaagtaaatatgaaatgttgatgctagcatgtggtttgatttctaaatgctctctatatatatgctttattgaattgttattcctcaaatagctttagttgctcattgtgaaaagagaataaaaatatgaaaaaaatgaataccgaatccttggaaacagtcttgacgacaaggacgtattcgatgtgagcaaaataatgggtgccgcatccctgaaaacagtatcgacgacagggacgtacccggaataaaagagaaaaaattgagcaaaaaggctcaagacaaagaaaaagtaaaaaattctcttggttgttttgtgctaaaggttatttgagaaagagtgattaatgcaataggtatatgtgtttagtttttattcttcaacctatgtgtttgttaaggtgttgcattataaatcgtatgaaatcatgaattttgattgttgattcaagcttaattgtaaaatctttggttcatggttatactttcatgcatgcttgctatattatagatgggttcatcttctttttattgcaacacatgacatgatatgctatatgtaggctaagctcatctacattaatgaacataattcctatgcttgatgaaatcattgtcaaaagggggagacgcaaggtgaaattttttggagaagtaaatgagttgaaaagtgagcatgttgtttttggttcgattgggaacttctttcttttcaaaagtgagagaagctttcttttggacttttgagcatgatgtgtacgtttgtac

SEQ ID NO: 33289 - DNA, 3705 bp, Oryza sativa
tgtgtgcgtatgggatgcggagtcgaatttggaaggagtccaaatttggtatgagtgggtatgcaaagtttgtttcttttactagagagtttcctaaggtgtttaggatttctagtatgagtttggtttgtggctttaggctgcctacctcagggtataaatagagggggagcgtgagacttctcggtatcgcttttaagagcaattgagctgatagttgagtcagggtttcgagtttcctcgagatttttgtgaggactgctgttggtgcactttgtaaacatagagagaatcaataaagtcgtcatccacttcaagagttcttcgatttgtgtttcaccgggtttcggtggtctaaccagcgacacaccggcggtcagaccggcggcatcgcggccgttaggccggcgggcgcaaggcggttagaccggcggtggcaacaggggcgacaggcgattccagggcggtccgaccgagagatcaacaccggtcagaccgacggcataggcacgatcagaccggcagatcaatcttggtcagactgatctccatcgaatttgagggtaacttttatttccgctaaaagttttggtttttggttataccaaccattcacccccctctggttggcttagttgttgtgtttcgatcctacagatgctggtcatgccttttgtctggtcttttctattgctttttttctgtaaaacgacttatgtgtatcctatttggctttcgttctgaaagctaggtattataatacctgtcataaaaaaaagaggaggaagagatcaacagcgacgaagtagtcaaaattaatggcaatgtagcttaattagtaaatcttcagaataggtatcccctttcatgtatggtgttaacaacaaaatttagtaatccaagtatcggagatagagatagatcgaagcagaatccaaacatagacgttgttccgggaacagagcgagaatcggctaaaagtccgaatcggctacgatcaggatcggcagagttcgagtcgggcaaggttggccgattgagccgataccgacaatgtggcgtgatacacattgtcgggttgagttaatgtattgcatgagagttgccatgcatggattgagtcctgagacgacaattgtatctattaattaggttattttatgtaatttccttagagatattttgggcaaaaatctgccgcaaagacttatggtatcttagagtttgttagagataagtgtcgtgtccgacacggatatattttgtaatcttgggtataaatagaccccgagccccatgtaatacaacaacacacgttcaatacaatctcggcgcatcgccacccttttactttcgttttgtttcgacgagttcttgctttcgggttgagctgcatcggtttcgatcttcaactagaggtaaaacttgttatggcggcttgcgttctcgggattagtgcttacatctttatgatactctaatcttatttatgtaattcgtcgagttatcatatattctgtataatctttgataatatcgctatctaaccttcaatcggctaacatctattattagaaggcagccgattaggttaaatatccatgttgacctagattatacagggtatctaccactctatgaaacaagttttattgtctagatattatccttctttttatacttatagtagcatcagttgagtttgatcttataagtcgtgattagaatctcaatctctagcctgcttttggttgccgactagggtagcatcggggtttcagctgatcttacctaatttagccttatattctatgtgcttgattgatatgctagatctgccctttatgttaaagatcttattacaacagagtatattaggcttttgtttaatatatttttcctgctttaatatcttaatatagagtggtatcggagtattagtcgatacatgctagatctatttgatcggctatgctataaacatctataatctcattgttagtatatattttgatctaagtgatttaaactgtctcggcatgacgatcaatctatcccaatcacttgatttaagtatatatcgatataaggattatatattgttgatatctacaaccgatcaagtagatttagttcattcttatttattcatgattgccgatcgatttacatatgacatcggctccaagataaatgatatgtcatcggtggctggccaatcggctatcatttatggatttaaccgcggtttctttgtctttatttcttgttgattgcaggatcaaatcaactggtacgctcacgaacctaaaggcaagatttttagacctgcactgaagttaagcagatctacatatggccatgatcgaattcagttcaggagttcaggtctccactctccaggatatgccacaattgcaggaataatttggtaccttagctgaaccagtgtctgaaccgtggagatttcccatggttcatcatacaccctccgtcctattataagtgcaattatgagttttcgtgcccaattttgattgtacgtcttattaatttttttataattagtatttttactgttatgaaataataaaataagaataatactttatgcgcgacttatgtttttaatatttttttcaaaaatttttcaaataagacggacgatcaaaattgggtatggaaaatcgtggctacacttaaaatgggacggagggagtatttcacatcacgcacaacatgttctcatcaccacgacaagttagcagaacagacagatcaaattgttcccaattacctctccatggaaacagagcatatgcccaccataatatcctggtctccggtatcatccgcgctcatctttgcactttcaattcctgaattttatttgctctttgattagctgactctgtaatataagtggctgtagtttcttggaagcaaaggcctgatattattccattatctgaaaaatatgagatacgctgcacaagcttcccggcatttgagttcaaatctgtgggccaagcatgttgactgggccagatggttcctctggcccaatagtttatataccacataaatgggccgatttcttcactgctgctgtgctcctttctcccgatgaatttaattgggccaaggttattctatgcagggaataagttcaccggaggtcccttaacttaacagcgagattttttcaggtcccttaaccacaaaaccagaaatctccacccctaaactatataaaactgttcactcaaggtccctagtgagtggtttcgctgacgtggcatcctagtcagcaaaaaaaattaaaaaaattatgtgggacccacatgtcagcggcacatatttttttttcttctcttttcttctcctcttctcttttctctcttccctcttctcttctttggttagggaggccggcggccagcgagcggagctgcgatgggcgagcacggcagcgggcccgcacggcagcggagcgtcggcgggcggagcgcgcggcggcgggcttcgggcagagcggtggttcctgcggcgctaaattggggacggtggggtctgcggccgcgaccgcggcaattcgtgaggcggcggaaaccatggcttctccggatccctcctccaccgtcgtcgaggtgctccacggcatgaccatccggatcgagctctccaaccacaagaccggattga

SEQ ID NO: 33290 - DNA, 5995 bp, Oryza sativa
gccgcgctcctcctccatctagccattgtcgtcggacgcaggaactgccgtggtcacggcggaggagggattcggagaggccatggttgccgctgccgcaggaactgcggtggtcatggccgcagagcccaccgtccgccccgcagcccggtgccgctccgcccgccgcgctcgcccgtcgccgctctgctgccgttctcgcccgccgcccgcccatcgccggccgctggcctccctgaccaaagaagagaagagagaagaaagaagagagaagaaaaggacaagaaaagagatgaaaaaaatatgtcccgctgacatatgggccccacgtactttttaaatttttttttgttgtctaagatgtcacgtcagcgaaaccacccatatatactgcctaggggctttaagtgaacggttttgtatagtttaggagtggagatttctggtttcgtggttaagggatcttaaaaaatcttgctgttaagttgagggacctccggtgaacttattccttctatgcagtctgctgcctgggcaggccaaggttactctagacttccattcagttcaaactaccaacacaatgctcctccctgactgctcaaattctctccttgaaagaacagccacaacacattctggagcttgagaaattgttagaggaacaggctgttttgactcagcctgagctcaacttgtctccagagtattgaagggcaggaccaagcgtacctcggcatctagtaacaacttctgtgctacatgccaaagagaggaagataaaaaagatcccgatttaggtggggtttgaatctcctaaagatgtaaagatgatgaagataaagattaagtgttttatgtataacgaggtagtaataacgtgtgattaattgagttttaattattacaaacttgacaaatggattaatctgatattttagaacaattttcatatagaaagttttcgcacgaaacacatcgtttagcagtttgaaaagcgtgccactttaatccaaaatttaatccactcatttcagtggattcgaacaggaaacattttgactacaagaagagcacttgtttggcctgtaatgcaattcctccggtgttaaatgagaaagttgatcacccaccttagacaaagtgtgataacttttctcggttagtgatggcaaagtgtgactaggaaccaatatgtcatctctaatacacatattccaatactactaatattttcacaccttttttatgtttgtatagagcttctcccttgcataagagatgtggctcatgtttctctcctctatctcatcacctaatcttatgtgacactcttaggtcccattcgtttctgctcaagtggcgtagctgaatgtggaaaaaaaattaaaacattagcgcatgattagtcaagtattaacaatgacaaacttacaagtaaatttatttgatttttaaagaaaattttaaataaaatgtttcttaagaatacaccgttcaccatcttgaaaattgtgttcatgtaaaaagagagagtagccccgacgaatgaaggacaagtaatctgcacaagacaaagaaggggcaagaaaaagatgtcacatgtgcatttgttgttcgacgttctcagtttgttattgtacgtatacaactcatcttttagtatgagaatttcttattaaagtcattgctgcaaagcatcataatgcataacatgattgttgaggatgaaggatattcttacggtgataacttcaattgtgagtcaggcatttctcctatagcatagcctacattaaattcatatagagtttttgaaaagctcacttcctattttcttttgagaaaatttattgattttagttattattacaaatattttttcttcacaaatttataagtccctctcaatcaaagaagaaagtttactaatgtcatcaaacacacaaaccaattatgataattattatattttttgactttcaatattacacattaattacaaaaagtctttcaaaaatgtttaatagtgtccaatagaacaattgtgaataggcttacctgcttaagtccattggcgacttcaaccgcggctctcaaatctctagccatgtggagacaaagggaattgctcggatcgagctccaagaactagctggaatcctggtaacaatggcgatgtcgcacagtggtcactagtgaaacgtagatgaacggagaaaggaatagataaataccgaacaaggcaatattgcataggtgatctctaatcaagacaggtgaaccgggaaaggaatagataactgctgaacaagttggagaagactccgcatcggacgtccgatattccaccaaatatcggacgctgcgcgtcatcacaccaccaacatgcaaaaaaaagaaatcagttagtcaaatgtttcaattaactaacgagtgaaacatcaagttatttagtgtgaaataaaaaatcagtaactgaaacatttaaaaagtttatgaaatatgatgaagatacacgttgaaacatatcgctatcacatatgaaacaaccaatattaatggattgaaacatatgtttttttcatcaaaatataatcatgtgatatcttgttgtaaagatttaattacaaagaatacaacagtgtgatcggatcgtagattggataattagtttaggagaaaaaatattttgaaacttgttaaaatgcatgcatgcatgtatggatgaggtggagagagagtagtgcagttagttttggaaattttgtgaaacatgttgaagacatattgaaacatatcgctattacgtatgaaacaaagaatgttaacagatcgaaacatatgactattctttattagaatataatcatgtgacattttgttgtaaaggttcaataacaacgaatacaatggtgtgatcgaattgtatattggataagtaatttaggagaaaaatcgttttgtatattattaaatgaatgcatgcaagtagtatggagtgcagagacaagagagagagaagcaacaggtatgcagtagcaagtcactggcaaaaggtggtatgcagcgcatgtgctgatgtgtagtcacgagtgttagagaagttagtcaagagccattcgatttttatgtttggatcggacggccgataaaaagtattttcggaacaagtttaaggctttgttcggcaggatgggttcccaacccatctcctcgtgttctgcgcgcacgcttttcaaactattaaacgttattttttttacaaaaagtttttatacgaaagttactttaaaaaaatcatattgatccattattgaaaaagaaattagcaaatacttaattaatcacatgctaatggattgctctattttccgtgcgctggagatatgttcccaactgcatgcagcgaacacagcctaagaccacaatgacacacatgtgatttcaagaatggggtacgaagttagccacctattgctcaatataaataatgaaatttctatgaaagtaaagtgaatatggtgtagaataaactattgaaattacaaagtattagaaaaataaaattttaattgttggggatttttttggggtgaggaaggggatattatgtctttatcgtgcatgaacatatagaaaaatgtcatgttcaaacaatgtacaaagaaataattgaagtattttgatgattcatgatatttcttaatttgttttgcatagaatcagttgttaacttgtaatattaaaggattaacacacgttttataatcccatggacacataattagcagaagacaaaattttgaaggttccacaaactaattttttttttgccaattctgaatccacgaacaaataaattgtacttccttcgtttcacaatatctccgtttcacaatctaagccattttagcatttcttacatttatattgatgttaatgaatctagatggatatatatgactaaattcattaacaacaatatgaatgtgaaaaatactaaaatgacttagattgtgcaacggagagagtaccaattttgaaaatctacgacatggagtcacaattagcatatgcatttatttgttcgttggtggttgtcaggccattcggattatatttcggaatattggtgccgattgaagggagaccagatgagaggaaacttaaatcaccgtaggcggctgcggctgaagaggaagtcaatggaagcaggcaagcagcgcccactctcccaggttgtggggcttgtggcggcgtccgacgaccgatggaggcctagagctccgcctccgatctccaaccgaacagcgatttcgcctagatcgattgtgttctttaggacttccaagaaagaaccactggaccatacttcgtgcctccgatggagatgatcagatgtggtgagatgaagcagatcagagctcggaccatcaatggcggtggcgtcctcctgagcgttttgggtcgagggttcgttggcggcgcgcgggcgtggacggcttgacgcagacgcaggctccgtttccgtggtccgcgccgcgttgagtctgacgcagacgcaattggattgccaatagaggaaagagagtggattggcctggtctacgtctgcgtctgcgtcgattggattgcctatagaggaaagagaggaaagagagtggattggcctggtctggtgcatgggttttgttactagggagggcagtgcgtctaggctgatgggcttagcccctgcgggaaagaaaacgaaaaggtacaccgaaggtccctcgacttgtcgtcgagatacaaaatcgtccttgaaccacaaaaccggatacaacacatcccccaacttataaaacttatgcaaattagatccctcggcggttttggctccagttttgaccgacgtggcagctaactcagcgtaagacccacgtgggccccacatgtcaatctatccacatcatctctctccttcccatgtctctcccttcctcctctctgtccagtctaggcagctagccggtgggcgcgaggcgggagggaatgaggttggcggcggcgatgcaggagaaggggaggcggaggaggaggttggtgtggatgccgtaggtgagtgctggcaggtagagggcaaagaggcgtgcgacgttagcggccgttgcgtccgaggccgtcttcgcgtcgcggacgtcttcaccgtggatggcgccatgccacaccgggctccaccgcgactcatgtagaggagcacatcgcggttgggcaccgccatggcctcccttgtctcctcgcccatagggtctgcagcggcgagcacagcgtccgtgacgcggcgtgccctgtcgaagtccccccagtcgacgatgcagcgaggagggagttggtcggccgacacgctgtcatcgccgccctagccgccgttgtccttcctgcccttgctcatccgtgagggctgtccccaatgagccgcctctctgactgtcctcccccgtccccacgccatgcttcccgccgttccagctcccgacaacagcagtgcctgcgctccccttctcctccaccactgccgtgcgccggtgccatgacgctctcctccccttctcccgcgtcgccgctgcccgacctctccctccttaccccgccagtctcttccccacccgccgggcctcatctaccacgtgcgcccccaccgccgccgcgtctccacggcgcggctcgtcaggactacccgccacacggccgcaacggtcccggagcaggagacccacgtcatcatcgtgtgcacggccgcggagcccctggtagtcgtcgttcgcgcggtcgctccaccactcgccgcccacgtgaccgcggccttggcgtcactcgttgccgtcgtcgtgagcgcggctgcagcgcccctcgtcgctaacatcctccgcgtagaagccgcgcaccttcacgccgtagcacgcgcagccgcgccggacctcatcgcggtcgcctgctagggcgcccacca

SEQ ID NO: 33291 - DNA, 3189 bp, Oryza sativa
ggcctccggtcgcatccggccacatccagacgctgcgcctgcgcgaacctccacgctagctgccatggaaagcagcggcatcgagggagagaaacaagttaaaaataaaagaaaaaaaaggggaacggggagagacagcgtcgatggcgctgcagctcaccgggcaccgcagagcaggtccgccgccgccgcctatccctcaccagcccaccacagggtcacgccgccgccgcaaggctgcaaggctgcgccccaccatcgtcgcaaggagagaagagagagaaggaacggagagaagaaggaaaagagatgggtgatgacgtggacagactgacatgtgggtcccacgctgagtcaactgtcacgtcggtcaaaaccggggtcaaaacagccgagggacctagtttacactggttttgtcagttgagggatgcgttgtatccggttttgtagttcaaggacgattttgtatctcgatgacaagtttagggaccttcggtgtacttttcccgaaagaaaaggagagaatatgggcttaggcccatccaatctgaggggaacagtagtagagtgaagagaagaaaaggaattaggctgagaaggattcggccaagcgagatttagagcttagcattaatttctatttttttaaattacacaatacaacgtaggtattgttaaaaaaactttgtggtgaagtttattttattaaattaaggactactcccttcatttttatttagatgatgtttgttaattacttcaatctttttttttttacaaaatagaggtagcactatttcatttaaagaaataaacctgacctttatttatgctagtagatttacgttgaatcctccgccaatggatccacaccacattcgggaatgtgatgccctccttctcttgctcaggcgaaaagatggcgacccaatcagttagggttcgcggttgaggtcagatggaatgggaagagtgggtataggaggtgaggggggaaaattaactttccgggcttagcgaaatagcagcgtgcgagcgacagcataacgatgaattgaagctgtgtagccggcggtgaaaggtgggccagtgttaacaacgagaacaaagtaaaagagattaggagctgtcggaattaatagctagaccttagcccattcgaagattaattctttagaaaatcataaaagcccaccttatgagatggcatggatgggaaatttagtacaccttgactattctagatagtaaaggaagatctccttataagggaggatgctctcctagccacttgaggcatgtgaggtggagagaagagggggaacatgcgcatagttgctcgcctggcatggcatggcgtggcggtgcgtgcatgacatatgcaattgtccgccaaaattggtttctcacccttgcgcagatgcagtcttcttttgcagttttgttttgctgcggtaaattcggatttgattgttttggaaacactcctaataatccgatgcataaaatggcgtagagtctggataaattacgcgcgacttatcaggtttggttacgcggagtggagatcgtgcaggtgtcttgatatttctatataagttgagccgccgcctccacgcaacacacgcggaatcaatctagggcttgcctcctcctctatattgcgtcgtcgctcatagtctactctgaataatccggtgcataaaacggcgtggagtctggataagttgagcgtgacttatctagttcgattacgtggagtggagatcatgcaggcgtcctgatatttctatataagttgagtcactgcctccacggaatacaggtgaaatcaatctaaggtttgcctcccctctgtattacgtcgtcgctcgtagtctactccatcccgctcatcggcatgcactggcgatcgggagagcaggtctctggaacattcgtcttcgatgtcctgcaccgggagaaggtgacaataaggtttttggaagcgcttcgcgcgactgctccctcttcgcttgcgtgctgtgcgccatcatcaacgcccgcaaccgcgagtacttcctaccagtggcggacctagaaaaattgcactgggtgtgcccattctagcgatcacttcactatatattttttaaaaagaaaacacccaattatgatggaagaattttggcagattttggtccgatttttcaaaattctattcaaatttggtccataatttatgaaaaatctataaaattcagaactatcaaccccatatcgtaatctatctagctgttcttttttccccattgtttctcgtttctcttcatgtccttccctcttcccctgatttgatttgttgacgattacaagatgacaaactgtgatcattgttatattctattttctgagagtagagtattctatttttaattctgtcctttgattgcatatacatcctagtgttttcccaaaagaaattgggtatgccggtgccaacccggcacacccctaggtccgcccatgctttctgcagagaaaccggtcttctgttatccttggtacgtgttcaacatgttgtatatattcgatttattcatgctttactgtctagtttacatgtgtagattttatgatgcgtttatgctagtttacatctacaatgtcataatttatttataaaataaattaaatcattatgtgcttataaatttaacgggagcaagggtgtacgcagaagacatggtgaggcggattgttacgttctcttttatggtagttttgccctcgatgacttttactaaaaatgcacgcaaaacgccgcaacttcagttacatatatacattttcgttcggttactctcgatgaacacagtataggcgagcaccatatctggtgattctgctcgcgagccggccccagcgtacagcatagcacttgcatgccgtcgtcacgtagccatggcaatggcgcaagccgcgcaaccgtccgagctagcgttaccgtcacgtattcttttttgaaaaaagaacaattagaatgtgccaattttattgaatatacactggtggagaagtgctttttagtcccggttcgtaacccccctgtagtcccggttttcaaaccgggactaccaatccgggactaaagatcgttatctttagtcccggttcaaatacccggaactaaagatcggttggtgt

SEQ ID NO: 33292 - DNA, 27545 bp, Oryza sativa
agatttagaaccgggactaaagatcatttttagtcccggttggtaacaccaaccgggactaaagatcaaatatatccgctgtagccaccaaccgggactaaagatcatttttagtcccggtttttagtggaaccgagactattgtggatttcgggcgaccgaccaaagacggtttctccaccagtgatagtatatactgccttacctaaaatataatatgtaaaacatgtatactagtattatgaatctgtacatgcttcgattagtaatactaagatactccctccgtttcaaaatataaaaatttttagaataattttaagtcaaacatttttcactttaactattaatagggaaacataaaaaagattgatctatgagaatgatgttgatgtatttatcactaaacaaactattataatatgttactccatttatttgaaataacttattttataaatatttttcagtcaaagtattatttcgaagaccatatatatcaccgtcaaaaacacttatattccgatatggatgtagtattatctttagagaaaacaattctaaactttcgaggggatatcctcttgttgtctccatgtcactcaaatagttatgaaaaaaattaaaaaaatattaagaatatgtattaacatgtgatatattactagatcgactccacaaactgcatgttcaaattaaacttctacatattgcaatgaaaaaaaaaattaaaaatcaaatttatttattttttgttgtgacatgtagaagttggacttgtatgtttgtggtgatatattacatgtaacacatcttcttaaattttttttcataactatttaaatgacatgcagagagatattccctcgagagtttagaatccattcccttatttttgtatgcttcccgaatcttttacaatttggtcctttttaaaaacttatttcacaaataggcctctggaaaaacttatcccagaaatggtcatttttagggtgccaaagtcagtgacatcatggtccaatgggactaggatggggctagcatatctggcgccgtctccctgccactgtggcggaccagcgctggcgtggaagggggagcgtgccaatgatgctaccccccacccacaatgctatcttttttttccttggtgcgctccccccgagggtcacacccatcccccgcgccctccctacgcgagcccgagcgccgctgctcttgctctctctctctccctcttctcaaatccacgcaagatttatcggtaagagactttctgttttcagtgtttttatttttcctatagtcagaaagttaccaaaacaatattagattacatttccttaatcctataaaccctttagcatttttttactagcattgctttgttagtgtttgttgagtttttttgttacattcgagtgacctttcttaaaacaaatacagaaaaaggcaaattatatatttacaaatatctacataaaaagttacatctgattctcccccatttcgcccgggtttggtgaaattagaatctcgaaattctgcttgcaagattgtgttttcaaggcgagaagttttttgatagagctttgaaaaattctacaggtcacatttcattcgtttgagtttaatttttctatgtttggttcttgtgtgctcctaaatgtgaaaaagtataaaataaaataaaagaaaattatcattggcgcgcttcccctgccacgtcagcgccggccagccacgatggcagggggacggtgcaagagatgatgtcaccgtcctattggaccacggcgccaatgactatgacgtccaaaaagaaccatttctagtacggtgtaagtttttttaggggtttatttgttaaacaagtttttgaaaaggacgaaagtgtaaaacatccaggacggctaccgcctccgtactgttcgtcgccgcagacaatactctgacacgccggcaggcggcggcagacagcttgtactagggtgcacagtgaacaggggcccatcgatcgatcgattaatcaatcgagagctagctacgctagggagaaggcatgcagcaacattgattaatcacaggtgattattacccgggctagctggtaggctggctgggctgagacgctgagatgagacgagatgagaggtgaggtgtggtgctgagctgagcactttgatggcaatcacaggcggcaatccgagacgtcgcttttttacctcccattaatcccatgcatgcagccgatccgagccccagcgcatgatcctcctcctctccctcacacacacatgagacgccattcaattcctcttccctcccccgcacgaaaccctcctccaccatcgatctccctcctcttcttcttatatgcacgcggcgtcacggccacccctccctgtccacctaatcacacccagaccaacctagagctagcgcgccatcacggagctagccagcttagaccccctgcagctagccagctagctagctagctacagttgttgttgttgtacggtgtgccatggcgccggcggccggggacgacgcggtggtgccgcgaaagggagctggaggtggggggacgacgacgccgccgccgccgccaccggcgcagcagcagcagcagcagccgctcccgccgccgccgccgcaggagcaggggttgcggtgcccgcggtgcgactcgccgaacaccaagttctgctactacaacaactacagcctcagccagccgcgccacttctgcaagacgtgccggaggtactggaccaagggcggcgcgctccgcaacgtcccagtcggcggcggctgccgcaagaacaagcgatcccgctccgcggcggcggcatcgcgcctctcgctcaacctgccgacggtggagggtatcggcggtgcagcggccgaccccgctgcggcggctgctgccaggctggggtttcttggcggtggaacaacgatgatgatgtcgtcgtcgacgtcgccgctcggtggcgccgccgccgcggtggccgacttccagcagggcggcgccgtcgggatgctgccgctgccgcggctccaatcccccgccggcggcggcgtcgggcatcatcagtacgtgccgttcggggagtggccctcgggggacattgccggcggcaacgcggtgaacggcggcggcggccacggcgcggtgagcagcaccatcgcgtcgtccatcgagtcgctcagcttcatcaaccaggacctgcactggaagctgcagcagcagaggctcgccaccatgttcctcggcccgccgggctccgcctccgccgccgccgccgccgcccaggccaacgacggtggcggcaacggcgcccaagccacagcgtcagggcatgctgccggaggaggcggtggcgccttcatgcacatggctggtagtgttcccagcatggaggcggccatgccgtcggcgacgtcgtggttcatggacagctgctcctacgggctcccttccccaccgccgcctgccactgccgccgtggccgccaccaccagcagtaacctcaacagcggcggccggagtagcggcggcgatgataacgccacctccaactgcggcagcgcgatcccggcgtggggcgacatctcgacgttcgcgatgctgccctaggccggcgatggaggtgtggatgggttcaaattaacagctgattccgaaggaattgagcttagctgcagggctaattcattactagtaatttaactagttattgtgtctagctaactgggttgagatattaatcaattaactgattatattattactatatgtggtatagtatttgtcataacattctgacatcaaagtccgtgtatcatgtcatggtctttgttttcttagttctgtttctttttcacttttgttgcgtccatgctagctttgttgtgaaatcccatgcatgtggatccattttgttccacctaggttgttcctacctttttactttactttttttttttaatttacatgtaagcaagctaaacatcaatgatggattaaagtgttatagtatgatttatgtagtattttgtttttttgtaattaaatgctaatagtttgcttaattgacattgttgaagtacattgtataataaataatctcgtttcatgcaactgttttcagcattttttctttgatgagttgatctcttaatctaacttgcaagcaataacgctatccaccgcccgatgacctgggtggctgcccaggatcatcggtaaacacttagcacacagttcgatttgccatgttaaatttcttggccttgccactgggtgggacagaacgattatattgggtatcatattttgtctaacattataaatcgccatgattgttctacgaaaatcaacttttcggagtgaaacaatatatttgctaatttaaaacaaattacaaaaacaaaaaacacgacgattcagcataacacaataactgtattttttaagataatggaacgatcgaatatcctgcacctaaagaaacctgacaccatagttcaacaatcacaaatgaagcccaactacttgacctagtcgaagaaaccttgctccttgggcttgtttagtagctttttccagaataaaaactcgttcaaacaatccatcttaatttttcatctagattctaagaagccacagttgtactctctccgtctcccaaaatatatatagtaacctagtattagattagcctaatgctaacagttgttgtgactatattttgagacagagggagttgaagcaagaagttggcatgttttctcaacttattcacattatcaccaaggattcctactagttacttctcaaaattaaaatctcctcaaacataccttaatcttgtcgcacaacaatattcgtacagtgaattaatcaccagttgcatatcgatatgcttattggagtactagtgataaactgagtaattaactctccccaatctctctctctctctctctctctctctctctctctctcatatcatatggttgatggagagaagcaagtagcaagtcgatctgacgcatgcaatggcaggagatatagctgtagcaagtacagtacgagtttggtttcctgtgggtgtgagctgtacgcgtcgatcgatcggttgtccagtccaaccaacccctcctcgctccgtcctccccccaacatatgccatccatctaatagcaatctaaccaagtgcctcctgtgatcgatcgatatccatccatccatccataggcgatcgatcgacgcgctagctgataattagcaacaatcgctccagaccaggtcacgggaatcctacgcatgcaacctcgctagctagctctagcaggcatgcaccctctacctctagatagtagtaatacattgcttagtgctccatacacgagtacaagctatagagattttgattttaatttagaactcgtctacaaattaaatataacagatcttatttagagtattacttttccaattcctcattgtattaaattgctcacttacatgggtaatcgtgatttttaattaaataaaaggtttttagaagtaccaaaataatttcacctcaaccccttaagctatatattttaacaacatacttcattcgctctaaaatataagcattttctaaccatatttatagacggtctaaaatgtttgagctccatcgatcggttgcctaaaacaccaaagtcaaagtcaaaatttaaattttgaaacttaattttgaagttgattttaaaatattttttagcatagtttattttatagcattggcttttaaatcgctaagaacacatacacaaaactttacaaaaattatttttggctgctaataaattgttatgacttataataaacttatggataacctttgaggcctttatattttaaaaggcttcgtataatcttttctattcgtggacgaatatatagagtggaatagagtgattggtaatttaataggggagtgcatctgtgcatggctagcctagcacagttcagctcagctcatctgctgcagccggtaactgtagcagttaattcatcgatcccatgcatgcataacactactactactctctctgatgatgatatactgtatacaggtatatactcctactttatgatggattggcggcagagatgcatgcagatatatatccagtgcagatagtatagcatgcagcagcacattcggtttgggcctgacaaagtggtgtgccctatcctagtaatggcctgacaggtatatcagacgtgtcagcatattcttaactcgatccccatatcatcaatagcacagagagaaattactcctccgtatgcatggagagagagagagagagtggttcgaggcctactttaccgtcttcccactaagatattctcactgcttaaaaaaaattctacacgagcatctcaatatattgcggacgaaacataaatgtccgtgtctgtaaagatcgatcctcatttttccatacagctctttaaaacatatatataaaaataaatttttctagatgaaccgcttagaaatatccgcaccaaaataagggaaataagggtattttcgcatgcggtgttcttaactcacatgcatgcaaaaataccccgaaagattcccactcctttacccacccccatcaccctcactccactccactcctctcctctcccggttctcccactcatatcccccactactctccccacctcctctcccctctcccctctccttactctcggtagcacgtagcaggctccggcggggggcaagggcaagggcgacggcgacggcttcctcctcctctcccccacttctctcccctctctttcctcctaacggcggtggagggactcgggcagcggagcaagacggaggaggcacacgattgtgcggatctgacggtggccgccctctgcctgtgctatggtggctgatccggcgatggggaggcgctgatgcatcctgagttcctttcgacactcaaggcagttgtttggtccggtctttcggtgagttggtgataactacgatttggaagaaacgttgacgatccaactacaaccgtactagacgtgttgcgccttagtgatcgatacacctctccgtgggttgttgatcttgccggtgtagatcaaccatattcctgcaagcaaatcgaagaaacaagcaagaacagataaaagcaatctcagacacacgataagttggggtttcgaatacaagcagacggacggtctagctgacacacgcactgcaaggaagtagcaatggctaaactttcatctaaataaaacccaagaaaccctgaaagggtacctaggtatttaaggatgtgagagaatgaccaagagggtcctaacgtcgtgctctaccagcttggggcgcaccccacatgggccccacttgggccggggtcccaaacgaagttacaagcccaaaggcccatgataggtgatgcagcaccttgtttctgcaattgcggccaaaggagatggaattcggggatgaggttggatccgttgaaaagaggactccgagagctttccatcaaatactcacgggccgaaaaccgaggttgtatgcagattcggcggccatttgaaatcagcagtgtagaagtaggccgaatcggattccagcacttggaggacttgaacttgatatcgtgatgttcatccatgatgtgagcaacggttgtatccgtagtagccatggtcacatcatcctccccttctttacggaaaaccgtcctcggtttttccatatgatgctcaacgcgtggtcgatttaaaacaacatgtttcatccaatcaaaacaagagagattggaagtaatatgattagaaataacatgtatctttagcttgcaagttttatccacatgtagaggaggttctaaatccgaacatatataaactctatgcaccaaatatatttttctattattatattcgccaaagatatgaaaaatagcattggttggacatggcaaatcagatttagcaaataatttctctttcaaattatcgagctcacaaaaattatcaaagttaacatagcccaaagtatttaaagaagttatcaattgacgttcctgaacttcatgagcaatgtgaacaacatacttaaaatcagcagaattaacattaggaatagcatgttcattaactagttgtggcattgatataagtgaagcattatcacacaactcttctttatcacaaggaacaacaagtaaattaacttatgataaaggaatttcagcatttggttccactaacggttgctctactttagcatgaaaagtggaaaaatttacttcattaacaacacattcaccttgattaatttcagcaccatttactttacctttgatgccctcttcagatgatggaggtgcctcgactttgagtgtgaataataggactggcggctttttcatgtctctctcctccttttcatgattatctacttcctgcaaatggttagtaatagaaggcaaaaacatagcaagttgcttcttcatgtcctcctctattttactttcagcattgcaagcaagttataacaaatgagaaagagatgtatatctttgacaataaagaatgtcctgaatttctttgttaagcccacgtaaaaacctcaattctgtagcttcttcgcattcatctaaaccacaacgtaataaacaagcatgcatatcattatagtataaagtaacacttttagtatcttgttttaaacattgtagtttgttgaacagaatgtcagcataatacatgggaacataaacatctctcaaatgtcgttcaggtctttccaagattgaggtactttattatgcctacaaagatgtttccaatcagaagaagcatttttaattagaacattagaggcacacataaccatatgtttctcagacaagtcatgcttcttaaattctctatcaaccactagctcccaatcaatgtaagcacgaggatcataatttccttcaaaataaggtagtgcagatttgatcttagctagaacatcacttacctcataatggtcatgttgatcattcctcatgtctcgatgaaaatgttggtgtcgagcaaggtcatatccaacgatcttgtgtatccctgccattgttaatagaaaacaagaaacatacacaaaaatatgcacgttcctattaactactaggtagtagtagctcaaatatcacacacacactcaagcttttaaccaagctcttacaagatcttaccaatgcaagcggaatggtggcatacactgactcaaccaagcaccccaatggagattggatgtatcgatgccttggcaaacacttgttgtacggctgcaatcaaatctgtggagctttgggtaggcttaaatatgtagcaaatgatagcaattgcacaaattagagaatgcaaagttgaatgatagttcaaagtcaagtattgtgttggtcctaggctagaatgtattagagacgcgagcctagacacaaacgataccacaagatagcactagggataactcacaactcacgcacaactctgatatatgaagttcagctcaaacataacaatattttctcttttctttctttcttctttcttttttttctttcttttcctttcctttcttttcttttttttggtgcgcccttttcttttcttttttatgcaccttttttgccatttttttgtgcggttttttttcaattttgtaagcacctttctgccttttctcacttttttttagcaaaaatgactcaagggcctgaaagcaagattacaaggactcaaatgtaaatacaaaaattacagggactgaaatacaaaagtgcaaaccaaaaaattaaaattatacaaaaatggaatgctctcgtcccgtaggttccatttttttaaacggatctccaatccgacactccaaaaattttcaccaaagtgtctagcaattcacaatatgtattgaaaccgaaaagggagagggagagagtcggactagcctcctcacgggaggtttttacctgtgtgccattaaaaaagatgacccctgcctctgtgccactaaaaagttcgagcctccctctatgccatcgtcgaagtttatcgcgccctccacaccattccatccgttttttttgttctaacggtggtaacggcacagccaaatgacttatttgcccttagacttgaaaggaagggttggagatggcagcagcggcggacgcaacgacggcgatgaccatcgacttcctccgtacgcgcgcctcctctccaagcgctccgtctcccacttcgcctaccaccgggggctcgctgtctccacgctcctcgtcgcctcgctcgccgccagggggtgggacctgcgccgccacatggccgtcggcaccccggcgttcgccctcctcttcgccgcctccctcgccggcgtggccaacggcgacatcccctcgctcgccgccgacatctctcctggcctctctctgtggcgctctctctagcctctctttgccaccgaccatctccatcgtggccgtcgggagcgaggtcctcgagtccggggacgccccctcgcggccgtcggccgccaccgtcgaacctgcgcccagccgccgcacagcgccggtcgccggcctcgccacgccaccccgcccttcctggtcgccacggccacggagggggagccgcctccgccggcgagctcgcgctccaaggccccaccggagaggcgctcatcaccgtgcgcagcagccgcgtagaggcggcgtctcgtcccacacgcatcggcgcttgtaggagcacggacgaggacgccaccgccgggaaaggggtggactgggaagaggagccgctggggtttgaggtgtcgacgacgccgatacccgagctgccggacccggagatgacgactggccgtcccccgctagtgtcgtccccccgccgccgagttgaaccgcctccacggccacgtcggggtgcacgacggccttctcttccaccggcgccgacgtctccgccgagtcgagccagcgacaccgtcggctgcctccccatccagcgcccgaccgcctcctgcctagcgctccatcgacggtgctccccggtcgtcccccgacccatgccactgcaatcagacaccgcccgcgtcggcgcaccggccgtctccaccgcgccatgcaccaggcgccgccgtgcccggccgtcgccgcttatgtgcgctcgcgcgtgggagaaagggggaaggagcgagaggaagaaactgaaagaaagggcaatagggacattttttctgcccgggcccacatgtcagagctgccaaacggatgaaccctaacagaatagcgacagaatggtgtggagggcgcgataaagttcgacgatagcatagagggaggctcgaactttttagtggcacagaggcaagggtcatattttagtggcatacaggtaaaaacctctcctcacggtggtagtgggcgacgagtggatggatacggcaccactagagttcggatttggtgagaggaaaagggaaactgattttcaatcaatctaatctactatttccttctagattaaactcacacttccaaaaacatatttagaaattcttcttcctcttctcagcgctggaaacagcacggcctatctattcatgggcaaaccaaaaactcaagcaaaacctagatgcaactccaaaaatgaccgataaaaacttctaaaaactacaaaatagaaccatggcagcgagccgattctgttttcgtaggtcccgacgacaacagagacacggtggttgcgacgactgtggtacaaaacttgaccagaacgtgaaactctaaacgaactagacgctaagaccagcaacacgtcgtgacaatgcaacacaaaattcaacaaagcaaagactgaaaagaacaatgcaatggcacaatatggctaggtaaatgatacaatttttttttgtctggctattttctggttataggtagataaaaactcaccgagcaacgaaagctcttataccacctaatggaccctgagttcctttcgacactcaaggcagttgtttggcccgatctttcggtgagttgatgataactacgatttgaaagaaacgttgacgatccacctacaaccgtactagacgttgtgttgcgccttagcgattgatacacctctccgtgggttgttgatcttgccggtgcagatcaaccctattcctgcaagcaaatcgaagaaacaagcaataacaagataaaagcaatctcacacacacgataagttggggtttcaaatacaagcagacggacggtctagccgacacgcacgctgcaaggaagttgcaatggctaaactttcatctaaataaaacccaagaaaccctgaaagggtacctagctatttaaggatgtgggagaacgaccaagagggtcctagggtcgtgctccaccagcttggggcgcaccccacatgggccccacttgggccggggtcccaaacgaagttacaagcccaaaggcccatgataggtgacgcagcaccttgtttctgcaattgcggccaaaggagatggaattcggggatgaggctggatccgttggaaagaggactccgagagctttccatcaaatactcacgagccaaaaaccgaggtcgtatgcagattcggcggccatttgaaatcagcagtgtagcaagtggccgaaatcggattccaatacttggaggacttgaacttaatatcgtgctgctcatccataatatgagcaacggttgtatccgtagtagccatggtcacatcaggcgcggcggccgtccccccgttcagcagcggtagatctggtggtagggaggcacggcggcggcggatcgggtggtagggaggcacggcgtcagctgattaggcggtggggaggcgtggggcggttgattcggctatgtctctggcgaggcgacaacggctataggagcgggcagacctggcggcccctagcctcctacgcccccacgatgatgacgaggacgtgatttttgatttttggttttttttttgatttttttcttgcggatgcaccaccgtaaattaaatttgaaaatatattgtttatttgttttttcttaaaaatattcggggtttaaattttttggcagtataccgttggtatcgctcaacagatacgcaagaatgatgtagcgtgacgatactgacgatgttgtgcggcaacagcgcgagtccgctcgctctcgcgcgcgcggtctcacacaaccaaagagcgagaccgttgtacgacaacaagcgagacccgatgtcttgtcatttgatgacttatttagtgcttaattatcctaattagcaattaattaataattaggatgattaatcactaattattaccaattaataaacactaattaattttcaaaaatgacctcgctctttggttgtgcaagaccgcacgacatcatcacgccacgtcattctcgcgtatataccggcggtatatttgtgaaaaaatttgaaccccgaatatttttaagaaaaaaaaatgatagtatattttcaaatttaattccaccaccctcacgtaaaaatagttatttttgcaaaccatttgtgcatacggatcgccctaccacctgcgaaaaccgggattcgaccgtatggaaaaaccggatttgtagtagtgtcttctgttccaaggatatgatcaccaataatgtctgcaagagaatactccctccatctcaaaaataaacaaatataatataagatatgacctcctatttaaattaatagcactaaaatatactctctccgtctcaaaatatagtaacttctaatactcagaatttgttccaaaatataataactttccaccaacactcttttcttaaccaaccacaaccctccaccattcactttttccacccatcttcacttttccaccaattacaacatctttccatttaattctacctgctttattaataaacatggccaattctaaagcttgtatcataggccatgtttagttcccacacgaaaaatttacaccatgtcacatcgaacgtttgaacacatgcatgaagtattaaatataggctaaaaaataactaattacacagattgcggctaatttgcgagacgaatattttaagcctaattgctccatgatttgacaatgtggtgttatagtaaacatttgctaataacggattaattagtcttaataaattcttctcgtggtttactgacggattctgtaattagtttttttattagtgtctgaataccccatgcgacaccctatataatatccgatgtgacacgccaaaaccttacccccctagatctaaacacccccatattttatctatatttattcattttaacgaaggaagtaatacaccattcctactaaaatatactaactactcattacctctgtactaaattacttattgtttatgttgtttggcatatactaggtttaaactaaaagactataatataatattgttatcaaataagttatgattaagaataaaaaggtgattgagagtaaaataggaagaaatctaaatgggacgtgattaatactccattcgtgttattttaagcgcagccatgagtttccgtgtctaactttaatcgtctgtcttatttgatattttttttgaaaaaagtaacaaaacataattcatgcataaaggattattaatgttttatcatctaacaatagtaaaaatactaatcataaaaaaatttcaaataaaacaaacaattaaagttggacacggaaactcataactacgtttataattgagaaaatccataaaatgacatcgacaagcaccctaatcccaaaaatgccatctacaaagccaacttactagaaatgccattgcacaagcctctttctcccaaaaatgccatcaccgtcaactccaaaccgttagaaccgttatttttttttaataatgaccattttgccctcggtgcaaaatatacccagttcactgtcaaagaaaaaaaattataacctaaccctaccgctaccgatcccaatcccctgatccagcgttctgccgatcccaatccccggcggcgtctcggcgagggcgggttggtggcggtgcccgtggcatctctatgctagcggtccacgggtgcggcgcggtagggcacggcgaggaagactagggcagcggcacggcagggcgccgcgagaaggtccacggcgatggtggcgtggcagggtgcggcgaggaggagcagggcggcgacgcggcaggacgcggcaaggaggagcagggcggtggcggggcagggcgctgcgaggaggtccacggcgacgaggtccaaggcggcgcgaaggtcacaggatgtggcgcgggggccgtaggcgctagcgagggggaggagaggcccacagctaaagtcgctgaggtcactgaggtcgccgaggaggctgcagtcctagcaggtggtgcaactctctgatttgaatttttccccttttgttcgatttcatttgaagactttgccggcaaggaggggaaatcccgatccggcgaggaggcccggcggctgctcagcgacggcggctcggcagtggtccacggcggtggcaccgctatgccggcggtccacgggggcggcgcggcaggggagcacagggcggcgtcgcagagaggaggccaaggacggcggtgcggcgaggaggcccagggcgcggcgaggaggcccgtggcgctggcgcggcagggagcggcgaggaggcccgtggcggcggcgctgcagggcacgtcgacgtggttcacggcggtgcgacggtcgcagcctgcagcgcgggggccgtagatgagcaaagccccattggtgccggcgaggagggtaaatttgtttttgcttcttttgatgaatttgaaatctgcaagagatgaactttgtgcgtggatagtaggttgattcagttgtccttctgtttcctgattattgatagcaaaatttctgaaggaattgcgatggcaaaatgtgtgaaattattttgtgaatttaattctgaaataatttgattgataacaaaataacgatgtctgtgaatttagttgtggacagaaaaaatatgcatgaatgcaaaataatattgtgtgagcaaataatatagaatgatgatgtgtgtgcaaatggatgcctagggtaagattgtcttttcatataacttaatggagatgagttaacaatacttatggtgtgatagtatttttgggagaaagaggttcgtgcaatggtatttttaggaagttgtctttgtcgatgatatttctggaattagaatgcttgtcaatagtattttatagattttctctataaaattagacggagtgagtaagacaagcagtactttagggagataagtgaaatttaaatggtggttggacaactaatttgggaacaggtagccaacaggcggcaaacgacaggggcagccatcaattcctctggccgctccctccaacagcagcacgcgtctgcatgcgtgacagattctcggcagcgaagcaagcaactgatcggtctgtcgctaacaattaatctcgctaattaagaaccgatcgatttgtccccgtccatttatttgtccaaacggcaggttaccatttaaggtaaggtaagggtgatcaactgatcgatcattactaatcccgtgtatacttggagaaaatcaagcatccacattgttgtatcgtattactgaggataaacacttacactacagaagtaattttttcaaacggttaaaatgaattatgtcaggtgcattcaccagccgcctgggagtagctttacgtgaaaatgatgattatcacgggtgggcatgacgaccgcatacgaaaaatcaattttcgcaggtgactatttaagacgactgactagggtaatgatttttatgaaaaaaataaaagagtgaattttactttggattaccttttttattactgacgttcctttttaccaccatctaacaaatagtttcacttgggaccggataatcttacctttactttggaccatctcgactatcttctcgcatatgaacgatgtcgagtacgtcgccttctgtttgtcgatgaactcccacagctatacttagactattgctttggcatataacaagttgatgcagatagataaaatagttgagggtggcccaaagtgccacaaaggtaaatttacccggttcaaattgaaaatattttattaaagaatggtccaaactgaaacaaataaaaggcgacccaaagtaaaatttactcaaaataaaatcacctaatccttgccgctccctataaccctagctctctagtcaaaatccacatccacatgataatcatcacacacagaaccagaacaaaacataaacttcatcacagatacagtcatctacatccagaacatgaacttgaactagaatcacaaacaaacatgaacttgaaacaaatccatgcgtagtgatccggctgctgcctccaccaccgcatggagccgccagtccgccacctccacctcccccgtgaggcgacgacacgcatggcaatgggaggtgtggaggtggatctgccaccaccacctccactgggaggcgatgagatggccgggaggcggctctgaagaggcccgtgtcgtctccctttgccaatgcagtcatcgcacctccccttttgccaccaccacgacggattcaccttccctataaccgccatcgccagaacgacaaggaagggggagaggccgcactagatccgccacctctgggctagcaggagacagatcgctgtggtcggggccctcctcgacagatttttccctcctgttgtcatcggagggagaggcaccactaatgccatagctacctacctctaccatcgccgccaatctctgacgccatcatcgaaagagagaaggtgagtagactaaagtgaggagggagagagaactgaggggataagagaggacggggtgagggttatcttatgtagtcacgggcgggcaggttgtggtcctgtatttcctaagtgggcctcttaggtttaaaaaatatgatttttcacatgtggttgtcttaagagtgtcacttgtaaaagcaagccgtaaaaatacgcctacttttacaagcggacctgttaagatgaccgtatatgaaaatcattttttgtaagtgagccttgaccggacacctcttacatatttttgcaaacgaatgcctttctagcccgttggtaaaaatacgggggttcataaaaatcttttttgtggtagtgaaagttcgaattaccccattaaattgttgcattagtttgatttaccccatgaactacattcaatatcagacatcattctctaatttttggcaccaaacgatttaaccccttgagcattatttttttatggttttggtccaagttagcacacatggcaccaatgtggcaattcccagtcaaataataataataaatttatagcacccacttgtcatcaccttcttcctccccatctctctccccctccaacggcgatccggcctcctcgacacaaagatcagcaatggctagtttgttgccatcctattcaccatcgaccttcttcttcttcttcttcttcttcttcttcttcttcttctctctctctctctctctctctcttgatctcgatggtggttgcacaccaaggaacgcaagctaggcaagcgatgatgaggttgagggtgggtggggaggaggacacgcgatcgtgtggagttagtgaatgtgactcatggtggcggagctagtggaggagcgcgacaccaaggtacaagaggtgatgcgtggcgacggagctagcggaggctagtggtgtaaggtcatggagcttgtcatcggtcgtgcggcctccactgtgagcttgaagccgcccatgctacctccacagtgagttcaccgtcacccgcgctgagtcctctgcgagttggctctgattgctacaagagccaacaactagtcttgccattctccacggttagggatggcaatcgggcgcgacgggcacgggaagtgcctatccatacccatgcctgtgagattatttgtgcccgtgggtatacccattactacatgacgggtaaggatggttgcccatgcccattgcccgcgggcgccttatgcccacggacgtgcccgtttacccgccacaacaaaagcagtggaacaaaaagtctacaagctactaagttcgaatcgaacttaaaacatcaaatattctccgcctcggtgtcgtgtctctcctctggcagcgatagagtaagaggagagaaataataagggaaataaaagggaaaccgtagaaaagaaagaacgtggcttatgtattctagtggattttgctcctagcctacatgtaagttagatttcgcggataaacgggcaaagcgggcatgggtagtgattacctatacccatgcccatttacccatcgggcatagcttttgacccaataagatacccatgggtataaaatggagaacaaacccaaccctaatagggattttacccgcaggtaaacgggcaaacgggcacaattgccatccctatccacggccctccgccaccttattattttaagggggtagccccgtgatggaaaattcaagatccaacaacggttggggtaagaacatggatatggagtaaaatataaggagtaaaaaaatatgtgttgttgtaattcaataggtaaattacactacaagagtaaaagttcaggagataattcagattagtttttctctatcattaatttctaatcgattatgtgacttagccgctaatcttttttagacaagtgttaggacacaaccacatgggtgtgtgtaggacatggatgtgtcacgtgtgcatttgcattgtacttccgcgctatcctttcttcatcgatggctcaaatgcttttgttggtccaaaaaaagcattttccttttctctacctcgaatgggatctttttatcaatctacaacatctacctggaggataacgacacggatgatggatctctctcatcacaaagacgtgaacaacagacctcctccatccacatcaaggatactagccaggattatattagctttgagtttatgtcagaactagcctaaaagatgaactaatgatacaccatatcacgattcaaaatgttcatctctaatggagttaatgttatgcaaattgcaatcacattcttcttggagaggtattgagttgcacgtgagatgtgtagtactttccatgtctctattaggatttttttttactatttgccatacaaattcctcacccatagtttgtcgaggcggggccctaaatccaaggggggatgagggaaggttgaaagtttcacctgtgggcccccgaaaattgtgaaatgtgctctaaatagttaatagttcactccaaaagaaacccaccaaggcccgtgcagtggaggagtaaccatacaagtatcaagaaaaccctaggccttcgattgatcccttaatcgcacgtggcacgctgccaagcaatgcttctacttctcatgactcagctcgcaagccacgaattgctcatcgtcgcagtcctccgctagctgtgctcagcacatattcatataatctctcctcatagcaagccctctattgcagctggtccgcactggcgcatgccgcctcttgcctccctcccggtgccccttgctccaacctcccactcatcgccggctgcctccttccacctcccatcggtatcgtctgtttgctcacttcccacccggcgtcctcctgcatctcacttgcaccaacagctgttgggctactcactgattccataccaaaggtaataatttttttggttaggtttaatttccatatatttgaaaaggatactacaacttgagtttttgtgtgttttcaatttcataagtgggattaaaggaaaagaaaggaagtgcaaaagcatgcatggaaaataaaaaaatgttgatttggggaccaagtgacggccttatacaagtcttccttggtgccaccacgtcatccatggctgaagcaaagaaagagttcaagcaggccatgttatgaaatctagatcgacctacaaaagacaattgtgactttgaatgaccacatacaagctctattttaggtccttgagtacttgatgcaaatctgttggagtcctcttttcaatggaccaccttagaaccaaatttcatataactcaaccgtaatggaggaaacaaagtgttgtaccaccaatcatgggtctacgggcttatgacttcgtctgaaaccccagaggagtgtgcctaacccggtgaagtatggccctagggactcgttggtagtcctcacacctccttaaatagctagataccctttcagggtttctcgggttttgtttagattatagtttagtcattactactttctttgtaattgtgtgttttggccagatcatctagttactcgatttctgaaaccacctttgggagtgttttattcgtcatgagctttaattcctatttgcaatttagactgtgtttatcttgttcttgcttgtttttcgatttttttgtaggaacaaggtatcaggggcgggcccagaattttaaggttgggtattcaaaataaagagggggaaatatttctacactcaaaaatcctaataattggcttatataataggcaaaatttattacaggacactcaaaaaacgtgtaattggctgtgagacatcgcaaaaacgtgacgcggctgatagacactacaaaaattatgtaattagctgtaggacaccggaggcaatattttataatttccgagtcaaaagaggtaagaaatttttcaaaatggcgagattgcccctggcacctcacctctcctctccagctcgctcgcctgtcacggagcgccgccgctgcctctcgaccgcgggcgcctcctgctcccacagcgccagcttgccgctaccgccgttgtcacgaagcgccgccgccgcctcgcgcgcgaccgcctccgccttgcctccgcctagccttgcgtcctgcaggagagcagctggatgaggcggtgccagagctcgagccgctccgtgtgtgagacctgatccgcatggacgacaaaacgcagtacatcgccaactacagcatcggcgacccgccgcagccggcggaggccatcgtcgacaccggcagcgacctcatctagacgcagtgctccgcctgccgccttcccgccaccggtggctgcttccctcgttacctcccctactacaactcctccctgtcgcgcaccgtccgggcggtgccgtgcgacgacggcgccctgtgcggcgtcgcgccagagaaggcaaggtgcgcgcgcggcagcgacgacgtgtgcgtggtcgtggcaacctacggcgccggcgtagagctcagcgttctgggcactgacgcgttcacgttcccgtcgtcggggacgacggtgaccctcgccttcggctgcgttagccagacgaggatctcgcgccgggagcgctcaacggcgcctccggcatcatcgagctcgacagccagctcaactccaagttctcctacttcctgacaccctacttcagagacaccatcagcccgagccacctattcgtcggtgacggcggcgcggcctgggcgctggcggcggcgctccggttacatccgtgcggcaccatctgtatcctcagctcctcgctcaacacgacgtggatcctttcacggcagtagttcaccacctgcacagcaacacaatgccacggaatcagtcaaattaatcctgaggttggctgcgccaccagtgaccaatccggacgtttcggatcgttccaagcacatgcttacctcggcgttgccgtggccatcgaaaacgctgaagaggtgggccggcagccggagtgcgtcggcgtcgaggcccagcccgtccaggtcgcgcacctgcgccggttagtgagcagccgcaccggcacgtccgcgaaccgcggcacggcggcgcacgcgtccttcatctccgcgctgcggccgcgcgtcgacgcgtggccccacactggcgcgcagtccatcaactaaacgctcctctaccccgcccccgccgccgccagcacccaggccgacacgatgcgagattcggcgtctggggtcgtggtcaacatgttcaacgccttcgaggcgtcagagctgggcaagatcgaggccaagctgtccaagtcaaccttcgccgtcgggccgctgcacaagctcaccacggtgaggacggcggcggaacagtaccgccatttcgtgtgcctatacggtccggaccgcgcctggctggacgcgcacccgccgcgctccatgctgtacgtgagcgagctggagaggagaggtgaggtgccaggggcaatcttgtcattttaaaaaatttctcacctcttttgactcgaaaattataaaatattgtatccggtgtcctacagctaattacgcaatttttgtagtgtctatcagccgcgtcacgtttttacgatgtcatagctaattacacgttttttgagtatcctttagcaaattttgcctatataatatcacaaactaataagacatatataacacaaaattgagcataagttcatgtatatagaatttttggttgggtaaaatggagtgaatcaattgtgctaatgggccaacaaagaaggggaggacacggcctaaaaaggatggtttctttgcttgatgggttgtttgatgtcttttctttaaattttttaatatacatataaaatatatagtatatatatatctatttttttgccaaaattcttgggtatttaatttgaatacccttgaattgttgtaggcctgcccctgcaaggtatatctgtttttgtaaaatcaacaacccatagagagatgtattagtcactaaagcgcaatacaacatctaacatctagtacgattatagtttggtcatcaacttctctctctcaaataatagttatctttagctcactgtaaggtcgggccacccctactcatatcacaaacccgaaggatggtaagggtggtggtgtgtaggagtgacggcatgggcttgaaggtggcaagcacctcctccattgtcgcatggatctagcgtacgcacccactatgatcggcctgtcaccacccctcatcatcattgattcatctcctaccttctcatcctggtatagagagggaaatgggttggggaagcgagtcagagaagaagggcaatagtagtgccatgtcaacaaagtggcaaaaatagaaaagaaaatagcgggaccaatgcttatcttaactacttaatctggtaactttccgatcgttctaatatgcttatgtccgtctcaatcctcttttgctcccttcgtttgtcccaacacttgcaaggtgttttttcctcacacgttatccccacatgaagcgtttcctttgcattctctgaatcggagacaggaaagcaagatgtgttcattaagtgataacaacacaataattcaataatcaatcttataaaagaacttcccaaaattagagtttcatagcttgaatacaaccaatgaagcaaatcggatacaccacaccacaagacaagaacaataaacaaagccaataaaagacaaaagttgaagcataaacacatgaacagattcaaaaaaaactctttaaaaaacccaatctttggcctacctcgcagcaaacacatgaacaaatccaaaaaccccttaaaaaccccaatctttggcctgcctcgcggcaaaccaatagcgattgtaatccccatggcgagcaaattggaaaagcacaaaagaggcaaagatccccatgaaaaccacaaattttcaagaaggacagatcctctcacaaccaaggcattcagggagaaggaaagactgcgacctattgttttcttctagccatctcgccgtggtggggaaagaagaatcatgggaagctcgaggtcaagtgagtgcgagatgaagggaagtaaaagaaggaaaaccggattcaggtgatctgatggccacgagctcgacttgaaggacggctcggcaacaccactaccccttccttccagcggagaagcttcaatgaggaacacgtgggaacgcgtggcaagtagtaggtgttttcctactccatttagagtggaggcttgaaggctggagcacatggatgatttcaaaatataaagaattttaggattgaacacaagtattaaggaagttgatgaaatttaattgaaaaatgttacgattggttaaaatgagaaagtagatgaaaatgtagccgcgatgaagcatccagttatccactcgattactcgtgatttggaggcagagattaatctatgcccattgcaattaacccgtcgcctgtgatccttttctttttttcccccttggtcttgggagataagaaaatgataagtagccttgtgggatgggagggaccaactactgaaggatctgagccatagatcggcaatcgggagcacgtatggtcccttctccctctccaaatcagcttgtgttccacatatggaacttctgaatactactgattagttcgcataaataattaactttcacacaagaaagtatggagagttaggaacgaaaatacccttttatgctaactaagtacacagccaataatgatgcatgtttactccttttctgtaccagccagataactgtcaaacaatcaattcaggcattttgcataaaaaagctatcttctcctttgaagctaatgtctgtatgaactatgaacatagcgcaacagttctgagtcaaagtcattatctacaacattatcttcacaagatgaatggaccacggtttatcagagatctgtgtgaagtaagaacagagcaaaggatcactgatcgaccataagtgaatcagcctatcaaagatcagagctacaaaactgattgccatttgatttctatttccttcacagtaagcagtcaagaagaatcaattggatttccaacaggtagtgactgctatgataataggagttaatctgtagtaaggaatctatcttgcctttgaatcaaaaaataacatccgtgattgtagttagcctcattcctgtacctccaaccaaggtggatggtcctccaccttggtctgtggaggaaggggcttccagcctggtttctcatcccagtacatgtcataatatatgtgccctatttcacggagctgcacacagcaccataggcccacatatctctttactcgattccgaaatttcgtgtccacagcctggtttaaacaataaagttactatgcatccttttattcagaactagcacaaaattgttgaagactggaagcttactgcatcagaaaaacctccgaaggcgttaaccatagatgagaactgtaagattttgatatccttatatggtttgaatatatccaaaagctgaaaaaaaaatagcaacttcagaatatgatttttccataagataccaaaagataaagcagaccttgcaataggcaatggctgctactaggagtataggaatcctactctatgttccacagggtatgccgtttcctcttatctgaggtgtgtatatgtctcgatatacctttatgtttagtgatttttaatgacgggtgtgttcggatgtgattgctgcagcggctttcaactactgcggctgcagcagctgcagcagcaattgcagctgatcaaggcatgatacctcttgtctggtgacttgttggcttgtcgcacacatatttcttaataaaattggagtcttgtctcaaataaaatgttcatgtttgcgaacttcaaaattacagcattaattctgagtttgcatgatatgccttttgctccagttctcactttagcttgagtttcctttttctaaaaatcctataatctgggtactagtatagttccctcatgttgtgacaaataagtatcctctaatctaaatgttgtatatttgtatgcatgaccacatgagagataaattaggcatgcataatgtgcaaacaatgccatttaccgtttgttctgtgctattccttggtaagagaacaggcgcgcctttattggttctattagttgttgagcatctggtgctatgctcattgcagagctcaacctcaagaaatgattctttgacctatgcaagatgcaaaacaataattattagaaggcaaacccacctttcttactaccaaatattcatagtgaattgttaaaacaagtacaataataacattacctgtttaggcaatgatggattctcaagaaacgagtattctctaaaatcaatgtgtgggccaaactcctccttaggtaagtcctttagcataacatgtacctgtagaattaaatcatcgtagtagga

SEQ ID NO: 33293 - DNA, 21253 bp, Oryza sativa
tatcaatgctcattttacccacaaaaaaccataagttgaccacacatcatttgttattcctgtgatggaaatccggtggtacttttgctatatttatgaaaaatattaatggcccgatatgtcaatttttatctgctacattgccacattctgagggtggtagcaaaataatgaataacgcatatcagcacagtaaccagatcagcaataatatgttgaaaagaagttttcagtacatagcactgtggtctggtctaaactccaaaccaccaaagcttggacaataaaaagcatggcaagcttcagccacctgccacctggatacatctaaaaaaaatgacatctaaaattctaaaactacagagaatttccaaaaatctaaggtatgctgacacatataacatgaaatcccagttatataatttactttaacttcactaaccatatatacttttgaaaaaaaaaatgtgatgaatttcctacaaaatatgattcatacaactaaggaaactatttctctaaccaactaatagtatgtcatataatatgaaaaatagtaaataatgttatgataacagaaatgaaaaaaattcccagtgtaatcacctcaaaaacatgatccattggacagaggaaaggttgtctggtcattgttccttccaaaactccaggatgtccaaaccacatcctatcaagcctgcaccataatggaggcattacctaaaagtacaaacagtagtcagaaattgggtgtccacaagtttgagcacaatacatcgaacagcgtaattctgctctcaaacacctccagaagttatctaagataaaaacttatcctcaaaaaagcaagcatgaagcacctaccatacattactactcaacacctcaatactcactaattagctgcagcttactcatttaaggataaatgcacttttgcaagttgtaaattttgtatcaaattaagatggtgcacacatcatcagtaaagacaaaattaacatctaaaagataagaacatattaataatcatttcaaccttttaacatatagaaagtttatggaaagagatcacattcaagaaatcgaattgcaggttaaatcaatctcaactaaatgtttacacttaatgatctgcatgtccactacctcacaatcacgaatagtaagtgtgtagtattcacactaccatcatggagttcaaatcaaactagaaaaagaatagaaattccactgaccagggtcctctttaatagggaagcaatagcgagtgcagttcttatttgcttcaactgaaaattttcaagcacatgactaatcaggaaaaagaaaaggaataaccatcaataacagaagtgcagccacaaatttgcagaaatatatgtgtagctgcagatacctggtaattgaccaatgcaaaatgagatttaacagtatgagcgccatctaacagcaagcttttaggaatgttgggtctaaatgataggaaacctcctgcatcataataccaggtaaattatggacatgatgaaaaaaagtagtaagtaaagattgtaggattcaaatccgaataatgttatatgcatgaaaataatttcatgtgaccatcttttcattcttggatcatatatggctacagcctacatggtttgtttaacagtgctccattggtaattctgagataacccatacagacgaaacattttaacactagggtacatcatggtcttcaaacataaaatcagaaggcatttgtacactagaacacatcatgatctttaaacatgaagtcatgaacctctgtcccaaagaagttccgtcatgatagggtcagagaataaacatacctggtgagtcatagtatgatggctgatcaaagaaaagcattgcttcacgcaatctatgacgctttcccacagtacctgcatactggaaagtagtatgcacagcatatggttctagccgaagctgctgatacatgccctggcaactcaagaaaaaaatacatttcaggtataaacaacccaagaaaattacagagaattttagacgaaagggacagtataaacaagatgcacaaagtgtgtgaaacaaaagaacaagaaccaaacatatgcaggacaacaaagataaaaaatgcaattgctaactaactgaaaatttactcaccaaagaaaaattttgacatgcaagatatttaatttgccaatttcaaacaaataagagcaactacctgcacaaaatatgtatgaccactacagaatatacttgctggtaggactccaagcttcagtttcccatcataagaatatacaagttcatcttctccaacaaccgggtatccaaattttttgtgtataaggtcattaaaagcattctggtcccacaacgtatcatcagataagagtaagtctttccaatcttttgccagcctcttagctggttcagtgggtcgccaatggaaaataccgatattgtatgcaccagtaactgtgcataagaaagggggggggaaggcaatatgttaggttcaaatagtaactgcaattgatggtaaacagaacaaaaaatcttattatacaggtaaacagggaaaaaaaatattatacaggcaaacagaaaatattggagcagattttttaaaacatcagaaaaatacagtaacaagaacattagttcacatcaggttctaattctctaggatttgctattgctgatacatattggaagctatattctacagcaattgtcttcaccaacagaagtccaattccagagtcattccactgtaaatatttaaaaattagttctattctcataagttgaactaaaattaattccaaactttcagaatttagtatcaaaaggtcaagaaaattcatctcagtattgtgcagttctgatttcctgatcttacagcagggcaatgattattgtagatagattagcactgggaaatatcgaaaaatagagaatgcatcacaccatctatctcgtcacaacatatgacttagataaggtgcattattgcaaagtgtagataattcaccttccctccagttctccaggctgtcatcggtgaccgtgggaatgacctggtcgctggacgtgaggagatccgcgtcagggtagcgggcgaggtagggcagcgggttcttgagccacaccatgtccgtgtcgcacatgagcagctcgtagccgaagggcaggagcgcgttgatgagcagcaccttctccctgcccatcttgtggaaggtgggcgagccccagacggcgtcctcggtggccatcctgctgcccatgtcgaagacggggacgcccctgaggtagagctcccggagcagcttggtgtccatggcgccgacgaggaggctgtcgacgccgaggtccgtgaggtggcgcacccaggtgaggatgaagtcgaggaaggcgtggttgccgaaggtgacgacaatggcgccgccgcgggcgcgggcgcccaccatctcgcgggtgaggcggaacgcgcgcggcgcgggcatccgctccctccgcggcgggggcttccagatgggccgattgtacatggtctccggctgcgccacaccggagactgcgcccgagaggttggcggcggcggcggacgcgggagggatggggagcgggggcgcggcgagcgaggagaaggaggagaggaggaaaaagagcgcggagacggcgaacccgccgatgacggcgccgtagatcccgacgaagaccggcttggtcgagtcggcggggcaccacggcgccatctcgccggccggcggcggcggatcgtggtcgccggagaggcaaggtcagcggctcaccgctgccattgtcgggaaaggggactaggggaggtggggtttgagacgagacgggagtgggcggcgccggcgggtcggggggcccacctggcggtggctgcacggtaagaccttactaccgatgatcccgttacggtgaaggaatcacgatggaaaaagcacgctcccgtttcgctcgccactgtcgtgcggggcccacttgacagtgaaagcaagtagggagtggatttgtgtcttcatttccacatgttcatccgttgtagtagagtatgactgtcaactcaatcaagtacactgtacgagtggtgtgtttatgtagggcaaatggcaatgtccaagcgtacgaaaagggaaagataaatggatattcatctatgggtgtgtttggaagagatttttttggcagcagctgcggctgcagtagtttaaaacggctgtaatctgtagcagcaaaaatggctgtcaaacgaggtctatttctctgtgcagctatgcttcaaacgtcaaatagggtaattttaagcttgtctaatcatcacggtttgcgcattgaacgattgagaaattcttttctttttagaaatataatacaaacgcagacatccacaatgcgcgtacactcacccctatgagcacgcgcgtataacctacctctaagcacttctggaagattggattagcatatcttgagattaacaaagtcaccacgaaccggcgcctcattgtcgcctattactgaaagaacaattagccataaatacgagcacccgtgttaaatctaaattttaactctggtgagctagtttcaccacaagaaacctaaccagttaagatacgctcacttcgtgaaaacctagataaatttggtgcgtcgtggaatatagttttcacctaaaatattgttttctttgagcggaattttgttcatatttcagtactagtatcttctgtgggccaattattagagcttattaatatctttacgttaaaaatactcttgaaaataagttctagtttttaaagtccttttgaagtaaataactatatttataataattaaaaaaacagccctacaaaaattccccatgtcatctaaaactaatctaaattcaagccaaagttgaaaaatgcacgatattgaaacttaaaagttgaatattgtctggtttagagttaattttagtgttattacatttttttaaaacaaatatttaggattgtaaatgaacttaattttgtcatttatgtcttacctggtatacattgagatatacaccaaaatattcgtgttattagagggaggggaaatttgccaagattgatatggactcacttcattcacaaattatcatcatataaatttttcagtgttattcagaaatgatcagtatatttggtacttcctacatgtgactttttgttttcctgtgcagtataaaataatcagttgcatgtattgttcaatgtactaactaattgtaattgtggtgcatgactgcatgcatgcaagcaatatcattggcgcatattgcccttgaagcatatatataggacacaagaaatggtgttgcatgttaatcgatgtcaatttaagtgacatgtgtaagtgtgatggtatcgatacacaaaccatatatgctgatcatttgtgaatagtggaagtacaatttatcaaggatttgtccttttgccaccacattaaaaaaaaacagaaagttctaactagctaggtactacatctcttttctaactagataccaagggagctgccagagatttctgtcgggataaggtagtagcactttgtaaatgaccaccatcgagccattcagacacgcatagatgaagaagattttagcaatatcgtacaaacagattggaacagtctattccttagacagctctagttttttgtctcccatttctcattctgtttgatgtggaaaatttgcaacaagtcttgtggctttgttcatccgcagatgatgcaaaccggaattttaattaaattatctgaaaagctacaaatttttttttgaattttatttgtgcaatttaagaaattctaaacaaacatggatggaccgtgtcattgtagattactagttatcgtgcacatgtaaggcatgttttggtattatgtacaataaaaaaaatagaataataaatgtaccttttttatatagagcactccatacaaattctaaaggtaaaaaaagagtatcatagaccctagtaaaaagcatgtgttatgtgtactcctggagtgccaagctgtgcaccatgtaaattactacgggagaagcaaagcagcaaaccttgtgtccaagattgtggatctaattctagacaattcattcaacataggaataaatgttttttcaagaaggtcctcagacctaccccgtagcttatattgaaagccacaacgacaggttcgctgggattacaaggtttacatgagctcagagcaaaagggaagtctcacatggtcacacatcccgaccagctagggtcacttaaaggatagacaaactaaacaaaaaggggtaagaactcccatagcagaaattgacaactcttactttaacacggacttcaaactttttttggtaggaaaaacatcatccaactcttgatcttggtcgcagccttgctattgccccttcagacgtgccaccagagcctccatctgcttctccttggggaaggagaggtttccactacatcagttgagaaataatttgaaaaagttaaattagaagggagtaagcaatgttatctctaaacaccatatcattcctcgttagccaccaggttcacacaattgcagctaatcagcaaagacacaacaaattttgtacaaatttaagggaaagaaaattgttcaccagtttgttttattcgttattgtcccccaaaaaaattgtaatagatctctgatagaagaaatagaggcttatatcattttattttggtcttaacccaattgttaaaaaaattacagttagcatgattgaaaacgacattcttgtatgttttttcagaaatgaatcttagcaggatacccaattaaagctcactaatcccatgccttgaactgcatatggtaacatgcatgctccatgtcccatgcaacacgctgcatctggctgactatacaaaaggacaatatgaaatttgttaaaaaagtgttttttaaatagcacaaatagaagaggcacaatcatctgttgttactctgcagttgctgctaaatagcccttctgattcctgtacatagcttcagatccattaagcttcattttttattcagtacaaaaacgattttgaaagaacactttagatagaaacattggtttatcccatgcggcctctcgccaaagctgagtcgtgtagccaaaaagattgaccgtacagaaaaacatggtcacaaaggtgatgttttgcggcaaagggaaatttaaaatgtttaaagaagatagtgtcaccagagatatgttgcatcataaagtaaatcagagaaaaaaaacttacagcaattcacacaaaatgaatacaatttcctcttttagactccaaaaattcttaatgctttttctgcacttcacgtttgctcaatctttcaacacacaagctctttgaacatggctctgaagctgaagcactcacttcgctgtgcaaaacaggagaaagtgctttagcaaatcactgggcaacagtacatccacataggaggccattagagcaactttgcacataagggatcaatagatgtgtatattcctaagcattgttgttggcacccagcttgaaccaactattgtgctaatttagccaaaaaaggattgatccttgggaatcaaaaagtctatcacgcttgataggtttgtctgaattagtcgagggtgcagactgcaagttacatgatgttatgatgttgaggtgagatcgatttaaattaataatgagacacaacctgtcctgagtcaactgcttctgaaattcatcctccgtcactgcagagaagggcagtaccacctgaatagttggagttggcaaatcacctgcatatacacttatttttttattagccaaataaaatcttaattgacaacaagcacagtaccattagaatcagaaatgccataatcatgccttggctgctccttcgatgtgaataaatcaaactttgagaacaacatgaatataatatggttacctaccttttttcgaggccaagttatactggccgccgcagctgccgttctccttttaggaaggttgaacccagtatcacactgcaaaccactcaattcccctaatcaaacaccatacgccaccaacatcagataaaaatctttagagaaggggaggaacatcacctgaactcctgaacatgacaaggtcatccatcgtgtagatgcgctagatccggcaacatcgccatatactgcaagtaccaagtagagagggcggggccatggcggtgtccaagcaatgtgccatcaccaccgaccttgcattcacacgcaagcaccacctcctctacctgacgtggcggcgtgcactgtgggagtcgaactcatgaggtgcctgaggtgttgagggatggccttggttcctcctccacctgacgtgacgtggtaccgtaggcggtgggacagctgtagcagtgcatatacactggatctcctcttctccactgcccgacgacggcagtgaggcgaagactttgatccaaggacgacggctctcgatccaaatccaacagcgcctgcgtgcagggaaggggagctggcgacggacgccgctgcgggatacgggtggtggaaggcgacaacggcgggggaagggcgagggcatgaggggctgaggggatgatatacttgccttggcagttattgcgacgatgcggggattgcgccatcaaggaggcgagattgacgatggcgatggggatgagaatggggatggggctttgggtggatgatgcagcgatggatttctggccgatgatttcaccgagccgattgacggatggagaagtggtggatcgaggcggagcgagtagaagcggcgcgtgttggcggcggcggcggcgacgccggaaggggacgaccctccgaaggcggcgaacggggaatgcgaggaggaagagggcggaggaggaggagcgccggcgggagcagcggtggggcgaggagaatcggcgcgtgatggcagcggcagcaaaagcgctggggaggagcgcgagtcccgcgtgttcagcgcacgctcatcgcgcgaggaggaggaagcggacggataggagagatggcggacggacgatctggatcaggagagacgcagatgaacggtagtgattgattcggatgatttcaccagtaggattggagggggcaactcctcttttttatattagtatagatatagaagtatagatgtgcaatactgtgatcacttagctaccgtggagagaaatggatattttgttaaaaagtaagagaagttctacacatgattaagcattaatcattataaacttgaaaaaagagattaatttgatttgttcaaacatcttctatataaaactttttttactagaaaaaacacaccatttagtagtttaaaagtgtgctaatgaaaaacaagtaagttaaagtttggattcgaaggaaaaaattcgaaattaatcttttttttaagtttataacgattaatgattaattaataatatgttaatgagttttatccttttatgcgtacgatgaatctttcttcaaactcgctagaagaaagcagtcttactacaacatactctatatatcgaacatattattttcaaaattttctaaagcacacaaaatataatctgaaaggggttgtaaaaccagctctctcattgtgagatatttgtacgcaaaaggccagatattttagcggcgaaggagatctttcccgctacagggcaaaagctaaagcgcctaacaatgtacttgagcctcgcgttctcttgtcccatagcgaagaaaacagaggcggctggcaagaaaaatgaaaaaataacaaaaaaaaagagggaaaaaaatcaaggcagaagaatactcatccaatccaaccacacgccccggccagctcgtcgtcgccacctcaccaccacacacgcgcagccaagcccctcacctcacctcacctctccatccacgataatatcatgatccatccttatatatgcctccttcgcaaactcacttcggattctcttctctttctttcatcagctatcacaattcacaagtgtagactgtaggatggccacgctctcttcctgcagccgcctgagcaccggcggcggcgccgtccagcgccgtccccggcggccggcaagcgctgcgaccatcacctgccaccggagctcctcctcctcctcgtcggccagggtagtccgcacaggcgccgccgcggcgcctgccgcggccacggcgcccgccgtgccgcagaccaacgagtgagtaactcacaaactgagctctcccctttaatttgtggctgatgaaaaagttgtgttgatttaaaaaaaaaaattggttgttgcaggtgctcgcttccgacatgggcggagttcgagctgggcaaggcgccggtctactggaagaccatgaacggtcttcctccatcggctgtaagtttaatttcttcacaaaaagaaatactttcactcatcatacatgtaacaactactccttctgatttatattataaatcattttgatttttttttcctaatcatttttttaaaaaaatttgactatgtttttttaaaataattaccaacatgtacaccgaattagtttcattaaaattaacatttgatatattttgataatatgtttgttttgggttaagaattttgttatattttcaaactttaaaaaataataagaaaaagaaagtcaaaagcaacttataatatggaacagcggtagtactagcaacctggcagattcatcatggaaatagtagctaattaagctgccgctgtgttcttaccagggagagggcctgatccttttctacaacccggcagcgaccaagatgacccccaacgctcagtttggcatcgcgtttaatggtaattgagcaccctcttaattctccttttcacccacccagtgtccgggaaaaattcaggctacaaattggtttgatctgaatctgattcaggagttgataactgagactttatttgctgcaggtggttttaaccagccgatcatgtgcggtggtgagccgaggcagatgacgctgcaagagaggggatcagctgatcctcccatatacaccatcaggatacgtgtgccgcagcatggtcagcagctgattgttttgtttcgttgaagatatgaatgattcgcctgcaatttctcattaacttaaattaagcttttgcatcatgctgacaccatatgttcaagtgatcgttactagtactgtatgtatgtaatagcatgttgtcatctgagtggccatggattcgttactagtactgtatgtatgtaatagcatgttgtcatcggagtgagattttgtctggttggttttgcactcgcagccatgaccctcgtcttctccttcacaaacggggtggattgggatggaccgtacaccctcaagttcagggtccccaagccatggctcaacaagcccttgagcttcttcaacgaggtaaaattttgctccgagttcgtgttgttttcaatcaaacaagcttgatttgtaccttgaatccaattttattgttaattaccatttcttgatagcttatgcactggaaaagttgaaactcctctttggatcagtgttaacttttagaatgcaccttttgtgctaataaagagagttattttaaaaattatctgtgacgacgatgcagggtctagcagacgaactgaacagagaaggggcatgcgacagagccatcttcccagacgaaaacgttgtcatcacaagctgcgagatgggcagctactacgaagagggggtaaaacttttaacctttatctcaaattcatgattaatcctagccagttctgaaccgttgctgcatcccctggcactggcagggagatcgctgcaagctggacattgtgtcagggtgcatggatccaaactcgcacatgtttgatccactcgccaccgtggatgacggatcatgcccaatggattccgattccgaggaatgaactgaactacagtctcagcgagttttattagcaaggagaagctgtaattagtggccactgttgttcaatgtaaaaagaaagaagcgacacggtatgatgtacaagaaagcacagatgtgtgatagaatggtattagggaatgatgtgtgctgcatttggtgaaaagaatacacaactgtaggcctcatacaaatgtggttgttaatttgtgacagaactactctgaatttaatagagatcaacctatacaaataccatcaaagaaagtgtcggcacgtgaccaaaagttccaaaaacacgggataactcctgattaaacaaggagaaaaaaaaattattttctgatttatctatatagccttcagttcagagtttgatacttatactggaaaagtggaaatggacccagaacacgaatcaaccggaatttaagttcagttccagcacaattccaggcatccgcccgtttgtctgatgtctacgtactgcaaaaatgtcgctcatgtctgctagacgactaccaaattaggccaagaaaaaaaaaaccaagcattaagccttgaacattcacaggacaaagtctgcaaatggtccaagcaaactgatgcaaccatgcaaatttcagtcacagttacactgcggaaagaaggcatacatgtcaaggcaacatggcatgccatcatcacgccagttcactgatacagcatccagtcataatggagttgcacagaccatattactacaagggcaaagtcaacttgcagcacattgctgttcgttttgagtagcctcagtcacagcttagccgcctccaacctggcgtttccaggagtcctccacaataagctcgtcaacgccccagtcctcatagctatatttgaacacacagtaaactattataatgaggttacaaaatcaggaaacacataaatgtcttttattcaaatctcaccttccgtcaggtaagtaccgcctaattgtgaatgggatcttgcgtgctctcagctctttcatggcaatctaatttgcacaaagacaatagtttagcatagcaagtaatttgaaagatagaataaaatcaactgacaatttctgacagaaagagagaagaaatctaagtagtatttataatgagttgttgataagtgcagtcaacattcatctcatcttggttttgtgggagtactctaccaaaatatttcagttaccatgcctaaaacataccaaaataattttttatccgggaaaagcaatctaagacccttgtggaattctaaaaacatgtgaaaatttttcatgacatggaggaagagggacacgtgtaaacatacaaaattttaagattgagaacaatatgggagtcaacaaaaattgtattcatattccggaagaattgatttcttctatctcttccttttctctgtccatcatgataacaaagtttggcatgaacaaagaaaacccggcacctgccttttccttttcctagaatttttaaaacctccggttaactcttccgatttagatataataaaccttctagaagttggaataaggatggaactaatgcgtatgaaagtcccacttcagggatagcagtggcatatttaccagccagcagccatataatatatcaagtgttacaacaaaaccaatctttggtattggactatcaaacactaaaacataatacagaattaatcaattgccacttgttctccacataaactagatcaatttcatgatatttgaaatgccatgaaaaacaatgtataagagccctgactaataacttctgtctgggtagaagaactaattcaaatagacaagtcagggtgcttgtcaacatttgtcctatctgtttttatattgtggaaacaaatcacagaatcacaaggctaccaaataatagtatctagagccttgatgaaagaaatatgtgtacaaatacaaccttgtgcatactagtataattgcagacgaaaacttattgtcagtcacatatttagatttcaagctgactcggcgtggcagccctccatgacgaaaaaaagacattctattgattgaattgctggcctatgtctatacacaattacatacagctatcaaacatgtgtactttgttgaattatatattcaaacgttaattttattaattagttggcagtcaggtgttgtatgcctaaacaagaaaattccattgttcattttcattcttcatgatggaaacagatgtttattgtaaaaggttatttaagttgtacaatataagcttggtatatggaactggcaaaaatcaaaataatgaatatgtagaggttatcgcttgtttgaacaaatacctattgcatgtatagtttggaaaaatagaatttacctcaagaggatcagtttctccctcaagctcaaccataactggagcattcatgctataaaacaacagcaagggttattaatactgtatggtaaactattagccatcaaattggcaatactgtgcaatatgatatatagaaacataccttatctgtaatgcacgtgtacccaggatgcgggcacgctcatactttgtcatatactttgacgttttgcgtgggcgctgagttttttcttgttccttatcttcagcctctgcccctacaacctcatcagggccatcctcgttattctcaggttcctcttcagccccttcctattattgaacagaactccatcagttcttttccattaacagataacatcactgcatgaggatagcaatgtgtgtacctcaatctcaggttctggtggctcatcctcatacctgcagaggaaaatacaatgccattccaaaatcaatatccaacaaaacaatcctttaaaatgacatataacaatcagtgcttcagcaatcatatagttgtgcaaggataatggtagatatctcactaggatgaaatgtaaaagaaattcaaaattttcacttctaccaacactaatgaacataactttggtctgtgtaatttagtaattacactaaaattgaatattcctgagaaaatggacatataactaactaattcatatgttttaaccgccaagccaccacagtaaattaagcagaaaagaatgaaaccacacattcttgttccaattagaagcaagatgttagagatcctctaagtttttagctagcgtgacaaagttaggattccatattagtacaatgaccatctatcttaatatgtaatagattttttccatttttatctttcatttttctccttgttttccttatatgcatatatatttttcccctttctttatactgctgcataaatgatttgcaccaagcctcctattacatcaattgcatagctcccctgacctatatcggtctagccaatcccttcatgtccatgtcaccatagaaaggagcaagcaggaggtacgcatgagaaccccccatccccgactgcgttcaatgttcttttctctcaaacaaagcggtatagaatcatcaatgaaaattcccataattggtgagcgggattgtcgcattaacccaattgattcatccaagcaaacctaaatttcaaagaacctgctaaacctaaccataaccaaacaagcagggaaacagaatatcactctttacagtatccccttctgttgctgacaaactaatctcagacaacttctaagagccattactcgactcaacgaacgaaacatgccctaagaataatactcgactcaacgatcaaaacatgccccaagaataaactccaaagacaccttttacccgtgaagaccagtacgcatccaacattaacacctctcgttttccaaaaaccaatcgagtgaatcgcggcaatcgccataactagcttcgactcgaatcaacgaacccaccaccccaaatgctccccatggcgatgaggagcgccaacgaatcacccagcacagactcctaccggcgcaacatgttacacagagagctggttcgaccggtctgggattagaaatttattagaacaggcgatgcctatcgaaaccctagattggattcccatgatcatacggaaaaaggactagagagagtgagatagtagagagtaaggcaaaccccatgtccatgtcgttgtagtcgtcgtccgccatggcttccgccgcctctgattccggccgctacaatcgctagggtttcgccgcacggcggccaagcggtgctcgacagggagaaagggggcaaatgggactctgggagagcgcaacggacggcccaccagcccgggaaaaagaacggggacaatccccggagaatcgtagaaggatctggaccgtatgatccgtatctgcagaaatttcaaaatatggcattcaatgcgccctgcagaatttatcagtctatccgttgttttcagactatgacattaggaatttaggatacgaatttttttcgttctacgccactttgtccgccagcgtcggttgcgtcgtcctagtccaccaaccgcgctcgcgtaagccacaagtcattgttcgtctgttcaccactcgtatcagtcgagtcaccctctgtccgctggcgtcatcgttgtcgacatccatcatctgcatcgccatccatctgtggcaccgtcatcgtctgtttgccaccatcactgtgtcgctatagtccatccatctgtggcaccgtcatcgtctgtttgccaccatcactgtgtcgctatagtcctctgcaacgccagttgtgccaggacaccatcgtcctcttcctgctacattgcgggcctacctcgaaccaaaacctacgtgcgcttttgccgtcgtttgcctatgatggattttggcatccatccggacctggattggttgattcatcaactgatgacgtcatcttacatgcttagtttgcttggattgcttctctttcttatctcgcccctttatatttccctctttaactttttccttgctaatcaaatttggacaacgccggcagcaccgacggatgaacgacggcaacaccgggcggattaacaaggatggggcaacctatgctggtagatggagtggcacataatgaagaaaattcgcagcctagtgttgtattctaaaagaaaagtaaattgggtggcaaattctaaaagaagtgtgtattggtgatgaattctaaaactttgtttgttggatttaagctcagttctagtgagcagtactcccctttctccgaaatatagatatttctagataattttggagggattaaggagtgaaggcgaaaaaatcatagcacccttcagagttgttcggagaatcaacatgctgcagcgctgcacctacaactacagccaggggcggatctatagtactaggaccggtgtcaggcgacaccgacgattttcggcaaaacctatagcaaaactgcttattcatatgttataacactgtgatctaaatataattagtatactatgacaccgatagacacgttatgacaccaatgaatcgattttctggatccgctactaactacagcggctacaggaggatgggctgttccctgctgcaacaaaatagttgggctttgcaacacagcccaaaccgctacatcatgggatactaaacaaccccttcattgatgcacgtaggacttatagtctacagaaaatagggtggttgatgggttaaaagagagctataaatagttatatatggggtaaatttgaatcctaaaaattagttatatattaagatggagggagtagcagttacctttaatttccacttgcatgtaaaatgaggtaagccattagcttatgattaattgaatattgattactacaaacttaaaaattgtgtttatttgaatttttttaaaaaaactattatatagaaaagatttatttgaaaatgtgcttaaaaaagagaaagttacaactgctaaacaagaaaacaaacaacgcgttagggtttttagttaatttgtagtgatttagaattttatattttcacaaacaaaataattcattcaaattaatattatgaatgtaaacacaaatctagatatagatttataaatctaagaatatccaacttcaataatattggctagagctgtttcaaatagggacaatgtgggtagaattttgttcgtcaattcgttccattaaaaaaataaaaaaaattctttgttaatttcctctaggtttgctaaatgattccttaccgttgtctatttaattagtgttttttactggctctgttattttagcattttaatctctattttatttcctgaacgtatttatatccgaatctaatgtgcaaacatactcgaacacattcaaatcgggctcggctttaatttttagtgtaaaacgatttacgtatgaaaacttggtatatattaacttttcctaaaaagacgattctagaccacgcttgcacaaacagcccatttcaatttggttctaacatttacatgaaaatttaaacaaatgtgggttaaaaaatacggtttgctgagatgaaaaacgcgcctagctaggttggtacatgggttgatttgagtttcaaaattattatggcacgtgacgcatgggttgattttgagtccaactccatatctatacatagttacaagcctacaacgtgttcacaggcctattcagaagtcttcctggataacagtacgtgagctggttgcgtatttgtagacagctaacgagcatgtattagacgtaccttttttttttttcttgaatacccaaaagatccgtttatcattatattaaaataagagagggtataaccccgagtacaaaacaagatacacccttattaaattataacaaccatatgtgccacaagctcgacaatgaacacaactaaaaaacggccacaaccacaaacccgactataaaactaaccacccggctctcgagcaagctataagaatagctccaaggcccagccaaacaacacagccattcttttgccttggcaacaaagaccacctgctaagttagcagcaaccccctaaatgacacattaatttcaccaaaatgactacaaattgagcccgtattgcactgggtcattagttgcctcattggtcttgtttcataactcctccctttttcaccatcaggccattagaatgactatagacgtaccacatttacacattttctcctcttttagtatgacaggcattttccttgacaataggtgctattctcaaacatcgtaaagatatggctcctagttagggtggacaatggatgaaactaaatattatttgagggcacaaataaataaattaaatattaaaaagttgaaaaatgtcccataataaacgtcgatgaaaaaattttttgtgaaaactgtaaagctaggaacttgggaagtgtggcggtatgccaaccatctgttagctcacaagaacggggcctctgttgccggatttggattttaccatagctactagtcctgcttagaatgattctaaacttgaatttaatatttgaaattcaaatttgtatttaaactcacatccttcttccccgttaactaggagtactgatttttggaaactgaatattgtaccagtataagcagtagtgcattattacagtttttggcaggatttcttatatatttatttaacaaagttcgataaaaaaaattaaatgaaagcacacctctaacaaatttgccaagagtggtacggtttgaaatgacattgatcttaacaaccccgtatttcttactaggtgattctccgtattttgctgtggaaattactaagttatttttagagtgaagtgcatggatagtcactaaacttgagcaggtatgtcacttaggtccctatttttgagtccctcaacttgtcttaggtgccatataggttcaaacgagctattacccacttcgttaaaaccaggtggcatgccatggtgacacttacgtgtcagtgcgatccacatgtcagtcacatagaaaaaataaaatttaaaaagagaggagagagagtgagagagagagagagagaggagaaaataatgtttttaattttgaaaaataaatgaaaaaggagaggagaaaaaatatgttcttaatttttttctatatgtgattgatatatggtttctactgacacgtaggcaccaccatagcatatgccacgtcaccaccatggcatgccacgtcagtacacggagcgggttggagcccgtttggacctatatgacacatgagataagttgagggacacaaaaatgtattttgagagttctaggacctagatgacacacccacagaagtttatggacctccaatgcactttactcaataatcgagctaagagtgaaacggatattagtttgccaaactgaaagtgcatctaggacccctcatttgttttggtgttaatgacaacacaattagaggataactaatgctttttgttgagatgtatgcaaggatgaaaaaggagtggaacttaagcatagaaagctttgtggcaatttgtgtggtaatcacctctctaaaccttgtgtatcatgtgttcttgagtattgggatgccatactattaagagggataccacatgcatataattggtagaacactagtgctcaaaatcctttctttgaagtgttcctgttttattcctgtcggactatccgatcttgatcagactatccgatgctcagactatccgaaatttcacagaactttgccctctgtctttggtcttagtgttggtcataaaatatcggactatccgatataaggtcggactatccgatacatcggactatctgaaatttctcagaacttcactctcggttttgaattgctttttattcctcttgagtgaatttcaaatcagactatccgatgtgatcggagtatccgatgacccagagactccaaaactcaatggaacttgagtctatgtgaaggatgaaattcatgactcaaaaataacggaatatccgatatgacatcggactatccgatcgatcggattgtccgaaattctccagaatttcgttctctgtctttggcttgctggggggggtcaaaaacatcggattatccgatgtcacctcggactttccgaggtgggatgaaaagattcccttcccaacggccacattttgggggatctataaa

SEQ ID NO: 33294 - DNA, 1433 bp, Oryza sativa
ggcctcttagagtcatcaaatttgattttgcctccttcaatagccgcttggatctgctgcctgaagaccttgcaatcattagtcgtatgagacccagaattatgccacttgcaataccttttcttgcccaactcttcagccgatggaattgtgtgaccgacaggaagttgaatctgcttctctcggagtagcaagtcaaaaattttgtcagccttagtgatatcaaagtcatacctttcctctttccctgtgttctttacccattggcatggtataacctttttacttcttacccattcggctgcaactatctcagaatcatcatcttcatcgtctgacccatatatataaggacagacatgattaaccttcctggaattcttcctagcctctgcaaacctttgttcatgcaaggttaccttctgtgtaagatgggacaagctttcaaaatcctcagatgagaatttctccttaattggagcaatcataccctgaaaagccaaatcggctaactgggcatcagtcaagcttaagctgtagcacttattcctcatctctctgaatctctgaatatactcatgcataggctcatcatgtctttgcttgatcgatgtcagatcggacaatttcatctcatgaaccccactataaaaatagctgtgaaactgcttttctaaatcgacccaactgttaattgatccatatggcaaagaagaaaaccaagtgaaggccgatccagacaaagataaccggaacaacctaacctttaaggcatctacagccgatgcttcaccacactaggcaaaaaatcggctactgtgctcataagtcgatgtactatcttgccctgaaaattttgaaaagtcaggcaccttaaaccgattgggtagaggaaccctctcaaaccattcaggatagggttgtcggtacaaatttccagcatctttcggcctaagcccaaactgctccttcatgacatctgcaatcaaatcggcccatggtcgttgttgaggtgttccttgaggttgctgtggcataggctcgaattggttgtattgaggaacaaattggggttgagccgatcctgcctactggtactgaacttagggtgatggcggctgatactgatagtttaaattgcccccccctggtaattttgaagatccggctgaatattgcgcaccaaatgttcaggaataacttgagggatcactatgccatctggttgtacgtgatgaaccaagtgctctggaacaacttgatttgcagcatgctgcacaggctgaccaccaggtgttgcaaacccaaccgatgtattcattgaaccttgctactgaatcggctgaacaacctgctgccttaatggcgtttgctgaatcggctgcaagacctgtcgtcctggtggcgtctgctgaactggttgcacaaactgt

SEQ ID NO: 33295 - DNA, 731 bp, Oryza sativa
gcataataggcccagccgtgcaggcggaaacaccagtcggcggcgggcgaggcggccggtcggtgaagacgtaaacgcccaacaacagcggcataataggccagccgtgcaggcggaaacaccagtcggcggcgggcgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggccaaccgtgcaggcggaaacaccagtcggcggctgacgaggcggccggtcggtgaagacgtagacgcccaacaacggcggcataataggccagccgtgcaggcggaaacaccagtccgtggcagcgaaggcaagccggtcggtgaagacgtagacgcccaacaacggcggcataataggccagccgtgcaggcggaaacaccagtcggcggctgacgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtg

SEQ ID NO: 33296 - DNA, 8776 bp, Oryza sativa
  unsure (1)..(8776): unsure at all n locations
atatttctttcttaatagtacaaaactatatcttatatagtctctctagttatataattcttatcggtttgaacaagaataaaaataaatttttataaatttgactatcaataacaatgaccatgatgattttggagccaaacctacaaagctacattggatgttatgttatccatgagagatgcttttgccacatgatcaacctggtggtccaagcatgtattattgtcattgagaatttattgatttttaaggtgtcgaaacatgaattcggcaataataaaacggggtagcgcacgagacctaaaagtggatggatgtggagacaaaagatttagacaggttcaggccctctcgatgagaggtaataccctactcctgtttggggatttgaatccgccgggtgtattatagatctgacgatctagttgtctcatgccccctagagggcttcctgcccaccttatataggatggggggcaggattacaagatagaaaccttaaccaatacggtatcggtttcctaaatctactttacaatcttatcaaaccaggactttaggccgttccataatatatagggaaacgtaatacccaagtcacgatctgttacatattccatacatatatgttatcccctattactagtcggataaccatgccgtgtggatatggggtacccataatctccacagtagcccctgagacccttcacagtcgaaaatataatcttctctcgaactagattactccaaagccgagtgcttcaatcatcttcgccatggtctcccgagtacttttaccaaatctgaggactgtggagggctgaaaaataaagtcaggtgcatcgaatagatgcacctaataggtgtagcccctgactatgtggttaattgaaccaaccaaacatatagtcaaggaataaataatctaaccaaccgagtggttttgataattgtaatcaaccaagtgacttgatatcaatatatagcatatgcggtgtgaatccccgaataatatgatccaagtgatataccgactgcttggcataatatgatgcgtacaacctaaagttgacaacatctttgaaagttcacatagcaaaacaactataaagaagcttgaatgctgtgaataaagaaatttccaaagtattgggcatacgccatgcgcacactgctttaacagatgtgcttaagtccctaaaagacacatggtttcaccacacctgaaaatatatggcacatgtggtataacatccgagtaagtaaactcataaaggatttaccaaccgcctaaaaaatgaccataatatataatcagcctaagccataatattggtcaataaaaatgcacacttacatggcaaaaagcaatgatattatatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataggtgtaacaattgaatcccgactggcgcaagtattcagttgataacccttacggggaataataaatagtccagtctttgagcatagaaaatagacccatgatcacgaattcatagtgcatatatccagagcaagtccaaattgaaggtatgatacttgtgtttgagctagtaaacccctgagcatatagcttgtccttctgtcgtagtcacaattgtccattgatggtagcaatcaaaagtgatgaagttgcatagctgtggagcgaagaaaccagtcggcagcagacaagtcagccaacagtgaagatgaaggcatccagcaacatcgacaaaattgagcagccatggtggcggaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatcatgaaaatgaagaaaatagtcgacgacgacaaatgcaaccgtcagtagcaatagagatgatcgactatgatgacgaaattgctcatcaaacagtagtagagtgggctatgttgaagaggcttgacagtatgttgacgaagatgacgatgttggtgatccagccaatagcagtgtagcaaccaatgataatgacaaagacgctcatcagcatttgcatagtaggtcaaccgtgaaggtgaaataataagtcggtgaagacataatcatccattagcaacagcggagatgtcagggccgatgaaggaaaggtgctggtgatgatgtcagtgacaataatccttcaaattaatgttatagctgttgtagatgcttcacttggaggagagttaatgctgttgtccaactcgtctaaaccgaaatatttgatgttgttgaagtagattgtctgctccgaagcaaagatgaagataatgactcctggagttgactcgttggctgattaattgattgctccatctttgacataaagcttgtcgaattttgagccatgtatttgtgtagccccgactctttgtttagttgggaaacaactgaacatagagtcgagaattatagcttcttatcgtcgagtagtcattgcttgattgaagataagtgttgaagatgtccaagtagaaatccatgatgacaaagttgcattgccgtgatgaagtgacagaagcaaactggtagtgaagacgcgcaattgtgacgataaaagcgccagtcggcggcagacgtagacagcttgcgttgaagatgatgacgcatattagcggtgacggcgacgtagccaaccgtgaagaagatagcatcagtcggcgtcataacaggccagctatgcaggcggaaacaccagtcggtggtggacgaggcggccggtcggtgaagacgtagacgcccaacaacggcggcataataggccagccgtgcaggcggaaacaccagtcggcggcagcgaaggcaagccggtcggtgaagacgtagacgcccaacaacggcggcataataggccagccgtgcaggcggaaacaccagtcggcggcgggcgaggcggccggtcggtgaagacgtaaacgcccaacaacagcggcataataggccagccgtgcaggcggaaacaccagtcggcggcgggcgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtgcacgcagaaacaccagtcggcggcggacgaggcggccggtcggtgaagacgtagacgcccaacaacggcgacataataggccaaccgtgcaggcggaaacaccactcggcggcgacggaggcgggccggcggtgaagtcgtagacgcccaatagcggcggcataataggccagccgtgtaggcggaggcaccagtcggcggcgacggaggcaggccggcggtgaagtcgtagacgcctaacagcggcggcataataggccagccgtgtaggcggaggcaccactcggcggcaacggaggcaagccggcggtgaagtcgtagacgcccaacaacggcggcataataggccagccgtgtaggcggaggcaccactcggcggcgacggaggcaggccggcggtgaagtcgtagatgcccaacagcggcggcataataggccagccgtgtaggcggaggcaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggtcaaccatgcaggcggaaacaccagtcggcggcgaacgtggcggccagtcggtgaagacgtagacgcccaacaacggtggtgtgaccaaacaaccgtataggcgaagacaccagtcggcgacgatgacggcaagctggtggtgatgttctgactgatccattcctggagcgtaagagataagcttaaagccatgtatcccttttgtgcatatctggatctggatcctgcagaacaaacatataggatgagtagtatctgatataaatataatactcgcgaaaaaatcaagtatctaaaaatatttataaatatgtatttcacctcttgtcaattttgatttccccgagcagatgactctgtacgtttaaacactctgtccgactagtcatagcccccaagcatcgggagtcgacctaggcatttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagcttcgtcgtattccctcgatgacagcagaagtagccgatgtgggaataaagcagtccatcaatggtgacaaaaacaccagtcggcgccagtggaaccaagccagtggtgtagatgatgaagcccattaacagcggcgaagtccgccaaccgtataggcgaaaacaccagtcagtggtggcggaggcaggccggcggtggagtcgtagacgcccaacaacggcggcataataggccagccgtgtaggcggagacaccagtcggcgatggtgaaagcgaagttgcccccaacggcgacataataggccagccgtgtaggcagagactccagtcggtggcggcaaaggcaagccggcgatgaagtcgtagatgcccaacagcggcggcataataggccagccgtgcaggcgaaaacaccagtcggcgacgccgaaggccagccggtcggtgaagatgtggacgcccatgaacggtggtgtgaccaaccaaccgtataggcaaaaacactagtcggcggcgacggaggcaagccggcggtgaagtcgtagacgcccaacaacggcggcataatagaccagtcgtgcaagcgaaaacaccagtcggaggcggcgaaggccagccggtcggtgaagacgtggacgcccatgaacggtggtgtgaccaaccaaccgtataggcgaaggcaccagtcggcggcgacggaggcaggccggnnnnnnnnnnnnnnnnnnnnnnngcaacggcagcggcgcacaccaaccgtggaggtgatgaaaccaatcggcagcgacgaaggcggccggcggtacatgtataaaataatagatcaaataataattagtgatctgtgaattaaatctaatttatataagaaaatttagaacgataaacctggtttgtgatccaattttgattcaaggcctgtcaatggatgaaccgtagcatgcagccgtgtcatgcagccgtgtagacatgtaatcgtcggtagcacatgcatggattagtttggagaccactttgtgcatgtaatagctgatttgtctatggattaatttccttgaccacagatttgaccaggtatatttaatttgtatcctggactttgtgtcttgccgtacgtatccgagtagtattgacttggtgatgtacaggctcaaccgacggtgatcttcgcatgatttcggcggcggctgcttgctgattgcttcaaatcatgccctggtgacgaaaccgacggaccaacagacatggcagcattgtagcgacggatttgatctcactgacagaggtaaaattgacgataacaagctggttgtagatcgattcgatcggtgattaatctcctggttgattgaccagatccagatagaatttttggcgacgaagaccctgcccttttgttgagaagatcacggccaaagacaagagtagcaccgatgacgccggcacaaagttccatcgcacttctcgacggaaaactcgacgcaacccctacctggcgcgccaactgtcgaaacatgaattcggcaataataaaacggggtagcgcacgagacctaaaagtggatggatgtggagacaaaagatttagacaggttcaggccctctcgatgagaggtaataccctactcctatttggggatttgaatccgccgggtgtattatagatctgacgatctagttgtctcatgccccctagagggcttcctgcccaccttatataggatggggggcaggattacaagatagaaaccttaaccaatacggtatcagtttcctaaatctactttacaatcttatcaaaccaggactttaggccgttccataatatatagggaaacgtaatacccaagtcacgatctgttacatattccatacatatatgttatcccctattactagtcggataaccatgccgtgtggatatggggtacccataatctccacataaggcaaatagtttattgattttaatgcatatgtgacatcatcaaccacattgtctaagcaggtatgggcgttattactatcattggaggtcacacactgatcaaggtgaggttataggactattgtagaggacctttgaggatatttggcattaacgtgaaacataactggaacacaacatacctcatgccgcgtcagctgaaagggtatgaggaaataatttatgatttgattgattcattgcacttgataataaattatgccgagatgaggatggtgatggtgatggtgaggttttgcttcttaccgaggaagaatgggacatagctatacgcatgtgtaaatttgtaaagccctttcgtagaacttcagttttgctatttggaatgcactatcctacttcttgttcggtgcatgaatgtctttggaagttatcacttatctttgaagaaaaccaacatgacaaaattttagcttccattgttaaacccatgcatgaaaaattcctcaaatacttcactgctattccaccattattgctttaatttggtacttgatcttcataaaaagttgaaaatcgtggagactactttcatatcattaggtgatgcaattgatctttgattattcaaaagtttatcaacatgctagagatgagttgtttagagttttccatctgtaccaaactaagctagatgttgctcactgggtgactgaggagaccccacaaaaaagaaaagcaaatcaagtgccctcaatttgtggaagaagatcaggggtaggacaaattggaacccggatgttgtcacgtcccaaaatgactctaaaatacatcctctaaattatgcctagaataattaaaaaactgtgtgaaagcctccaacaattaaaatgtacaaggttaaaagtcaaataaggcttagaggatttttgtatatttcctaaaagcctaaaatacgtaaataaattttagtggaattttcagagcacaaataataattgttaagaaataaacaaagttaaaaaggttttataaaaagaaaaaccctaaaatccctccttctctctaatgggccaaattcggcccatctctctccccctctctctcctctccccgcggcccactcggcctctccccgcgcgcgcgccgctgacgggcgggcccgcccgccaccctcgctgacgggtggggcccacccgtcatccccgacctcccgccgctcccgccgcctcccccgcgcctagcgccgccgccgccgccgaatccgtcgcatcccgtcgtccccgcgttcaatcaataggggggaattactccccgtgatcccctctccctttccccccatttttccctctctctctcgcgttcaaacgggcggatttgcccccgcaaatctcgccggcgccattgatggcggccggacctcctgcgccggtttccttcccctccggccgctctctcccccttccaaccctatttaaaccctccccacacctcctccgtccgtttc

SEQ ID NO: 33297 - DNA, 6790 bp, Oryza sativa
tttcccccttccctcccctctttcggccgccgctccgccgcgccggtggtcgccggcggcgaccatcggggcgtgggcgcgccgcctcccgccgaccgcgccggcgtggccgccctcgggcgcgccgagtggctgccgcgtggggcccggccgtcagccgcccgcgccctcgggtgcggctgacgtgtggggcccacggcgccggccggtgtgagcccgggtgcacccggtccaccgtggaccgtgaggctgccgcgtgggccccactcccgtgaacccggtccgcgcgcccctccccctcggctgacgcaataaaccctttttaaattaaaatttaaatgaagaaattcgcaaatattcatttaaagagcatataaacttcaaatggccataacttggccatttgaactcagaattggactgttaaagtctctaatttttccttaagaagtcaagaacccatttttgtactttgttcctgcttgttatatggagtttattagagtaaaagcccttttattttccattggtcgtatagacgctgcagcttcggaagatctgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattattaccttgttcaccctggaataaacaaaaccccaactagtggacactctactcatggtaccagtagtatgattttaggtagatgcttcgctggttaattaggcaacattaggtggttttacaactgtagactttgggaatattctcatcacctggacactatggaattgttggatcattgtggaattggattcacacctcccctctattcaaaaccctcaaaatggttttaggctgggctcgaggtgcatggttttgatagtagcacctcggccatataaggaccggtcctcggccatataaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaatgatgtacacctctgatcagagtataacctattcgaatagccgcgccctcggttatgggcaagccgagcaatgtacccaagttagtgtttttaattcttaaaacctgcttaacaactaaaatgtggaatggttgacctgggttggcttgggacgagctgggacccagggtcgggttaccagttcggtctgaatcatcgtaggccttgggttaaggcaggctcgtgtgggttcacggccttgtttaataatattatatagctctagaatcgtgtttacaaaatagctttgagcaactaagtgtcttttaatgctgtttactgcaaaccctaaccctttatactataacccccttgtactcccttgcatttattctgcacttatgggtgtgtcttgttgagtacggtggttgtactcagtcttgctcaatttttttcccaaacccagaagaggagcccctggacgatgaaggctttggtgtctagctcgtgcctgccgtcaagcgcctgtggtcgtcgccctagtcttccgctgtttttcgttcgtcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacagatgtagagcataaccattgcctcaacaccaatcacacaaaacataatggaacacttgatggcaaaaatgttgatctccttaagtggtggaattagactcttcctgtgtagctcacttcagacaagatgttatattggttcaagcatatatcctctatctctttaaagcaagcatttagccaggttggaagaattataactattgaagaactgatgagacagttcttcatgcctagcacctgagaaagttgagacatacttttgccttaaagactggatagaagcatatcaacaaactgttggtatttcttacgattacagataaaatccgcatgcgcacggatatacggatgtagcacttccactacggagtattcaatgggtatcgaatccaagggaacgtgtgagattaattcttcctccggttcatccaaggacaccaagcgaatgtaggcagaggatagagaggatttcctagtgagaaacagtgtctagggaaagcttagttttaatcctaacgcaatacttcaggcactgtcaacccgctgtttccagatgtcgctttactccgtacccggacagggaggacttaagtgctcttgagggctgtcaccacctctacacccaccaaaaacgtactataggatacgcagcaattacaggataataattacctctaaacaccatgtctaagcaattaaaatctactttagtgtttataactcaccaaagcaatcactatattttagttgattatagtgaacaataatcccgtatgctaattaggaactaaccaagagataattctcacaagataaatctaaattacttaggaaaataattctattaataatagagtaataaacagaataaaagagacaggaaaggattaccgacagatccggaattcctccgacttcttctactctactctcttcctaattctagtatacaaatagtacaatagagcctcttgtaattcagctcaagcttgggagtgtgtgtgggagtgaaggagtgaagctccttaaataggacagttaatgacggttggcgaaggggaaatgtccgaagtgccctccaaccatcatcagggatgcatccgggacgtccatgccaaaccccagcctgaacggctgagatgctgattcagtggctaggcccatctggcctggcctttggcccatctccccctctgatcctgctctatccaattctcggagttttgggctgattctccagtgttttgataaagttcaaagcccatccttgtatggatatgtttccttctccactttagtttgattttcctcccaacttctgggttcatcacctgcattgaataaataccaacactcatggaatatgttagaaataatccctaccactatgttggatgttttattatctggacattatgtagatgttggcgatataaatttagcacttaatagccgccaacacagatgcaacactggctagaggatctagagattgccgatgcaacagccaacacattggtggaatttggcatcaacaccgatgacaacgtgccaataagaattaataatgtaatatatgtaatagtgtaagtcaatcattgtactcttttccttttccggaggaaccctactttagggagtaaggtttttaacaaggtaacaactttgtatccctactatgaaatcaatttatttgcagtgcatatttttattttattttcctgcatagttagaggaggcaaaacaaatctcagtatcccatgcgcaggtagctgagcgaggcgagaaactgagttagaccatatcgttttccctctatatcatatttccctccgaaaatttcagaactcccaagttgtttctttttccctcctctgtttgcagattggccgcttagaacagccacaaaccagagcaaccagacaactagagtactagtgtcgattatagaaatcagcaatgagaaaagagttaacgcatgagatctagagtggatgagtaaagggacaagatttagacaggttcaggccttctcaatgaaaagtaatacctactcctattttggagattgcatccagtattgtattgatcttatgatcaaattgtggtcatgaccttgagaggctcctttccctccttatataggcttgggggtagggttacaagaaggaaagcccaaccgaatacgacataggtttccttatcctcttttactataaagttataactcactaactcctaaacttaacatgcaaagattctacatcatcatccattaacaagatgtcatatcatcatccactaaaaatcattaatttaaacatcatgcaaacatgctatattatctataattttataatttattaaattttatagcttttaaaatacaagcatgttaaatcatcatcccacataattcacataacatttcaatttatgtattcattatttttttataatatgctttgaacttatatagttcatcctcacttagttaatgttatttctctcctctcattaagtcgtatcacatcaatttttttagtgcttaagtgattaatctatggtccaaattatccctctccttttcttctgtctaaactatctcaatcttttctttttttgtaaagtcatatcaccttacttttacatttgaatcatcattctatatactatttaaatttaaattatcataagccatgttaacttacataatcttatgttgtctagctatcttacacattatttgtacttgttcttgtcatactaaactcccgtggcaatgcgcgggatttcacatagcacatgtataataactaagacttataaactataccttggaatacaagacaactcaactttcaaaaccccatggatccattcgtctcctatctccagttggataagccgtccgtgtaggtataggtacctatagggtttattaggttgctcgcatttccttagcctggtccagctccctcatctaggccgagtttgtcctagctaaggagatacacatgcaactgttttgttgtttgcattggttcagcctaattagcatgagattttgtttggttagttgcattagaaatacagtttaaatgtttggttacttgcattagaaatacagtttaaaagagattttgtttggttggttatatggatctcatatgtgaatacctagggtgagattaccacttagaactaatggatgaaaatttctaccatccaaaaactgatttttgtaattcaaagcagtttaggttataataaaatccatatattgtctaaagcaaaagaaaaatattgctagatatcgctgtgcacaagatgttgatatatgatgaatcggtaacacaaaatagaaaaagtaaaagagaaaacaaaaaacaaaaatcaaagccggtcaggtgttcagcttgccgttcaattcgctgctcccagcttaccgtccgccgctcgccgctccccgctcccagcccatcacagcagctgtggtgtccagatgaccagatccgacggctagctgtgacccctgtggcggccggaattcggacgggcaggcagtcggggaagggagacgttggtggcgacgacgtaggaagtggtgcagcaccgacgatggcgaggtaggcggagggagtgatagatacagaagtagatagtggctgtggcttctccacgaggtccacgcgagctccgccaaggcacttggctccgcctactccagatccagccctcatctccacaggggctgactgagctccagccgctcgtcgccgcctgctcacaaattcagttgttgtgagttgtgaccctgcagccgcctccagccctcatctccaacgtagccggccgagctccaccaagcccctcgtctctgccgtcttctcgccggttgttcttccctgcttgctcgtctccggcggtcggtggggacggaaaccgcggcttgtaggaggacgaggagatcaggagccgggtgagagcagggcaaatactcgggtggggcggtgaccccagcgaggccggtgcatgtgcgggtgcagcgccttgcactcgcgggtgccgcgcgctgcatgtgacgggccaggctgtgttgcgaagctcgattcgagctttttccctcagcctggctctgggctccgttttgcagccgctcgacctggcccaaccaaacgtgcaagcaaccaaacacaggtgaggttgcatcccagatgcgggccaagtgcgaaccagacaaccaaacacgcccataatttccacaaagagtgctagacaagcaggttgcaggcgaggcgagcttgccgcttcgtcgggccttgttagaaataatcttgtactaggtgatcatatttattttgttgcatagcatcacatttagttgtaggagtagactaatttagttgtcagctgcatgcattagtcgttgtggcatagcgagctaatctcccgtgaagcacaaaatatgttagagtgcttatagtagattggcagccaagtagtgcgtgcgtgcaggttggattagtctcaggattatgtggtgaattagtcttgcatgtattagttagttgcagatgcatgtgcatgcatgcaggttagttggttggtgcaagcaacgacgtcggcgaggactcagtagtggagatgtggcctgagtcaaacagttgcgatacttgtagagttg

SEQ ID NO: 33298 - DNA, 2377 bp, Oryza sativa
  unsure (1)..(2377): unsure at all n locations
cacaagttgttttggtgccgtaaagctcttgtgtgtttgcttctgtgtttgtgtttcttcctctctgcctcctgcctcgttcagaaagtgtagcctgtattcgcgtgagttgcttaatttgattcccaacaggccttctgcttccacgcgaggtggcctgtggctagcagagaacactgtgtcaccgtgaagcacgactccacgaccacaagcaggcgagcagcgatcttcttgtgcttctcttctctaggaggccagaagcgaatccacgatcaggagcaattaacaggcccgtcgggcttcgcagaagtgtgctctgttatgaaacgccacgagatttaacgtggaaaaccctcttaaaacaggagagaaaaaaaccacgggcgccagcctgaggtgaggttaaatcgccgcacgcgggcttacaagagatatatatatggtgggaaccctaaaagggataacgatccataccaaactggcatttattaagtgcaaataaatttggatcacaactcaacaaactccaccttaagacaaattccttcttgtagtatgaatcaatccttcaccctgaacccaccaaagccaaaaccactttcggcgccaaatagcctcttgggctaacccactataccaactaagcttgagcaaaactcaaacttagcaacaggaacaggctttgtcatcatatcagcaggattatcatgaatacttatcttgcatacctttagcttaccttgcgcgactacatcacgaacataatggtacttgatatcaatgtgctttgtcctctcataaaacatctgatctttagtaaggcagatagcactttgactgtcacaaaacaagttaatgcaagaatcaactccacaaagctcaacaaaaaatcctttcaaccaaactgattctttacatgcttcagcaatagccatgtattctgtttcagtggtagactgggcaacaacaggctgcaatgttgccttccaactcatagcacaactaccaatggtaaacacataacctgtgagtgaccttctcttatccaaatctgcagcaaaatcagaatccacatatccaacaagccccttatcagtcctgccaaacttcaagcaagcatcagctgtgcctctgaggtacctgaaaatacactgaacagctttccagtgttctttaccaggattcgtcatgtatctactaaccaaactcatagcatgagataaatctggacgggaacaaaccatggcatacatcaaagaaccaacagcactagaatatggaactcttgtaaagctgataatttaaaatgaggtgcaataggagtacaaacaggctttgcatcatgcatgttaaaacgctgaagaaccttcttaatgtagctttgctgactaagaaataacaaaccagaatttctatctctagtgatttccatacctagaattttcttagcagcaccaagatccttcatatcaaactcactactcaactgtttcttcaatgtagtgatttgttccttgctcttggcagcaatcaacatatcatcacagcaagtatataggtgatccattaacaaatttaatatacacacagctatcaaattcagacctcttaaagccatgtgacaacataaatgaatcaaactttttataccattgacgaggagactgtttcaaaccatacaaagatcttttcaacttgcaaacataatcctccttaccaggtacaatgaacccttctggctggtccatatatatctcctcctcaagctctctatgtaaaaatgttgtcttcacatctaactgctcaagctcaagatcatgcatagcaacaatactgaagaatgtgcgaatggaactatgctttacaattggagagaacacatcattataatcaacaccagcaatttgactgaaaccttttgctactaaccttgccttaaacctcagaggctcactaggagataagccctcctttctcttgaagatccatttacaacgaacagacttcttctgttttggcaagtgcacaagctcctatgtgccattcttctcaagagactgcatctcctcctgcatagttgagatccacttctcacggtctccagaaacaacatgtagcgcccgatccgtcgtggcgcctagcgggaaaattatctcctaaaaaccctaattgcgaaatttgtttcttcgcttgttgtctagtgtccgtgccatctcaagatctcaatccccgatctatcgtcgagttcaattccgaatccaaatccttccaaatcaaattcctccgcaaaagtccattttgcctcccccggggtcgatgggccgattntctctcggcccatcttcccctctcccccggccctttcccctctctcccc

SEQ ID NO: 33299 - DNA, 7512 bp, Oryza sativa
tcgaagagctggaaagtaaaggttatgtacgacctactcatccccttggggagccccagtgcttctggttaagaaaaaggaaggctctgagagaatggtaatcgactatagagccctgaatgaagtaactataaagaacaagtacccgttgccacggatcgacgatttattcgatcaacttaaaggagcaagagttttctcaaaaattgacttgaggtcaggttaccaccaactgaaaatcagatctgaagatatcccaaagaccgctttctcaacgcgttatggtctatatgagttcacagtaatgtccttcggactcaccaatgctccagcattcttcatgaacttaatgaacaaaatcttcatggaatacctggaccagtttgttgtggtattcatcgatgacatcctgatatactccaagaacgaggaagaacatgctgaacacctgaggttgataatggaaaatcttagggatcatcaactattcgcaaaattctcgaaatgcgaattctggttagaccgagtagcatttcttggacacgtgatttcctccaatggtgtcgaagtagatcccagcaaggttgaagctgtacttgcttggaacccgcccaagaatgtgtcagagatccgcagcttccttggcttagctggatattatcgaagattcattgaaggattctctaagctagccagacctatgaccgagctgttaaagaaggaaaagaaatttcaatggtctgcagcctgtgaagacagcttccaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgtgaagtatacactgatcacaaaagtcttaagtatatcttcacacagaccgagttaaatatgagacagagaagatggttggaactaatcaaggattacgatcttggaatccactatcaccctggtaaagccaacgtggtcgctgatgcgctaagtcgcaaggcctattgcaatgtagctcaaatacggcctgaccaagatcacctgtgcagagaattgcagaagttaatgctgaccgtggtacagtcaggtgtccctgccagcttgacagtacagcctaccctagagtcgcaaatccgggaggctcagaaagacgacgaagggataaaagaattaataaaaagaatacaggagaagaaagacaccaatttctccatagacaaccaaggcacagtttggtgcggtccacgcatctgtgtaccggccaagaaggagttaagagatctcatcctaaaggaagctcatgagtccgcctattccattcatccaggaagtacgaagatgtaccaagatatcaaggcatacttctggtgggctggaatgaagcgagatgtcgcagaatacgtagccctgtgtgacatttgccaaagagtcaaggcggaacatcagaggccagctggtctgctgcaacccctaccgattcccgagtggaaacccgttaggaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagctaaagaaatgtcttcgagttccagaagagcaagttcccctgggtaatatcgtgctggaaaagaatctgacctacaaggaaagaccgatcaaggttcttgaagaggcagaacgtcagactcgaaggaagaccatcaagttctacaaagtccaatggagcaaccattctgaagatgaggcaacctgggagcgagaagatcttctccgcgccgagtttccggagctgctcccttaggtgctgaatctcggggtcgagattcttgttaggggggttggtctgtagcgcccgttccgtcgtggcgcctagcgggaaaattatctcctaaaaaccctaattgcgaaatttgtttcttcgcttgttgtctagtgtccatgccatctcaagatctcaatccccgatctatcgtcgagttcaattccgaatccaaatccttccaaatcaaattcctccgcaaaagtccattttgcctcccccggggtcgatgggccgattttctctcggcccatcttcccctctcccccggccctttcccctctctccccggcgccctctctctctctctcgctctctcccccggcgcgctcccgctctctctctccccctctccctccgctccgccccgcgccgcgcgcgcgagcgcgcgtcgccgcgccgagtgcccctccctcgcgcgccgcacgcacgcgcgagagccgcgccctgcgcctctccgctctgcccgcgcgcgtgcgcgtgagccgcccgcgcagccgcttggccccgcgagccagcgcgcgtgcccgagccgcgccactccatccgccgcgcctcccgttgcgagccgcgcgcgcgtgccggggtggccgaccgcccggtcgccgccgccgtcagcctctgcacgcgcctgtcgccagtgtcgccgctccgctccaaaccgccccgccgtcatcgccgtcgtcatcgcccggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttctcctcgccggcgtcatcctccctgtcgccgctttggccgcgaccgccgagcgccagctcgcgcccttgaccgcgcaagtccgttcccaaaccgacattgccgcccatttaaaccccagcctcccctttcccttcctcttccattcgcctccgtgccattgctgccgctcccgtgctctgtctcgcctccgccgtccatcgccaagcgccgggagagccggtgcgttcgtggacgcggaaggggactccgggcgtgccctcttcttcctcttcctcggcccgaggccggagagatcactcccgcgccgtcggcctctcgtcaccgtgcccgtcccgcacggtagtgcctccctccgttcttcctcctcgctccatctccctccccttagctttcggtagtagctcgagtagcctccccgaagttagccggcgcagccccgaccgttgccgtcgctcgccgtgtgctcgccgccgtcgccgcccgagctcggaagcaccgctcgtcgccggcctcgctcggcgtagttccgcccaatccgacgctagcatcggattcccgtaaccgcgtagatgctctcgccgccgggaattagcccctagtgacctcgtcgccgtttcccccttctcccgccgccggttgccgccgccgcaatccgccgccgtcgagcaacccccggcaaatccgacccgttggttcgtctcccctcgtcacgtgcaaccgcccggtgtgctcgcttttacccgtatcgccgtggttcgctccgtcgctcgccgctgtcgaccgccgtccgttccggccggcgtcgtcgtctacctcccgccagcccgcgtggtagccacgtaggcgccacgtcggcgccagctcagcctagaccgggtcgagccgaccccggtcagtccctccccgtgcgcgcgttccaccgcgagccgtgaggctgagcgtgggcccgccgtacctgcgtccaccgcgaaccgcgtgcgtacaccacgtccatcctccaccctagcgccgcgccgcgtgctccctccgcacggtgagccgagccgctgacaagcgggtcccacccgggaccgcgcgtggtgagcccggtccaccggactctctctccttcctccgcgcgcgcgcgtcttgggccgccttgggccaccttcttgggccggccggcccgttaagctcggccgagccgccctttctctcgggccgcgccctagccgcccgaggaaagtctatattccctccctctccctttttcttttcttttcttttccaaaaatgatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttacttttcgccgtttgttgagttgtcccgtttcgcgtgtagttccggagccagaagacccgcagtgcgaggatttcgaggatcaagctccagatctcgagcaaggcaagccacctttgaacatcttgagcctatatttgaaatttaattatattgcttgcaaaatattatgcattgataggattgcacttaatctttgtcccgtctgcaaggcagattggcggacctgcctaatttgttgcatttgatccttcctttgttaattgttataccatgtccccttgtaaccacccagttgcgcctcgatattcgtgcactctatgcgagtatcgacggtcgtcttcaaaacttaaaatctgaaaaacaacttgggtaaaactttggttttacaaaagacttggaaaacccgacacctgggtcggtgcttgcgaactaaatgaacttctaaaaccgcggaccagggaacgtaccgggtgtacggttttcccccggacacaccccagttgcttcctctcgccgtggtccacgctttatccgcactgcgcggaagcgtgttgttggttcttccaccgtgttccgtttccaccacccagctcccccaccgccagcggcccgtgctgctgctggccctcgacaggttccgccggtcccttcgcgtcagccgatcgacgtttcttcgacagaggagccgactacaggaggcagccaggccgacgaggagtagaggaggcagtcttctgcagccgtccgtgtgataggcccttttgttctgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaattcagtttatacctagtgtgtgctatctgagttgctatttactttgctccttgccctcctaagtgctgatctgactcttaccccgccctcttctgggagtttagatggctagccgcccctgccgtgcagctcgtgcgccagcccacttcggttttgaagaaggtagagtcgaaccagaagcaaatcatgaatcagctaatgagcagtctcaccgcagcaacaattcgcaccgtactgtttcccgtaacgcagaagttgagcaaccccgccgtagcaaccgctcgcatcgcacagcttcccgtgattcagagatggaacagtctcaccgctctcaccgcactgctagtcacaattctggagaagaacgcctcccttccccacctcatgtggaaaacaacatgcaacacttaatggcagttcagacacaaatcttgcaaggaatagccgcagccgtagccggttatcagcataatgtgcatggaaatggccaccctcacatgggcaacaatagatccaagctgacagattttctaaggtcacgtccgccagagttctctcagaccgtcgagcccgtcgaggctgacgattggctgaaggatgttgaaagaaaattcaacttagtgcagtgtactcctgttgagaagacgctctacgcctctcaccaactaagaggacctgctgcagattggtgggagaattactgcaatggacaccctgaacccactaacattgcttgggatgagtttgccacggctttccgtgcagctcatgtgcctgaaagcaccattgacatgaagaaagaggaattcaacaggcttaagcaaggcaacaccagtgtcaatgagtacctaagtcagttcaacaagttggctcggtacgcccctgaggaggtggacacagacaagaagaagatcaggaagttcttgaagggaatcgcagttgggatgagactccagttgcttgctcatgacttccccacttttcaacacatgatcaacaaggcacttctacttgaggatgccagaaaagaggctaccgaagagtacaagaaacacaagtctaaccatcagggaaattcttcccgaggcgcgcctcgccctcgctacggtcaacccgtgcaataccaccagtcggtcactcaggctaaccgccagccaggctacgcccctcgtcctcagataaaccgtccggcacctcagccacagcagcgtgcccctagtggcaatactgcgccaaacagcgttacctccttcaagtcacctcaaggaccgtcagcagttcagtgtttccggtgcaaccagatgggtcactatgctagacagtgccctcagaatcctaccaacaccaactcagggcatgctaatggcagcactgccagaactcctactccagcggcagctaagtctcgtcctagcactcaggcaagtggacaaggttcacgtgcttccaaccactttggtcgaggccgtgtgaatcacattcaagctgaaaccgctcaggatgctccagacgttgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctggaaggaatataaaggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacactcctaccgcaagtcggtctatcttaacctgtttacaagtcacctccttggagtcggtgcccatagtttgtgaatatcccgacgtatttccggaagaattaacaagaatgccactagaccgagagattgagttcgccatagaactggcaccaggcaccgcaccaattgcaaaaagaccctaccgaatggcagctaatgagttagcagaagttaaaagacaaatcgaagagctggaaagtaaaggttatgtacgacctagctcatccccttggggagccccagtgcttctggttaagaaaaaggaaggctctgagagaatggtaatcgactatagagccctgaatgaagtaactataaagaacaa

SEQ ID NO: 33300 - DNA, 26313 bp, Oryza sativa
attcaacttccaaaattccccaaatctcgagatctatctatggcacgcttagaggtcattaatagggctttacttttcgccgtttgttgagttgtcccgtttcgcgtgtagttccggagcccgaagacccacagtgcgaggatttcgaggatcaagctccagatctcgagcaaggcaagccacctttgaacatcttgagcctatatttgaaatttaattatattgcttgcaaaatattatgcattgataggatcgcacttaatctgttgtcccgtctgcaaggcagattggcggatctgcctaatttgttgcatttgatccttcctttgttaattgttataccatgtccccttgtaaccacccagttgcgcctcgatattcgtgcactctgtgcgagtatcgacggtcgtcttcaaaacttaaaatctgaaaaacaacttgggtaaaacttgggttttacaaaagacttagaaaacccgacacctgggtcggtgcttgcgaactaaatgaacttctaaaaccgcggaccggggaacgtaccgggtgtacggttttcccgctcccgcacttaaggaccgattccttggaatttcatccgaacataggacaagtacgaccacatgggtggaatgggacacccctggctgagtaactagcttatcaggggagccatgatgccgagggacatgtggattcgccggggtggtgtcggagaggacccccctgggcttcctggcacagtatggtctgggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatgtcgtgtgggtaaagtgtacccctctgcagaggttaacaaactgttcgaacagccatgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcctgggtggccgtttgaaaagctgttggccgggtgccaaccttgttttaagatctaaagattgatacattgcacatactccgaccggtcgggacgcactatctcaaccgtgtcgtttgagaagcactcacctagatgtttttagaaaagagttcaaataaaatcaattacgaaaacaacagcctttccttgaagcctgcattaaacacttatttcccctggcttgctgagtactcccgtactcacccttgctctatataaatatccccccagttgctgatgaagatgaagcagatcctgctgatgaggagtttttccaggagcaagccggttacgatgagttttagggtttcggcctagttcccaagtcgcgcctgtgttgtttggtccaagtcctggcttccgtttcccttatgtaatgcagttgtgagctcgggatctgtccgcagcccaacatgactgtacctctactctataataaagagacctctgttgctgtgataatccgtcttcctgtgataccagtactgtttcctgggactggtatcgatcaacaggttaatttggagcgtcaagggctagttccggtcggtactagttcggggcgtgacacaacagcttcagtatatgtggctggctcaagagaaatctccacctgttcagcacaactaaaagcataataaaccatatcacattcctcaataaggcagactggagctccacaactcctctttgttctgcgatgtgcaataggttcatcttgtggctgcaaaacaagaggtgagtgctgaataatatcattaacatcattaccaacaatttcagtttcctgatcatccacgtgctccacctgcacgctaacatattgctgctcctcatcagaaccacctggtatgatatctgtgggcaagctatcattaaacataacagattcattgaaaacaacactcctgctcatgaaggtcttattagtttcaggattccataatttatatccttttactcctgaaccataaccaagaaacagacacttaatagctctaggctctaattttccattatcaacgtgagcataagcagtacatccaaaaactctcaattgtgaataatcagcaggcataccagaccatacctcaatgggagttttcttattaagtgggatagaaggcgacctgttgatcaagtagcaggcggtgttagcagcctctgcccaaaaacgcttgttcatgcgagcgttggacagcatacaatgagccttggagatgatggttctgttcatgcgctcagccacaccattctgctgtggagtgtacgggatggtgtgatgcctaacgatgccttccttcctgcaataatcatcaaaagcatccgaacagaattcaccaccattgtcagtgcgaagtacttttacctccttttcagtttgcctttctatcatgactttccactctttaaaagcagcaaatgtatcatctttatgtttcaggaaataaggccacacttttctagagtaatcatcaataatggtaagcatataacgagcaccaccaagagagggcttacgagaaggcccccacaaatcagcatgtacataatcaagtatacctttagtgcgatgaactgaggtattgaattttaccctcttgtgcttaccaaaaacacagtgctcacagaacttcatgttaccctgagtgcagccatccaacaggttcctcttcatcaattctgctataccacgttcactcatatgtccaagacgcatatgccacaggttagtcttactaggttcatctttagaaacagcagcagcggtaacagaaccatgtaatgtacttcctctaaggacatataagtttacagaattcatatcaccaatcatataaacgagagaacctttcgatacctttacaactccacctgaaccggagtatttgtatccttctacatcaagtgtgctgagagagatgagatttcttgccatccctggtatgtgtctcacatctttcagcgtgcgtgtcatgccatcatgtgtcttgatctgtaaggagccaatgcccacaatctcacgtgggttatcatctcccatgcgcacaacatctccattctgcacagacttgtaagaactaaaccaatctctgttaatgcagatatgaaacgaatatgcagtatcaagaatccattcatcatgactagcaacacaaccagcaaaaacgacaagacaatctcctgaatcagagtattcagcactagtaacaacagaggccttaccatcagatttccttttctccttatcctgcaccttccaacattcttcaatgaagtgatttttctttttgcaatacttacagaactttttacctctggacttggaacggcctctactctggctcttgtcacgatcattgctgtcgttgtaggttttctgctcaaatctgcctctgacctgcaatgcttcgcccttagaggacgacgcatcagactgaaccatatctttcatcttttccctgttttggagcgcctcataaacttccgctagggttagttcatcacggcttaaaagtatggtgtcacgaaaatttgcatatgaactaggcagtgagtataacagtaaaagacctaaatcttcatcatcaaactgtacctctatcgacactaggtcggcaacgatctccttgaagaccgatatgtggttcaacacagaaccactctcctacaacttgtgcgagaacaacttcatcttgatatgcatcttactggttagatctttagacatgcagatcgattccagtttgagccaaagttctgcagcaatcttttcctgcaacacttcttgcaaaatatcattagatagatgaagttggatcagcgatagagccttacgatctttccgcttctcctcagcggtccattcagtcgatttcttcttcccgaagctttctagcgcctcatcaagatccgaagtttgcgccagaacaacccgcatcttgacttgccacagcaagaatctcgtcttgtagtctagcagcggtagatcatacttcatcgacgccatcgcgaaaccctaatgtgggaacaagctctgataccacttgttgtgaaacgataagcgaacaaatgataaagaacaatagatcaatcacagaagacacgagatttaacgtggaaaaccctcccaaaacaggagagagaaaaaaccacgagcgtcagccagcaaaatatcttcactatatctgaggtgagattacatcgccgcacggcggcatacaagaggcatatatatggtggaaccctaaaagagatgacgatagcctttattaaatgcaaatgaatttggatcacaactcaacatgctcgatagtctacaccacggcttcctcgcgagttgcaacctcgcggattggtggcggatcggtggcaagctttggtggcaactcgtggcggcgcagtgatttcttcgatgaggatccatggtggtggcggcagctggctggcatccttggcgaggagtcgaacacggcagagacacagcaagcctatgctgggctgcccctgctccatatgttctgggccgtgcttgtgctggcccggcatgaacaggcccatcgggcaaatgggccatgccggcacggcccaagtcccagctctcgactgaaaaaggaaacggtctgtcattgtccctagtcactgacacctccctccatccctagtcacttcaacggattttcagccaccacggacaatgcgatttaggtaattttccaaccaagctaaaaacattatcctcgcttcattcacattcagcggaccgtctagtgaccatcggacttctaatcagtagacttatgttataaaagatatagcggaacgatgactaaccttcttaattattttaaacattaatcatccaacacatattagatgatgacacagaaacacactgttgaagatatatatgtgatagcttcgctctatttatatacattagagaaaaaatagttgtattcagtttacgttgcttgattcttcttccctctacatcatatcttcaaaaaaattcacttattaagaaaaacagtcgtcatccattaatgatttgatatgtcttcaccttggcaaagcagaagccctatagcgtcatgaactcatgatcattttaggtaccttaggtacgacactctttgtcacgcgtgtggattttcgcacatgtgcgttgtgtagaggggcggagaaacatcttccgagtcttcgttttttttaacaaaagatagatttgatggtctaaataataggtccacctattttagtgaaaatatgtgtacaaatatttttacataaaaatctaaaataatgggtacattatatagtataagataatgatgtaaactatattttatatattagaaactaatttatttacttctatttctatttttaaagagttatatgttgataattcaatatttgcaaagtaactattatttaaaaattattatcactaaaagtaatgataattgtcgtctcaactatatacatggaaaaataaaaattaaagatgtttttaccggtactttggtacgtcatccgtgtacgagtcagtttttaagttcgttcgcttttgaaaatccatatccgtatttgagtcggtttttaagttcattcgtttttgaaaatacagtaagagtcgtataagaaattcttttaaaaaaactcgcatgctaacttgagacgatcagactcataactgctcataattttctaaaaaaaatatatccaacggtttatatattggacccaccgatttaaatgaaaatttagggatagatgttttgtttttttctctgattttctactattttctctaattactagattgtcacatggcgacttaaaagcgttttgagaaattttaatggacttttagtatataatagataagattgttctccaaatatagcctaccatttgcttatagttttaactgcgccattattattattagtagttcctttggaatgctggatttcaaaaacataggaataggccgaaaaatgcatgattggaatgccatgtgttaaaacttttaagaatttaatacacaaaaatttgaatgtgttgagctatataggattgcaattaattcaaaggaatttgctcacctccaagactatgttccagacatgcaaattagagctatataggattgcaattaattcaaaggaatttgctcacctccaagactatgttccagacatgcaaattagaaaaaattcctaaggatttgattccttcaaaattcctatgaaaatccttcaatcaaaaggagcccaaagattaggattatgcaccagacgagtaacggagcagggtacaaattaatccgttagagattcataatgcgagaccctttaattactaaaatccatgaaaaccgacgatacataatttgcaaatcaaaatatgaatcccatgcaaaccgatcgaatagtaagctgatatccaacaagctcaaaaacaagcaggcctcaaagaaaggaaaacgaaaacacagtgagggagctcgcgcaacgatgccgcgcgcgttggattatagaaaaaccccaagtatattaggcatgcgatcaatgcaacaagcactattaaccggccaaccacacacacatgacaacactctcacagacaaacatacacattccacacaagcataagacaagaacatacagttgtcatacagctaggctatccctgtagcagttctagccattttatgctattaattttctatatcaaacgcaagctaggagtaggaggcacacatattacgtacgttatgtcctttgttgcagtgcctgcaaatcttggcagtaaaacagtagcaaacttattagcagttagccggcatggtgaggccacacttggctggcagctgcatggcgcggttggggtcgatgttgtagatgctgagccacggcgagttcttgtaggagcagaggcagttaaggtcggcgtgcgacagcgccgagcagcagcccgccgacgggttcgtcgtcgggttcgacgtcgccgccgccgccggctggcacttcatgaactcgtcgttgctcatgttgcacacggcgcgggccggcgccggcgccacggccagcagcgccgccgcgacggccaccacgaggacagccagcgccaccgccttcgccattgccgtcggctgctggagaggtgaggagctggatcgagctagctagtgactataggtgattggtacctggtggagctagctagctggtggctatctctagtgagtatgaaatggctggatgctttgtccgtgaccgggggatgggtttttataggggcgtgttcggatgggagattttgggttgaaacctggaaagtctgtggtttttcacaatgggtccttcggttgggtttcagttgcaactatcttattacgggatcgaactgtgccctacagtttgcaaattattggttcttgggagaagtcaacaaggtgatggattatatttggcatgctaaacagttttgtcgccagccttggcgaggacaaatatagcaatcagcactcgttcatatttgggcagggtttttttttttttctgatgcagtagtccctctgttccatattaactacctccatttcatattataagattttctaacattatctacattcatatatatgttaatgaatctggacatatatgtgtgcctagattcattaacatctatatgaatatgggcaatgctagaaagtcttatagtagtattaatttctatattataaattgttttgtactatattttatcaagttcaagtttctttaattcagacctagtagttaagaagaacgtagcaacgtttacaacacttagttatattcattacaattgaaaattgtgatggatcatcttaagctgaacattgaatatctatgaccagataatttttttaaaaaaaaaacctcaattaatttgatgccagcatgtacgcatggttagttaaataactactctctccgtttaaaaaaaaacagcaacctaataatacattatacacaactaaatactaccaatctggaccgtgagcaacatgcaatatcaggagaactcatgcgctgaaatgcgctagctctatatatccgtccaattgatctgcagtttaattagctggaatagatgcagagaagtatataggggaggcaaggttgggcagcccgtgaagatcccttgttgggtagcgctagcagcaggcacgcatacagcagcgcgcgatcatatcgtcgtcgctgcgtacatgtcagcgcggcgcgcgcggtagatcgctcgatcgatcatcccggtcccggccaacaaacacacacgccagcaggttcacgggcgcgcgcgacgacgacgcgacgagagacgaacgcgcgcgaccaaactccggccgggccccgcgcgcgcctaccggagaacttgtggccgggagggtttcccgggattcactgacgcgcgtgtgtgctgctccatccatggatagcaccgcagctatagccggtacgtatagtagctaccccggggccggcaggccggcctatcggagactgatcatcgagatcgattcctaatcctatggcgaattggcgatgcatggatatcatatttctcccagataggacgatgtttacctagctagatccatgacagtatgacactaatttgttgatatatatggaatgagccctcctcgtgcttggagtcgtacatatggtcctgtttacgccaaattcaacttgctgttgtatatacatactacttcatacattatataataatataataatctttcgctataaatgtaaacaagtgtttatttagatttataacatgctatgctatatttttaaaatgaatggtgtagtcatctttctgttattgaggatgtaccatgagcatgtccttttcttttttaccctgttcgtttttttagtactccctccatccctaatataagacgcggtcaaaattggcacggtctccaaaactaatcttttacttataatttctcatatactataagttttgtagcagttcttgaggggaggagataccatatcgtagctgtccattccaatcaatccaatggcctgggaaggctcggtacctgctggtaccacatcgtctgcaagagtaggtaccaaatgctgttgatggtgggagggcaaggttgtactttcgcatgaagttagcaagttagagcaaagtgttgtctatccacctcctcaaatcgagtgaaagctgtaggggtaaggaaaacacggcgacgatcttgatgcggccgatgcggtggcctcccgggcggcgatgacctcgagggaggtgggccggtggggaacgctgacaactttggtgttccctccctcctcctagttcgcctcctctcagctctctctctctctctctctctctctcgcaggccgtcttcccttccactgtctctcacgctctcacgcacgcagtctccacttcagcgcttctccaggttctcccctacatcgctaatacgctgctgcagccgcagttcagaccgagctgagccatgtcgcctccttttactctctggaaacctccaaagtcagccatctaccattgccgtggcagttgtccagttatgcagtgaagaggagggggacgtggctcagcatccatcagttacaaagccaattaagtccagcagcagcagcgagctcagtgccatctcccatttggggtcttatgcttattagcttcatcataaaacagttagtctattaagcaaaagtttatctaatcagtaccttaataatatgtaccaaaaagtatagataattgaaacatattattttgtcaagaactccagatgttgggtttctcccatccagatttttcaacaaagatgaatttgttaggttgtgcagcagctatttgcataatcgcatagatcaggttagcttttgctcaaatactgaccaaagcgtatgaaccttttcacattaaggatttgtaagatcttgtaccatctcacatccttttctttttcgctataactgaaatgttggaccctaatgtcagacttgtcttcctccttatgcttatcaccattgaagacgtacaagactaggtgcccaaacgtccaaacattatcaccacaatgaaggatccataaactttcctttttcctccccgacttcatgcgagccctcctttacatttttttacttactatttcttttcttcatccttttccattccactagcctaatcgtcggcaagctctaatcatcgttgtctctcctactctcctattcgccgccaccagattatccccttagagatgtaggcgacacttgaacctaccgcgtgcgcgccgcgcgcctgctctcatccattcccgtcctgacgaggccccaaagctggatcgcagctttgtttgcagccatggcgtgagcggtgtgcttcagcgcttcaggcatcggcacttggcagggtggagcggagccacggactgggacggaattgtttgggacggctggacagcacgatgcggaggtagaagaagatggaggcgatgtcaggtgtaggagcggaggggtagaaacacgctattccaatcataccctttttgaatcgatggatagatggagtcgatacctagcagtacctagtacctggtggtacctttttaaggatagtaaaaatcctctaattaaaaagcccagcatatatcctccttcaaattaaacgtacaaatcatcgcaactccaaacattttcagatggcacgaggctctttttttaatgtaggtgaaaatttactgccttagcactggctaggaatacatgtaggctgggttaaactccattatctgatagtgtggactgtggagtgctacatttgtctgttgactgacgtttagaagtatgcacctcgctccagcccccactagcccagacccttgcgcgcatcctgaagcaagcatcagaaacggttctgggaatcaactgacagaaccactatttgtcagtcaactgacaaatagcaaaaccatatctaataaagctaggaatacacggcccaaaataaaaggtgaaaacagacgattaacaaaaaaagaagtaaaagcttgagcaaagaagatgttaggcataaggaatacacagggtgtgtttgattgttcgcgtctctaacctgatctaactctctcgtccaagtttaacctgaattaattaggagatacacatacaactatttggttatttgtattatctagaatggctagcataagattttattttgttgctcgcacagacataatgtttgaaagatattttgtttggttaatttgtggtgtagatcaatttaattgtggttaccagctgggtgagattaaaatttcagctttcaccgaacggtcgatttgcacatttatcacatacatggaataatttccctacataaattttgtacagatattttttaccgcaaagtagcgagaaaaaaataaaacacataaaggagagaatcagttatggtcgacgagcattgccaccactaacgccgtcgggacggccaaatccggcgactacgagctgaaggatgccggttctgacagcagcgagcttgtggacaccggatccggtgattcggcggctgaaaaagcagatagtggtggagtttgatgggagaagaaggacggcaatggcatcgatggtgaaaaatcaaagcataagcatagtggaggagcgaaggtagctgcatatattacaaaaacaattttctcacacaagccctcttctaacctataggcaggccgataggccataacatcgtacacctacgataatgttggacagggagggggacaagacccgtatataaaaaggagggctgctagagagcgggataccgtccgaacaggatactttatggaggctaacgtcatctcacgtatctgcttcctccacgtaagtctagcatcatcccaacctcactccacaagctcacattccccatgccttaagctagcgccccgtgtcggcgtaggcaacgatgtttgtcgcggcagcagtagaaaggtatgaaggctaagtcgagaggaagggataagaggagaggaagcgttggtgcttgatacttgataccttgcatgtaccagccctggtacatagggtaccaactctgatacatgtgggtatcagtcatcataccacaggtactagcccaaatacctacgggtaccgggtctaatacctgagtatcagctgtgataccacaagtgccaagcatggtacgtacatgcgaggacaggtctgatacttgggtatcaggcgtgataccacaagcaccaagcatggtgtagaagatacatcgcacgacttacctgcacacactccggcaaggagcatgatggctcaccatcacgtcgctaccaatggaagcttcattggtcgcacccctccatcaccattgacaacgtgcctcgaaggaggaggctgaggaacccacatcggtcaacgtccttcccgacagtctcccttcttcctggttgcccccttccgtcatgggagctagatccattgggtgtcgtcatgcctcgaaagcatgagacgaagtactaggaggccacgagactagttccacccactgtccttgttgtcgacgtgcactcaagccggatccagtaccgaggagagcttaggcctctagatatccatttttgggggacctgctccaccgccaccatgcctacatggagaagctctttgcagagaggaggaaaggaggggaggggaaaaagaggggcgaaggaggtgaggcggaagaggaggacgaaggttcgagttgataaagagacatgaggggaacggataagactgaatcattatccacttattccatacccacggaatactgtagagtagtttttctgatacaaaaatcaatttttgcagacgagcctcctaacatgcctgcctagcacaaggcaagctgccatgtcccctcccatcttcttttctcttatctcttaaaaaaaatctaactctcctctcactccacactctcctcgcccctctccttccttctcctctcctctcctcaccctctcatccaccgcccatccttgacagcgaccgcagcggccacaatgacagtggtgacaggagcggtcacgatgacacccgaggggcgatgtgggcttgagctagcattggtggccttgcagtaggcagattgggcctcctaacgattagatatgacgatcagatctagctccgcgacgtctggatccaatgccagccgatggcaagccgtgcggcgacaactgcagctagggcgggcaatgacaacagcggcaagccacgcgagggcagaaccggcggtgacagactcgggagcgactgatccaccactcctagccctaggagggatggatccactgccgctagcctcagcaacgacggggcctcggcgacgatgactatgactgctccctgtggtgataactggcagcgtgggctacaatgacgacgacgttggtggcaagctgcgtgacgacggatccgtccctggcatcaggataggttggaactgccaccgtcggcattgggagcagcgttgagtacggcgtcgacgatgacggcggtggatgggagctagggttttggttttggggattacttttttttagcaatttttatttttcaggcgggcatcataactgatcgcccgtgtaaagtgattttcacacgtggctgagcctcccacttgaaaaaatgtagatttttatatacatctcgatgaagacaggccacccaacagtttgcaaatattagttttgtccgcttgaaaagatcattgttttgtaaactgttgggtggcctgtctgcatccgtcggtgcgagctaacctttatcattgtcaagcaaaaacattcatattgatcttattgatcctgttgctcgccgtccacgataagaggctgtgcgtggaattaagaatagactacgtatataatatataaagaagtatacgacaattggtttggctgccaaaaaaaaatcacctttcgccgttaagaaaaatcacttccataatagtataggggctgattggccaaatcattcctgcatagtagaccactcgaccttcacattgtataggatgtaatggtattgcatctttatttggaaatgtataatcatactaattttgtattcgcataattgtcgactcaggagcatcatctgcggccgaaattcctactcggatccacgtcgtcacaagaatttgtcctgtgccgatcgatagacgacagtacttggggcagcgacggcacaacatcatgcgcttatggattgtgatgtgactataattaaattgtcgacgagatcatcaaacagtatgtccatctcctttattttttttcccgttgtaatttgttctcatgttctcgtagatgtgcatgcatgtgatcgatcttcctatctttttttttctccccattcggtagtgcgcagtgacctaaaataatttctctatgtatatatatattatatgtacaaatttaattaagcggtgagttggcgtatagctagccctgccacgcaggaaggagagggacgagagagaaacacgttgtgctaaacgagaaagctagcgcatgactaatgtagttttaattttaatatttttagaaaatttatttaatatcttaaagcatatagaaaacttttgcaagaaaaccgagataaaatttgtatctttaaaactagatctaattcttctgtttaacagttataggaatagcaaatacgagggaaactcattctgatggggtgaagcaccattgccgtccgtaagacctgaaaagccatgggccatggcactatcaagtgccaagtggtcagcaagagacatgtccaacggatctattggtcaaagacatgtccaacggatctattggtcagagacatgtcaaacggatctatctgtgagctataatgagcaaaaatgacagcctcatcgtttggcatatacacctttatatcggagaaagaaaaatcttagagataaatctttctagatgttggtattttaagacaggaagtactacttatcagcggacaaaaataatttataaataaaacttatatatgtgtgtctttttaatttaaaagataatactgaaaataaaatatgattaaaaacctcaaaaatctttcaattataaaatttaaattttgactgtcatgaattaatatggtgcgctcacgaactgtgcaagttaagggatgggaatggtctatgtaacactatattaatgcccttgttttggtttctggcaaaggaaaagacctctatctggcattcgactactctgttcttaccattcctcctgagaagcgatctcaacagacaaaagacacacagttcatgatggtcaatggccaacctatttcagaatgacacaccacatgtttaacaatgaatctggacccaaactattttatataataaataatatctactacctccgttttaggttataagactttctaacatagtccacattcatatagatgttaataaatctaagcaaatatatatgtctagattcattatatatgaatatgggcaatgctaaaagggatgaagtagtaaacatgagaagagatttgcaaaaataggatggacacggggagaagcagcgtccaggttaggacgtcgttgtcaaaagcgtccaggtctgcacgctgttgtatatagcgtccaagtctacacgccgttctagtagcaaaagagagataaacaacctatggtcgtcctccagatcacacgcgcgtcgcttggaaaaaaattctatgcggcagtgccgcacaatgcttctcgtgcaacaccacgtgagctggtgccacgtgtcccatctcctgctataactcgagtctgttttcgagccgagccgacgccgcaggctctagagttagttctaccgccgcgacgccgccccaaaatcctttccgccgcctcatccccgcgcctagctgcagcactcctgtggtcctgtcgtgctatctgccatggacaaaccattagaatctccactctccgcttctccgttgacactgctagctttcatttttcttttcctattaagatagcaaatgtctagtaagtcaccgtccgcagtaatattcagtaaattactactataattttcaaagagctttagtgacacatcaaatgaaagaacactaattccacatccgattccaacaagataaattgcaaagagaagccatgaatcagctttgaatatcacaggaatcagccttcagtatagcttcagcaaacctgacattagctccttgccgttgtggtctgctgcccagaaacacatcaccacggtcaggtctgtctcaacgcagatggcaccactgatgcgaacaagcttcgaggagggcagcggggcccctcaaggctcacagcgtgtcgtatggctgggtggtgggtggggcgctgttcggatgggtggagggcggagccctgtagccaccgccgccgccgccgccaccgccgtaggagtagatttggagtggtgaagaggagtgctgcaggcgtgggaggaggcggcgaagaggattttgggagcgacggtagaactcgactcctgggcatcggctcggctcaaagaacagagtcagtccacagcaagagacgggacacgcgtcgccagtccacgcggtgtttcacgagaggccttgtgtgttggatactttgattaagttagcacctgttctaccgctttgttagggtaggttttatctcctgtcttttacttgcatgttttcagggctcggttattagaacgagcgcgtccataagccccgtgcgtatgttcacggcgtggcagtaatgtagcgagtcgcccgctgcacgatccgatcgtgtgcgatggcgcacgacgcactgggtcgtgtggcgggcaatgcggatcacgtcgatcacgttctcttgtatttcgcaaataaaaggagaagtaaagaaacagaaaagctgcgccgtattatgcagcacaatctctgtgtgcaactgtgtcttcctcgcgtgcgtgtgtgttgtgctttccagtgatctcgccggcggctacctcgccgggcttcatttggtatcagagccatgtcggctccaacgccacgtgtgtcgcggtcccgtgaaccgcaccagcgacgtatctcccgttcacctccacaccgtcgtggtcgccggcggcctggcgaagaccgtgaacttattccggtccagcgtgtggtgaaggaggtgggcggctcagccaactatccactgctgacgaagactaactacggagattgggctctcatgatgaaggtcatgctgcaagcgcgcggcctgtgggatgccgttgagcatggtgacgccgatttccaggcggatcgaatggcgatggaggccatactccgggcggtgccgccggagatgttagcttcactcgccgtcaagccctcggccaaggaggcgtgggacgcgatcaagatgatgcgagttggcgtcgatcgtgtctgcaagtcgaaggcgcaaatgctgcagaagcagtatgatgcgatggagttcaaggacggggagaccgtcgaggaattctcgttgcgcctcaacggactcgtcaccaacctcgccacgcttggagtccatcttgaagaaggaaaggtggttgaaaaattccttaactctgttccagatcatctctcgcagatcgctttgtccattgagacgttgcttgacctcgatgagctcacgctcgaggaggtcaccggccggctccgaaacgctgaggagaagctgcctgccaagagctctgctgccggtgggaaactgtttctcactgaggagcagtggactgcccggtggaaggagaaacaggccgcggaaagttcctctgggaaggcgaagtccggcggtggcaaccgtcgtcggcgtggtggcaagaagaaagctgaagctgctgcgcacgatggagatcgtgccgggggcgacacgcaggaagggcgggaaccaaaccgcgacaagtgccgcaattgcggccgcacggggcactgggctaaggactgccggaagcccaagcggcctgccgaggcccaccaggccctggcggatgaggacgatgacgagtcggccctcctcatggcccatgtcgtcgacgctgctcctgtgtctgcgtcgtcttcatctgcgccacctgcttcttcgccgccatcgcagcctgacaagacgatcgagctcgtcgagccaaaggtgttcgcgcaccttctcacggagaaacaaaccaacggcggcgtctggcatctcgacaccggagccacaaaccacatgacgggcattcgcgaagttttcgctgagctcgacctgtctatgcggggctcggtgcgattcggcgacggctccgtcgtcggaattgagggtcgtggcaagatcatttttgagtgcaggaatcaggagcaccgagcgttgacgggggtgtattacatccctaaactcaacgccaacttgataagtttgggccagctcgatgaaaatgggtgcgacgtccgtatctaccacggtgtttgcacgatacgggacccagcggcccagctgctcgcacgcgttcggcggacgcggaatcgcctgtacttgatcaagctcaccatcgggcaaccggtgtgcctcgcggccaaggcgcaggagtgcgcctggctgtggcatgcgcgctacggccacctccacttcgacgctctgcgacgactggcgagccgcgacatggtgcgcggcatgcccgacatcgatcatgtcaagcagctgtgcgacagctgcgtcatatctaagcagcgacgcaccccgtttccacgccgctccatgtttcgtgctgaggatcgccttgagctggtgcatggcgatctgtgtggtcccatctcgccggcaacccctggaggcaaaactcatttcctcctgcttgttgatgatgcgagcaggtacatgtggatcactctgctgggacgcaagagcgaggcggctgatgccatcaagcgctttcaggcgcgagccgaggcggaatccaagcagaaattgcgcatcctccgcaccgacaacggtggcgagttcacctcggtggaattcgccacctactgcgccgaacagggagtctcacgccacttctccgcgccctactcgccccaacagaatggcgtggtggagcgccgcaaccaaaccatccttgggatggctcgcagcttgttgaaagccaagaacatgccggcacgctattggggggaggctgtcacgacagcagtttttctgctcaatcgcgcgccgacaaagagcttggccaacatgacaccttatgaggcgtggcatgggaagaagccggcggtgggttacctgcgcacgttcgggtgcctggcctatgtcaaggacgtgcggcctcacctccccaagctctctgaccgcagcaagccgatggttctcatcggatacgccgacggagccaaggcgtacgaggtgttcgatccggtgtctggacgagtgcaggtctcgcgcgacgtgattttcgacgagggcgctgggtgggactgggatgcggcgggcgctgcagccgtccccggcggcggaggttgctcagacttcaccgtcgagtacctgacaacggccacatcactgtcgccttcgacctcggctccatcatctgcatcttcgggcgcttccgcgtcaagggcagtcacgccgtcgtccgcctcgacacccgccaccttggcatcggcctcaacgcccgctacaccgacattcgtctcaccgccaccaggcatcgacgagaacctggacgcggagcaggatgattgtccactgcgttatcgcagtatgggtgatctactgggcgacgcacgtacgcctgggttcgcaacccgggatccggaggaggggggggcttcattgtgcggcactgccgcagagaattttcttccgcgtcgctctgccgactgctgccgctcgcaagcgctggtgttgctcaccaactagtttgtactcgctacctcgatccgcttcgccgaattcgtccgcgccttggggttggggaccgcatgacgcaggtagacggacctcgtgggtaggaacgcctgcgtcgtcgctgatacttctgctggttggacggttgatcatgcggaactgcatgcatgtaaatgagtgaatccaacacatattccattcccacatgcacaaacggttccatctcttttgccattcgacggctgtatgtatcatgtggagttcagtatatatgcatgtatgcatcacctgatactatgcacgcgtcgaagaaagctgaggcggcagcctcgcgcgtgattggagggccgcgccggccgacgcatcgcatgactagtgccctcgggcaattggacgagatgcgaagccagccagtgacgtgtggagctccccgctcgtggacgagggcaacgacgacgtaccgccggcgccgataactaggtagtcacgttttttttcttttctcccctcatgtgccttccttcacaacaaacagatgcttggacgctgtctgcgtacggctgttcacaaggacgtccagacctggacgctatttccctcagcgttcatcgtgttgttaaaaatttatatctgatttactatatatttaattcataggatattagttattatatattaaaaaattcggcatataagctgcacgaatatttgcaaaaaacagagcctagaaaattaatttgttgtagggttaaatgagttctacggaaattcgtaattttttttatttcaaatcaattcattaataaaagaatacacaatctcaaaatcctataaatttgctattatcgacaagaaggttttctatacactataactgccttgatctaaatattgtttgacaagcaaattatccccgtgtcccttctgtcgtgctgaatctaggaattgacaggcgataaaattcctgacgaacttagatcgatgctatctaaacaaaaaataatgggacaaaaattagaggaattggaatttccctgttgtgtctcacgctacctttgtgcatatcgatcaactagtgccttcgctgcatcaggtgcgaaaaatttggcctgcacaggaaagtcaatatatctgcattagtgaaaagagaatccaaagttgtcaccaggtgagccacatcatcaaacaaacatgaacagccagatctatgatttggataaggtactccatcattttcatattataagtcgttttgatatttttcctagtcaacaaagtttatagaaaaatatatcaacattttccacgcaaagcaaacatattatcaaaatatattaaatgttacatttgataaaactaattttgtgttgtggatttgctaattctttctataaattttattaaaactaaagaagttcgactagataaagtcaaagcgacttataatgaaacggaggaagtagtgaaaagagaatccaaaaataccaccaggataagcacatcatcaaacaaacatgaaccgtggatgcgtgatttggataaaaaggaacattggatcataggaaaaaatggctatcaaaatagggatgtttctaacccttcaagccatcccatgagatgtggtatcagagaaaggagaatgaaaaaaaaaatcccttacacattgaccatataataattatttaatagtagttctattatatcaataataatgagtatttttaatagctaattaacctaatgctatagatcacatggcctcggttacttcactacacctaaagtacatcatgtggcacaggcatagtaaagtttataaagttgttttaatataggaatataagacttacagtaaatagcatatagatatttctcaaacagatcatgatagccttgcaacatgtaatggatgtggctatatacattattattacaaaacgtgtatgacacatttagaaattgagaaagttagtggtggtggtaatgtatgataaattatttgtgttataatagtattattaaatcataaatcaagataaattcgttaacattttagctaaacttccttacaaatgatgttctaaaaatgtatttacattgttgacttaaaatttaagctaattaatataaactatatacaaacacattaaatagacaggaaggttatatatagtcgtgtaaacacgcgacttaataggctagtatgtctgaagatccaaaacatttgcttctattgattgctcccctattcatttagagtatttttctgtccaagacattgtttggataggcttaattatcccttggcctatccatgtggatgtgcggggattgaagcacagccaaacaagaccaaaatggcataaacatgtatggctggtgggatggcagcaggagagtaaccaaccaaatttgtagatccttaatatcataagcactgtagttttatttattactcagaatttacagcttcaggtttttcttaaaaaaattgagtaaatttcagaaaactgcaactttagtgacaaaactatcagtttgctgcaataatagcctgggaaattatcacaaaactgcgacttttacgttatatgctgttacagtacatataggtgacaaatgtagcaacatataacgtaaaagtgcagttttctgataatttcccacgctattgttgcaacaaactgaaatatgtccctaatgttgcagcaagctgatagttttgtcactaaagttgcagttttatgaaatttactaaaaaattataaggctacaaattttaaaaccctacaggtctgtagtccatttgcacttctgttaaaacttaaaagtttagcatgggagacatcacagacaaaacaatacctgaataaacattctctctgcttcacctgatttaccattttcctttaatatgattccctgcaagatggataaaagaaaaaggatggagattaccagttatgtaagaaatccgaattatgttaatacacaatgtatgttttggatagtggttttgcgtattcgggatcttaaacaagcggttttaaattactaatacaatatatttatgtatcatcatttgtaggttgtttatacagtgatgtcatactattgttacgttagtactttcttgttagtgagagcgaacaagggataaaaaagaaagatttaagtgaaaattttaacatatatatccaatatgtatgtcacatgatcaaagctcagccagcttatatgcagattaaataaaaaccactttgtaaaccaacttagagggccatataaattttaatcaaagtctagggggttatttggactttttcctattgaaaaattagatatattggtttagcatgccaaatatattgaaatcattaaggtcagtgattaatgaattgccttatccaaaaaaaggcttcattaaagctcatatataaagcacaagattgatcagtaccttagccaaataaccacggaagtcttcaggatgttcagtgattagattttcataaacagcaacagcatcactgatatggccccaatcagaataagcctttcctaaaagcagatcaacctgcaataacatatgaaaataatttaagacttaaattcacagctaaatcttcctcttaaccatcagctactaaaatcatgtacaaagaaacatttaggatcaaagtctatctgtaaataaataatgttatttgacaatgcttaattgctcttaaattattggctcgcttgcgtacatgacacttttgttgggaaaaaatgccctcatgccaggatggcatactctcatttgccacatacttgcttatttaccatgtttgaccttttcaactcacccaccaattgccatgttcttcttcctcaacctctgtcacagcctggcaaaggccgaagatttgtagtcgtgatagccagccagcctaaacctcagacctcccggtcagctagacacgatggtacgcaatcagatggtcctctaacgtgcactgcccacagaagaattgctcacagcagataagccatgtcaggggccagggggtcttcctgtcgaatgtcgggaagtaccacttgtgttagcacaacgcgcccatctggtggtctacccagagccgaagatagtcgggggactggaggaggatgcctttgctcaccgagaaggtatcggcattgcatgctgatttactggcctacaaacgactgatcgcaaggtgatcaggtgatgttctttttgctggtgattgatgtcaccaagcttcgactccaggacgtccaacttctccagcttcttgaggatgaccaccatttgctggcctaaacctttcctcgcttccaccagcggccgacatgtctacagacgcaggagtttgctctggtaccaagttgtcacggcctggcaaagaccaaatattgtagttgtgatagattgctggcctcagccccaaacctctcagccaccagcaaggtacgatggtaggcaacagaacacaaaaaagaacgaagtgcgcattggaagggtgcacgggagggagagactagttaagaggaacaaggaaataaataagctatccaaacttgacatgagaagataaacctaaactgataaaatagctatccaaattcgcaccattggactccaaatgacgccctaggccatgccttctgaggacctcaagctgcccaagggcaaggtgctcgacgtggtcaaggacaaggtccaccggcagttgtatgaggccttctcaagctcgttctgtggcaccccgtgtatctcatcgccagcaagcagcaatggaagcttcattgacctgcgatgcagtgccatgccaccagaccggagaagctcaaggcattccacaacacaccgtactagatgtctggacatgttcatagacatgatcatgcagccgtaaggcctagacctgacgctcatggaaagatggatcggagggcaagataaatttggaacttcacgtcgtgttgtggtaaaactttgtggcatttcagtaaagccaatcaattatgcggcaaataagattatggcatccaactttgtggcataagagcatctgttgacagtatgtgcgtttagctaacttatgcttattagcatttggctttggcctaggacattaagcaagtcaaattcataacatgagatgaaaccattatagctcttcatccagctcttgccgccaccacagagtttatcacaagtcatttcaagaactttctcattattgcctatgcgccgaagaagctcacctccatgctcatgcatagctgctctgcatgacaacccggcactatccatgtttgttgcaataaggactgtacctacaaggctacaacaatagcctgccccttcttgttacaacctagagtcctgcactttctgcttcgctcaaaatcacatggatcgagtccaactagggctgtcaaaaaaactcgaggctcacaagttgctcagaatagaacgagtcaaaccagagcctacgttcaaacgcatgagctttctagagcgaagctcattgtctttcaccccattaatatttaggttgttgtaccctttctattcatgttactccaatcatgtaagagtcattctaaatgaaaagggtgtgttagcgatcataccaccaaacattataaggatatcctgtgtagttttcaacaacagtactgacacgaatatgatggcatctgctcttatatagttcatatgaccattgtttagtgctacactaaaataaatctaagattgctactcattggtcattagtagactatattactaagtttatgaataatgctaagcatgatcctcttgtaatattgtttgcattagacctagcactgatataatttgtcatttctacatctcagacaataagtagaataccacatccaagtggctctttcaatacttgtccatttggattgtctgtcaagattactaacatgtattttataaaatataacatgtaccaaaatattgtaaaatatagcagtaaacttacttggataagatcaatatattgagattttggagcaccatcatcatttgcagccgccaaattcgcaacttgagtttgacttttctcatt

SEQ ID NO: 33301 - DNA, 2190 bp, Oryza sativa
  unsure (1)..(2190): unsure at all n locations
acatgtgctagagcttcagatcatgtatccatgaacagtaccaatgaattgcacagagcttctctatccaaaatttctacgctataaggaatttcttgtttccttagtgcaagtccaaatcttaacctagacaacttcataattaaacaccacgctgtatggataactcttgttataatggatagatagaatgaaagaatgtgaactacacaagttcacgataccctctcaataataatttatcaactgacctgatctggcttcttagcagcaagtagtgcattggtcagaccacgtaaaacttcaaaatcgatattctctgacgcctgcttcatgaagtgttagcattagaaaaccagtatgataaactagaatatatacaacatagaagtgcatttcaattttcttacagataaagattttctgtatgatgaagaactcccatcataatccttgagttcaaactttacttcacccaacaaacggtatgcttcaactttgtcagggatcacctatatcaaaataaattgtgtttcaaccatataataagtgcataagcaagacaaactctaaatgacaaatacaatgggcaccaagaatagcatgcagcttaccttaacaagcttctctaggaattctgaagccttctgatattcaccaagttcaaccaatgatactgccgcaccctgtgatgccatatgaaaattacattggtatttaaaagcgcagtagtagtcaaagtcaagcaatcagtaattagtgttgaagtattcagttacattttgtgattcccaaaaagattgattgcttttggcttggaatggaagtggatgatgtatcattgttggattcatttaagaaggtgataatcaaggtaccagtttaagtggtaaactcaatgtgcacttttccctcttttttggtctgttcaaatcttctcacattaaatcaaagaataatcttgctatatgcatgactaggtctagattgtgagccacttttaccatatacatgacttagattgtaatcatctctacatttgttctactttgtggaaactagattaaatcattcatgtgacttcattgatgaaaaagaatggtaatgcctgacaatacttttagaactggcccaaacaaatcaatctacagcaaccagataatacagctaacatctccaagtagataggatcatatctcaaaatatgcctagataagatatgctactaaaagataagatatcatcggcatctaatgttctaatcaggtgttacagtgcctacttactgtttgtgaacatgaacagtaaaccctgcatgtgacaacataaaagaatattcttatcgtgcaagtttacatcaggttgatatacagggcaatttggttacatatgccagactttgccatagttttgtcaaaaaaagtgtgtcgcatgccatttgtggcaatatttggaaagaaactatctccatcttgtggccttatgaggtatggttttaagaaagtgttccatgccacaagttcagcaaagaactaaacattagattaacaatgtcaaacatttttaactcatgtagactagcttgtagcacgaacaaaagcccctaatcatgatagaatgatacccatttatgaaatttgtacattattacaagctcatttcaacatcagcctatgcaccagataatgtaaactacagcattattataatatcatatgtcaacaaaatgcagattgagaaaagaaatttattggggaaaaaacagtattaagacaaccagaagtacgttggaaataataactcacctcaagagcagtaggatcattaggtgatgtccgcagtgttgcttcaaaaccttctagtgctgtctaatcaaaagaattggcaatctcttaatataacaacaaactgtcaaacaagaataaaaaattatatgtcaaacatatgaaactaatctcccacagatatactagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33302 - DNA, 4872 bp, Oryza sativa
tgtctatgttgcctcttgtggaatggtctctcaagaaatggtggcgaatatctatatgtttggttcgggaatgttggacgggattattggctatcttaatggcgctctcattgtcacataggagtgggattttggacacattgaggccatagtctctcaaggtttgcttcatccaaagaagttgagcacaacaactccccgccgaaacgtattccgcttcggcggtggatagggcgacggagtttttcttcttggaagaccaagaaacaagggacctaccaaagaattggcaagtacccgatatgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcctagatgcacaaaggtaaaggaatgagccaatgatggaacggtataccttttggtcgacgtctttaccttgctcgttgaggtcaaggtggccatttgatggcatgggagtgtggattggcttcgcattctccattccaaacttcttgagcatgtccttcaaatactttgtttggcaaatgaaagttccttccttgagttgcttgatttgaaggccgaggaagaacttcaattcagccatcatggacatctcaaaacgcttggtcatcatcctactaaactcttcactaaaagagttattagtagaaccaaatataatgtcatcgacatatatttggcacacaaaaatatcattttcatgtcttttagtaaaaagagttgaatcggctttcccgatctcaaaaccgtttttcacaagaaaattgcgaagacactcataccaagctctaggggcttgcttaagcccgtagagtgccttgtggagtttgtacacgtggttgggatattttggatcctcgaagcccggtggttgctccacgtataccaactcgttgataggcccgttgaggaaggcgcttttgacatccatttgatatagcttaaaattgaggttagtagcaaaagcaagcaatatgcgaattgactcaagtctagctaccggcgcaatagtttcaccgaaatctaatccttcgatttgggtgaacccttgagccactaacctctccttgttccttatcacaaccccggccttgtcttgcttgttgcgaaagatccactttgtgtcaatcacattttgctgaggtcgctccaccaaagtccacacttcattccgggtgaaattgttcaaccctcttgcatcgccatcacccaatccggatcattaagagcttcttccacccttagaggttcaagagaagacacaaacaagtaatgcttacaaaaatttgcaatacgagaacgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtagagagatcgtcggcttgggtcgatgtaggtggctctacttgtgttgaggaagaggccccttgttgtggctccctaggacgtacgtctccaagagctgaccttttgattgcttcgctagggtcctcctcttcacctaacacatgtgagtcagccgttagtttcgtcaaatgtcacatcacgcgcgatctcaacaataccagaggttttgttgaaaacgcggtatgcgcactcatttgacccatacccaagcaagaacccctcatccactttaggagcaaactttgaggatctagccttcttattaagaatgtagcacttactaccgaaaacacgaacgtaagagacattaggtttgttaccggtaagaagctcatagggagtcttcttaagaaggcggtgaagatagagacggttgatggcgtgacatgcggtgttgacggcttcggcccaaaagcggtccgatgtcttgtattcgtccaacattgtcctcgccatctcgatgagagtccgattcttcctcttggctactccattttgttgaggtgagtatggagccgagaactcatgcttgatgccttcttcattaaggaaactctcgatgcacgtgttcttaaactccttgccgttgtcgcttcgaatgttcttgatctcgaggtcgaactcgttttgggctcttcttgcaaacttcttgaagatagcttgcgtctcactcttgtcatgcaagaaagaacacccacgtgaagcgtgaaaagtcatcaacaataacaagaccatatttgttacctccaatgcttagataagcaattggcccaaagaggtccatgtgaagaagctccaacggtcttgtagtagtcattacgttcttaaccgggtgatgtgctccaatttgtttcccggcttgacatgcactacacaccctatctttctcaaattgaacatttgttagtccaaggatgtgatcgtgctttagaagtttgtgaaaattcctcataccaacatgggctagcgtccgatgccaaagccatcccgtgttggacttagccactaagcatgtctcatgtttggctttagttgaggaaaaatccacaagataaagttttcccttgagaacacccttaaagactaccgaggaatcatcccttctaaatacggtcacatcaacatcggtaaaaagacaattgaatcccatggaacataattgagaaacggacaatagattgtaatttagagattttaccaagaggacgttggaatggaaaggtcatttgaaattgcaatcttacccaatccaattacctttccctttccatcgtccccgaagatgatgttctcttgagaagtggcatttggatcaagagatgaaaacattgattcttctccggtcatatgattagtgcaaccactatcaatcatccaacttcttccaccggagacatattcctacaagagatcaatttctagttttaggtacccatacttgcttgggtcctctcatgttagtaacaagtgccttaggcacccaaagcactctcttgatagaaatatttttgtcccttgggccaacatacttagcaacaacacgaccactagcattcttcctaagaacataagatgcatcaaaagaacaatgagaagcataatcattaggaatgatacatttggccttaacaaagttgctaagaccttggggcttcttgatcatcacactcttgtccacctttcctttaggtggaggaacatacccaagactttcatggttgaagttgtccctttgatagcctaggtactcctttaaggccttactacccatatggcacttaagtagaccattatgaaggagtcccataagcttctcattttgcttttgcaaagcactcaaagaagtagagttagtagcacaagtttcaatataaatatctttgcacctcacacatggttcattgcttgggacaattttggagcacgatgcctcgctagggagagagagactgttctttaaggtttcgaacttctcttcaagagagaggtaagctttgtccaagccatccactctcttcttgaagttgagcgttcgccacctcaagattagcatgagattctttggtttgcttgtaaagccgtaccaaagcctcatttttctctctctccttagcaagttcactcttgagttcatgagaccgctctttctcatgaatgagcaattcctcttgcctctcaagggttgcatattgattctcaattctcccaagcaactcactcaagtgtggtatggattccttggctatggatttgaacaactcgtcatccataacctcatcctcaacatcttcctcctcatcactaacaagatcaacattaaatgacttgaggggagagggtaccttaggctcctttgccatgaggcaaatgggagcatcctcatcacttgagtagttgaagagtctcggtggtgatgaaggcttgacggcgaacgtggcaactccttcttcatcacttgagcttgactcggagtcggagccgaagatcatcccaagatgagcttggccatagcaatcatgtttgctatgcttgtgcttctccttcttctcaagcttcttcttgtcttccttgaagtgggagcaatccttgatgtgggggcaatccgcaatgaagtgcccgggctctttgcacacatagcatacccttgcggagtgtcttccacttgacttgttggaggaatgcttggacgaacttcccttgaagaagccgctttgcttcatgaacttgccgaacttcccttgagagccatctcttcatcatcgatcttcgccttgctcttgctcttgtgactctcttcttcttcttccttcgccttcaatgccaagtcttccttcttgatgcttgtggttgaggtttggttgatatattggatgacctccttggactcttgctcgagcatgtcatgggcaaggatacgcccgagcaagtcatgaggtgtgagagtcttgtagtccggacgctcacgaatgatggtcaccaaggtagagttccttggagtgattgcccgaaccatcttcttgaccacaacctcatcggtcatgtccttggagccaagtcctttgatctcattaacgatcttgctcaatcgatcatacatgtcccttgggctctcaccatccaacatcacaaaccgctcaaattgccctttgagaatctccaccttggactcgcgaacactaaccatgccttcatgcaaattccgaagcgtgtcccaaatcactgcg

SEQ ID NO: 33303 - DNA, 3911 bp, Oryza sativa
aaaaacagacagagattaattaatttgaggtgaaagttggagttcaagaagaaactttgattggccaaaatttggatatatattaccatttttttaaaatgttcaatttggtgtgagtcaaacacaaatggtagttcaattttttatatatggagttatagatcaaaatggaagaaaatcctaatcaataattactgaaggcaccttgtaaatattttctgtagatcactcactgcatgcttaaataggtccactgctcacgatttgacctttctttgtgtgtttttagttcttcgaatctaatggcttcccatgtcccttgaggaggaatccttctgatcacttcctgagaatgattaacaaagactttgaggtataaaatgaatatagaagctttctctatcaataaaattgttatacagcattaatatatatgctatatcattagtatgtttcttgacactaactatgccccacttggagtggtgatgtatgaataggaatctgaagaaggatctaccattatttctccacgtgctgccgaagtgatccaaaaactaatgggttctttcaaatcttgtggtaccttaaggacagaaaaggaagcatgtgcaatgattaatcaggtgttttttctcaaaagagtacaagtcatgaaaaaagggatatttttttaaaagtaagttattgttctgaattttaattattttcaaacaattatttgtgcaggggcctctccaattcctcaaaggcaggcaacattcttgaccaaaacatatgtgctaaccaaaagatcaattgttaacatgcacagagatgcaggctactattggttgcgatttgttatctacattgccatttgcttaagcattggtacaattttttttaatgttggctcaaattttgcatcaatccaagtaagtgatctcaatatatatgaggtaaagttgcagaaagttggagtatgtgacatatatgggcttcttcatttcaggcaagagcttccatgctaatgtttacatcaaccctattaacaatgatggcaattggaggttttccatcttttgttgaagatatgaaggtaaatttcgaaattaagtctgcacgtgcaggagcttccattgatgtgtgattttcatggttcagatatttcgaaaagaacggatgagtgggcattatggtgcaacagaatttgtgatatccaacacactctcctcaattccatacctaggcctcatctccataattccaggggcaatagcctattacctgacagggcttcaaagaggaatagaccacttcatctactttgctgcagttttgtgggcctgcacaatgctggtagaaggattgatgatgattgttgcagcagttgtgccagattttctgctagggataatcactgcgtctggtgtacaaggtgtactgatgctcaacgctggtttcttcagactcccaagtgatctgccaaaaccagtttggaaatacccaacatacttcatctcctaccacaagtatgcaacgcagggactgtacaagaatgagctgttgggcttggtctttgaagatattggcggtggcgggctcacgattagtggcgaatacatcctaaagaattacttacaggtggaattaagctactctaagtgggtggatcttgcgatattagttgcaatgatcataatttacaggttgcttttcttagttattataaagatttccgagattgtgaagccaaggatgcttcactttctctgtgcttcaaaggtatagcattattctagttgttgttgagtacaatagtatccatggaacgtatgtagatccttcttatatatctatcaataatttatcgtgatgatcagaacaccatcatgtataattgtatattactgaatcaatgaaattatctctccttttatcccctgaaaaaaactatctcgtcatttgatcagaagttcactttactgagcttcccttctatttcaaggcagaaatgtttgtgaaacttgatctcacagggcacattttaatgcactatcaaaaaaaaaaaagaatgcatggtattattttactaacaaatagcacaaaatagatgccagtctatttgagctttttccctataaaattagcgagattttcctatctgtgtggcgggctacacgaaaccaacagcaggtagcagagttggatgggttgttactcttgctgcctacggtgttttggcttagtttagtttcctctgttttctgtactcttcaacattttcttgctcatcattctcgttcactatggagtctcgtttgttcgtccaagtctcccacgcggcacgatctggcgtatgggatggcacacgctgtgaaggatcatgggattgcggacgatggccacaacttgttcccgtttgaataaaagggagaagaaaccacacaaattctgttggaaggcatcctctcctgattttcggctgacacgatgaagcgatgaactctgggcaaggacccatgttgtgattgagatcaactaaaggaccgaataagaaaaaaaattatcagaaagaagaggtggatccagttgtagggcagctagggcttaagtcctaggtctgggttctataccccatgtaaatttcatgtaaatttataaaatttatatgcatttgtatatgaatagaaccaggtaatgggaataagccctaggggtaagggtgcaagcggctacccacaaaaacccacttatagattaaactaactcactaactcgtttattttgaactataagtgggtttacggatgacccacttgcacccctacctaggggtgggctctggctggctcggccaccgcttttcactaacgataagaagaaattgaaagagaaaggatagcttgcaaagttgcaatgcctcactgagagtacatgtgcattatcaagagttcaacggagatataagagatgttcaagtcgaacacgaattgttcatcagcaaattttcaaaaattagggggttcgatatattcttaggctgcaatccttccacccagctcccaacccctctccctccttttcagcgcgtacgtttttctaaacggtacgttttttataaaaagtttatatacgaaagttgcttagaaaatcatattaatctatttttgaaaaaaaatgacaaatacttaactaatcacttgctaatgaatcactccgttttccgtgcgtaggagttttgttcccatcctcccagcgaacacaaccttagtatattccttctcaagcctttgcgaaatgatatgccttttgatggtaaacttatcaaattgccgtaaacaattgtcaaatttttacggtaatttgacaagtttacaataactattcaaaacgatgataaatttgtatacccctttgttccacttcatttaataatcacattagtaaaccagtgccacgtacctgcactcctcacctgttatgtatatattgcaatatcctcatgcttttacaaacccatattaattaggtctgccagtgtcaatttcttcatgagtacaccgatcgtacgtcctctgttcggaaaggattacttgaggttattcgtactcaaaataaataccatcttgctgagaaatttaattatctgatggtgcatacaactaactgctggcctggaatatatgtggtccacaggtacaagagggcagacacaacactgtaacagttatcaatgttgacgataacacaaaaggcatatatgtatatatccaatggcgtttgcctctttgatctgcccctgcagccttctgtttggtttcgaaacaaatgttccccttctccaatatttcttttcatgatagcgaaaattcgttgatgtgtacgtccattagtgtaggctgtaaaaagcgatagggctgcaggaa

SEQ ID NO: 33304 - DNA, 2678 bp, Oryza sativa
aaagattagtttatttaggctgtgttcgggaggaggggttttccgggcacacaaaacgaagctcgtattattgcaagatcaattaagtattaactaattttttaaaatatggattaatatgatttttttaagacaactttcatatagaaagtttttgcataaatcccaccatttagcagtttgaaaagcgtgcgcgcggaaaacgagacaggtgggttggtaaaatgggggcggggtgttcttacttccccccaccacttttccaacttcttcctcctcatttttcacgcacgcttccgaagtgcgaaacgattagttttttttatttacaaacgttttctataagaaagttatttaaaaaaatatattaatttagttttcaagtttattaactgatgcttaattaatcacttgttaatcaaccgtttggtttagcgtaccaggtgtgaagggttttaatccttcccaccaaacacatacttcctccgttccaaaaatataaggagttttggttgtgttccatctaactaaaactccttatataagtgattaggatgtgttccatccaaccaaaactccttatattctgggacggagagagtacttagttttgtacgctactttcttgtctattcggctttattcataaaaataatcacttgttaattatagataagagataaggtggattctcccaaaaatatttgaaaacacttacataattaagaatttcaagattgcattaggtaatttgagccacattgccatatcactagcgataaaacagagtagataaatacagatacaattcaatacggatacaaatacaaatactaatagtttttcctggatatgtatacaaatatgaagtcgaagcttctgacggatatggataataatactaatatctggtgaacaatgttattgaaatatctaccaaaggaataaagcataccctatttcttactaattctagaccttcaaactacacctttaaactttaatactagcccacactactagcactagttcacattattaatattatttaaacatgtaaatattttaaaaaactagatttatatgttataatatcagttatgcttccatatatatatcggtaatgttatatgcgttaaacttaatggacactatttacactttaatgaaactttttatatgaaactagctaattatgtgtgatgatatatgtttctatcataagttaggtggttttcttgttaaaacaaaatccttatttgtattcgagataattcgtatttggtttcgtatcaagctaaaaatatgaaatgaatatagcacaagtatgatgcatccgtatcagttgtgttttcttccttgcatgtcagtgccacattagataccactttgtgtgtggcccaagattgaaaatgatctgttttgagttttcacaatttactactgaattccacaggattgtttttttctagatgttaatatttaactattgagtttgtaaaatggattctcctaattccaaacatacacaatgcaatgcacaggaactaaataataacttttattcgttccaggattcatgagctactcgatcgatggtaccagacttttttttaagaaacatattatataatggcagtgtgttttgaagtgcgataatggaattgttattcggccgctgaagaatcagaataaaatatctttaaacaacagactgtctatcccacattcccaccaacctgacaataggcctcattagccaggcacacccacactcgcagatatagatacccaaatgggccgcctgacccagcacggcccaagcacgactgggcctaggctgaggtcagtcgggccggtatggtgccatgtctgcccacgagctacacccacgacccaacacggcccgaaggcacgatagcccatcgtacttctctacagaattccctcatacctttgggttgtgtcttatgtggctggaataactctattttttatccctcttctctttggatagtgccttttagtaagttataaggatgaattaagtttattttttatccctcaactatttttttagaccatgtcgtgctgggctgggcccgaaaccagtcatgtcgtgccgtgtttgggccaggccatcgttcctcgggccttatggccatctatactcgcatggaataagttcacctgacgtccctcaattttacgccgagtctgtctgaggtccactaatcgcaataccggaaatgtgtacccctgaactacgtataaccattcaaaaaatgccccaaggcagtatagataccagatttcgttgacgtggcctagtcataaaaaaataaataaatatgtggggcccatatgtaagtgagagaaaatggtataggccgccaccctttctgttctttttctcttctcttctctccttctctcgagcagacgcggcggcagactcggcgtgaggcggttggctgcggagcaggggtggcgacagagggagaggtggagagagatggccagcgtgatggtgagctcggtggcggagaggaacggcgcgcggcgcggcggaggggagaagagcggtgcgcgacgtagcggcgggggagaggagaggagtggcgcgtcattgggggctcgccagaggaaggctgtcctgcagctccagtgctcccgta

SEQ ID NO: 33305 - DNA, 6178 bp, Oryza sativa
  unsure (1)..(6178): unsure at all n locations
cctccccttccccctctcccgcggcgacctcctcttccccctccggctcaccggcctccccttccacctctcgctcgccgacctccccttccccctccttcacgggaagttgccgccgccaccgccgccgcacgcgatggggaatggagcagccgccgttgaagctcatgatgggcgagggcgccgctaccgcatgcggtggggaagagcgtcactgccgctgctcatggtggaggaggtcaccgttgccgcacacggtggggatgagtgccgccgccgccgctgcagacgagaaaagaaggagagaaagaagaaagaaaacaaagagagatgtggggcccacatcattctctcgctgtcatgtgggtgttgatggtcgttatcgatcagtttcgaccgtcaatattaccaaaatagaggagaactagtgatgcttgcaatgcatatatatgttagaataataatattccactaatattaggtgtactcaccttttgcagagaatgaccattaagtggaggagaatcgacatcaacacggacgataaatcaatcgaacgatgtcgacaatcagacttatgtatgaatgagccaagaactcagaattgacacgacaaactgggccaaaattcacaagtctacataaagaagcaatagaggaggccgccagccgaatggtgggctggttgggccagccccatgttcggccgaactaggaggttcggccgaacctccctcgcctccgttggatccaggttttggctggacggttgagatgaaaccccaatgacggttggagggtattacctaccattccaaccatcacaaccgtcatagttcagctattaaaggagctcctcttatcacttcacacacacaccttaagcaagagctctctcatttctctaaagtttagtttagtagtatctagctggtggaacaggaatagagtagaaatcaggagtccggaagccctcggaagagttcgggtatggctctagtagcttttctttcctcttttgtaagctttgtacttttattagaatactcttctatatacatttatggtattgaaatactttccaagtatatgaatacctactttacattatgttcttgttatactgaatgtacggctagcttatctgggagatgctttggtgcgggtataatgtttgcttatgcaattagtctatgtcatgacgatgatattagagtagtatctggtagtttagacgtggtgtctagattacgggatatcattatttggggttatatgctgcggatgatttcttcttttgtaagctttgtacttttattagaatactcttctatatacatttatggtattgaaatactttccaagtatatgaatacctactttacattatgttcttgttatactgaatatacagctagcttatctcggagatgctttggtgagggtataatgtttgcttatgcaattagtctatgtcatgatgatgatattagagtagtatctggtagtttaggcgtggtgtctagattatgggatatcattatttagggttatatgctgcggatgagagatgggcagctgatggtgacagctcagtatgggtattcttccgcgcctgtatataatcctaagttagtttcctggtgttaacgaccaaatttggtaatatctgcatcggaaaagaggattagaccgaagcagaatcaaaggcgaagatcgattcgagaacagagtaagaatccgctggagtccggatcagctacgatcagaatcggctggagtccggatcggctacgataaggatcggctgggtccgagtcagactaggtaagccgatacagccgattctgacaaaacgacttggtgtacgacatcgggttagattgatatgcttcaaaatgattgccgcacatggatagggtcctgagaaggcaattgtatctattagttaggatatttttgaaagggtcaattaggcctagagggggggtgaataggctaatttaaaactttatgcggatgctaaaactgaaataaggtcggaaagtctgatccacagtcagactatccgaaaatatcagatagtctgatgttggatcagactgtctgatccaccaatgaagcacaacaagtagatctatcacacaaacaagagtaaagcacaaacagcgactagatctatagcggcacaattaagcaaagctaaaaggaggatgaagggagatcaccaatgatgaagttcacgaagttgttcccggagttcaaatccttgagggggttctactctccgttgaggagctcactaagaaccgggcctttgctaaccctttcctcaacaggttgcactaagcactcttccttccactaaggggtatctctttccttgcggaggcgagatccggccttcacaaacttctccctgccaaccacacgtagatcggtggctcgggagtgacacctaaccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagagagagctcaaagatccaaagcaatttagcaccaagctcaacccaaagtgaatgagaataaattagttgggtaaccctagaaaagggttaggtggggggtacggatagtccgatattttaaacctccaaggcaacgagaaacagagaacgaagttccatgaaatttcagactttccgagacatcggactatctgatgttaaatcggagtattctgatattttagaagcaaaaacttcgtcctcaaacagagactcaagttctatgaaatttcggagtctctgtatcatcggactatctgatccgacatcggatactccgatacttagaaaaactcactcgataggattttttcaaatcaagacagagagtgaagttctgtgaaaaatcggatggtctgatacatcggatagtctgatttcaaatcggacagtctgatgttgctcgagtaaaactgcaataactttttactccgaacttggatttcgaagatcttggactctatggaaagctagtttcgtgggctatcaaacccaacataaaacatggtccaaaaccttcaagagatgttgaaaaacttgcaaagaaacccggtgtaagtgttgtgacaagtgaaacaactcgggattgaaattttgacttaggtttttcaactcacacaaagatgaagcattttgagcactagtattctaccaattatatgcatgtggtatccctcttaatagtacggcattcctacgacacaatgcaaggtaaaagatacaatataccatttgatcattgccgcattgcatcgtgatgtcgcattcatggggtatgcatctcattacatcatgtcgaggacataacaaccttcacatttgcttgaataaaagtgttagtcctctctaatcgcattgtaatcaatcatcaaaatcattaggggcctagatgcactttcaattttatgtaatttccttagagatatgtttagggcaaaagtctgccgtaaagacttatggtatcttacagtttgttagagataagagtcgtgtccgacatggacatagtttgtaattttcgggtataaatagaccccgaaccccatgtaatcaatgaacacacacgttcaatacaatttcggtgcatcgccacccttttgcttttgctttatttcgacgagttcttactttcgagttgagctgcatcggtttcgatcttcaacaagaggtaaaacttgttatgacggcttgcgttctcgggattagtgcttccatctttatgatactctaatcttgtttatgtaattcgtcgagttatcacatatcttacataatctctggcaatatcgctatctaacctacaattggctaacatctgttggaagagggcagccgattaggttagattttgacgttgatttagattatataagatatctaccactctatgaaacttccagcggcttgattgtctagatattgttcttcttttcatacttaatgttgcatcagttgagtttgatctattaagtcgtgcttagaatatcaatctctagcctgccttctggttgccgattagggtagcatcggagtttcagccgatcttatctgatttaactatatttgctctatatgctttgttgacacgttaaatctaccctttatgtcaatatattattgcatctaagtatattaagcatatgtttggtatattctgcttgttttaacatcttaacatagagtcttattggagtattagccggtacatgctagatttatctgatcggctatgctatgaacatatatagtcttgttattaatatatatttcgatctaagtgatttatattgtctcggcatggcgaccgatctatcccaatcacttgatttaagtatatattgatataagaattatatattgttaatatctacagctgatcgagtagatttagttctttattatctatttacgaccgccgatcgatttacatatgacatcggctcaaagataaatgatatgtcatcggcacttagccgatcggctatcgtttataggtttaaccacggtttctttgtctttatttcttgttgattgcaggatcaaatcaactggcacgctagcatacccgaaggcgagttttggacctgcgctggagttaagcagatctcccaggcctcgtgttttacgtcaacacgctttcatgccccccaagtctggaatatttggtaatgtttcggatttgcagtatatcgactccgagcaagtttcacactttgccgttttccgaccgttactcccgtgctttaaatactaaccgtcaccctcgagaaatctcacaccgtcctcttccattttcaccaccgaaacanacttctccctctctctctcncgcgactgcaccgacgcaaaaggcgattccaaagcgattccatctccagccggacctccgcctgcggtgatgtcgtcctccgccagcccgtctaccacaccatcggccgagtacgctgaggtaagttctcatcggctagatctcttttcctcgcatgaaatcgttttcccctttccgcatcttgttttcttcttctcgattcctttggatttgcagcacctttccaatctagttgtgattcccagcctgtcacatgaaaaccactactttcttggtccaatcggcaatcttgacccccactgattttatcatcggtgagaccaacataatcccctttagattagccaaccctaatctgggtcattggaagaatactttcaagtcttggccatctcttgagaaaaccacccctgagaagagttggaccacatggtacaaacgcgtatcggctagtaagaaagttcactgggatgagatcgggatcggccaagcgcttgcccttaccatagccaattccgctaaggacgaacctctaatggctgccgccacctatttttggtccaacaccatcaatgcctttttgttcaaccaagggctgatgactccaactttgatcgacatcaccatgatcaccggtttggatataacttcatcggctaatcctatgagcatgaacactaagaaccaatttgacttcaggaccaaaagcataggtggttggtctggttatgtggcagcatatatgggccaaggatctgctactcctcgagaacatgtggcctttttactcatgtggctagaaaaattcctcttctgtggatccagatatggccctacgacaaattggcaatttgtagccgaagccctagaatcaaagaaacaatttcccttgggcaaaatcctcctcggctatctataccaaatgtaaaacaatgcatcggccaagatagccgtcggctcagtagttggggcaggtggaccatggtggctgctacagacctggttaaacctgatggtcatgaaagttgttaatcggccatctgtgatagaagctgaatttccgatgcaagagccgattgtggaagataatggagaagaacgcactcatcgcagatgcatgttatacggagaatatgcatccacaccaaccgatgctggagcaaagctatcggctgagctgctca

SEQ ID NO: 33306 - DNA, 1371 bp, Oryza sativa
cggcctgcccgttagcttatgcataatatggtgaagaatttaataatttgatacccatgctatcggcaaactgaacaaactcatcagacacgaaaattgaaccttgatcggttgtaatagtttgaggaataccaaatcggtagattatatgctcttgaacaaactgtatcgcatccccagaatcaacattcttcaaaggaatcgcctctacccatttggtgaaataatctgtcgccaccaatataaacttatgccctttactcgatggtggatttatcatgccgatcatatcaattcccaaacctctgaatggccatggcttaatgataggattcatagccgacgccgatgctcgctgaattgctccaaatttctgacaatcttgacaccttttgtaatacctgaaacaatcttccagcattgtcggccaaaaataccctgcacgccgaagtaaccacttcatcttatgagccgattgatgagtaccacaaattccttcatgaacttcgccgattgcaactttggcttgattggcactcaaacacttaaggaatactctatcaatcatccgataataaagctcatcatccaataaagtgtacttcaacgccttatatcttaatttcctagaagccgattgagatggattttgtaaatattgatgcacatcatacctccaatcatcggctgtcattgctgcaatttcaaccttaacatctttgatcatcggcttataccccgacgccccttgggccaaatcattagcttcaatattttattctcgggatacatgctttaaagtaaccagccgaaattccttcatcaactcttggcacttctcattgtaaaccattaatgtatcatttttacactcatattctcctgccaattgactgattaccagcaaagaatccctaatgattgcaatagcatcggcttcaacctccttgagtaattgcaaccctttgaacactgcctcatactcagcttgattattagttgcataaggtttaatagtataagcaaactcgaaacatgccccctaggggaaattataactaagccgataccacaaccatgagtacacaccgatctatcaaagaataaagtccatggcacaatttcgaccgagccgattgaatcatcacgatgttccacaataaaatcggctatagcttgtcctttaatcgctttcggcgactcataccgaagatcaaactcagttaaagagaatattcactttccaacccttcctttcaaaattggagccgataacatgtatttgacaacattggccttgaatatgacagtacactcgttggatagtagataatgcctcaaccttatacttgaaaaatataagcacaagca

SEQ ID NO: 33307 - DNA, 812 bp, Oryza sativa
agctaaacaacatatttgtaattatatgtgttcgtaatggctaaaagcaaaggcttaaaaaataaacttcgataaaaacaacctcaaaatcaactccaaatttaagattaaaaatttaaattttagctgataagcataagaaaaagatgagaggctgcaatactacaggtcgctgctatcagcatcacatcgattaatttgcacattccctgaccggagcagacgttcgacattcttcagtcggccaaccaatgttctccaaccaaatcaattggttttgcagaaataaacattaatttactgaacagggaattgtgcgtcaaaattccaacaacgtagcatcatctttccagctccacccattccaaaatcaatcaaaattcaagaccgcaaataacgcgctatcattttcaagtaaggccacagaaattgcacaaacttaagtcatcttataagttacgcttgatatctttgcagcgagattaactgtttgcttaactgaccaccaatgttctccaaaaataaagtacaataggacatggaaacctcacatgcacaattaaaacaaaattataagtttccttcaaatcctccatctcgagggccaattgaaatcctctcagtcagcattcagtctgctttaatctgcagcatagaagtacagttagcacaatggcatttgacaaagggcgggcaaaattctacagttgagggatattccagtcttttccttccaaaatctacagatgcatgacaaaaaaactttacagtacttgttcttttggaacgagatactgtgaaatgtttcacat

SEQ ID NO: 33308 - DNA, 3747 bp, Oryza sativa
  unsure (1)..(3747): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgactatctttctaggtttaacaaaattttgagtgatcttagatttgttgattcttcttatgatgctaattatccacaatttgagatttctcgccactttttgaatggtcttgatatgtctatttgggagatgaaagttacatctgttcaagagtccgttaatatgtctactttgactttagattcgctttacacaaaactgaaaacacatgagatgaacattctttctcgtagagttgattctaagtcgagtgctttggtttcttcttcttcttctttggatgttgatgcttcttcatcaaagtcttctattcttgctttatttaatgccacatccgatgatcaactcgaacagttcaaggaggaggatttggctttggttgctaacagaattgctcgagctatgaacaatgtcaggttcaggaagagaggtggtccaaatcattgctttgaatgtggtttgattgatcatcttcgttcgcattgtcctaagcttgggagaggcaaaagggaagacaatgatagagagaagaacaatgacaacaagccgaagggtacattcaaaggaaggaagatcaaggagaatctcaagaaggcttttgatcaagtctacgccgcgtttgagccactaagcgacgtagatggtgatagtggagatgaagataagggaaagaacatctccgttgtttgcttcatggcacgtggtgaatcatattcagagtgtgaagacaatgaggtaagtgctcttgaggaagctattaatattttgagtgcaaaaaataagaagtgtgagaagatgtatagaaaataggagtttatcattgaatctcttaattctgaaattgctagattaaaatctcttattcctaatgatgatgattgcaaaatttgtgaggttttaatgaatgagatttcaaaaattagagatgtcaatgttgcacatgatttgaaaaataaatcctctcttgctcttagttttgctttgcacacacgcactttggatgagttgtttttaactaaaaagttgttgcaaaaatatcaaattgtttttcatgctagtttgatgtttaacatgatttgtgctaagaagttaaaacaaccacatgatgttttagattgctcaacatgtactttgtataagaagaaactaaaagttgctttaggtcgtgttgagtacatggaagatgttgtgaaaaacaatgaagtgctttcttgctctaagtgtcgtaaaaacaaaggtgttatggtagattgtgaaaattgtgctaatttggaaaaagaggttttgtatttgaaaaattctttgcaaagattttctgagggtaaaaagaacctcaacatgattttagattaatctaaagttagcacacataaccgtggtttaggttttaatccttatgctcatcatactagacatcctcctgttgtgttaggtgttggtgctagaggtggtgagattttggttaaacctgatactaataaaactgtatttaaatctgtgggtatcatgtctacattgagtgcatcttctttaaaatccaatgttatgcatgcaaaacctcctgttgttgcttgtgttgctaagtcttctgattctactaatgtgtctaataatcgtgaaaaatatgcttgttctttttgtggcaaatatggatatattgatggtttttgtttcagattagctcataaacagaaaaaggagagagaggttgcttttgcaaaatcaaagtggcaaaaatctaggtttccttcgaggaaatcggttagaccgcagtggttcccgcggtcagaccggcgaccggtcagaccggctgcagagcctcggtcagaccggacaccagtcagactggcagtgaagcggcggtcagaccggcccccggtcagaccagctgcaaaccctcggtcagaccggcctcggagaaatttttctgaaaattctcaaactgtaattgcacatggatatatgcctattggatcttctggtcgtgtgtctcagtactggattcctaaatttttgttatcatctaaccccagtactgaggcttcgacttctgcttgtgtgtaggctttgatggcgcggaaggagaacatgtggatcgtggatttcggttgttcgcggcacatgaccggtaataaaaattggttctcctccctaacaaaggcatccaagactgaatcgattatctttggtgatgtttttacaagtgtcgttctcgctacaggtttggttaaggtaaatgagaaatttgaattgaagaatgtagctttggttgaggacttaaagtacaatttgctttcagtttcacaaattgttgatgaagattttgaggttcactttaagaaaactggaagtaaagttttcgattcttgtggtgattctgtgttgaatatttctcgctatggaagagtgtttaaagctgattttgataattctgtttcacctgtgataacatgtttggttgctaaatttgataaaaatgtgatgttttggcatcgtagacttggacatgttggttttgatcatctcactaggttaagtggtttggatcttgctcgtggtttgcctaaacttaagaaagattttgattcggtttgttcactgtgtcgtcatgctaagatggttgcttcttcacatgctcctattgttttttgtgatgacggatgcaccgggccagctattacacatagacacggttggtccagctagagtgcaatctattggaggaaagtggtatgtgttggttattgttgataatttttctcgatattcttgggttttctttatggcaactaaggacgaagcgtttcaacactttcgtggtttgtttcttcgattggatcttgaatttcctggttctttgaaaagaattcgaagtgataatggtggtgagcttaaaattgcttcttttgaacaattttgcaacaaaagaggtcttgaacatgaattttcttctcctcgtgttccgcaacaaaatggtgttgttgaaaggaaaattcgtgttttggttgagatggctagaacgatgttgggtgagtataaaactcctagaaaattttgggctgaggcgataaacactacatgttatatttcaaatcgggttttcttgagatcaaaacttggaaaaacttctgatgaactttgatttggacgtcaacccaaagtttcacatttgcgtgtttttagttgtaaatgctttgtcttgaaatctggaaatttggataagtttgcagcacgttctaccgatgcattgtttcttggttacgccgcacattctcatggctatcgtgtacttattttggagactaacaaaatcgtttagacttgcgaagttttttttgatgaggctagtccaggtactagacccgatattgcaggtacattgtcacaggttcagggggaggatggtcgtatttttgaagacgagagcgacgacgacaacgacgaggtcggctcggccgatcagaccaggcgccaggccggttagaccgccggcaagccgccggtcagaccgacacaggaggtacggtcagatcgacctgagtcgtcgggttccggtactgttgatgctgatcgagatggtcctccggagattac

SEQ ID NO: 33309 - DNA, 7202 bp, Oryza sativa
aattagcttttatttatgtaattagttttgtaagtagtctatatttaatactctaaattagtgtctaaagataggactaaagttaagtccctggatgtaaacaccaccttattaaggagaatgagaaatcatattggataaaagacccctttttaaaagattcgtgtatttattcaatatagatgtatccatgagtcgttgggttcattactgtaagataaactagattgataccccacgcattgttacaggattttatggtggtgataaacaactttgcaaatatatgcttacaaacagaattgaagaatggaaatatcaaaagtagacattcaaaaataataaagtgtaaagttggcatttgagtagtagatggtcaagggacatagcagtggcttaaaccactcacataccatgtataaaatgctaattgaagaggttctattaaagagaatgaagttagtatataacactgtgggagcttgtagcagttgcacctttaagagatgtgaataccacaaatgtactatgtataaaagatctgttaagaagaataaagttaggtatatagccctgtttgagagagtttctatcagctatagcttcttcaagaatctacatctcctcaaaccatccagatttttattcgaaacttgagaatatggagcctcaacaagacattaatttgtttttgctaatttcgaaaaagaaccccacaaaattctgaacaaaaacatttgaaatgaacctcaagatctcattccaaacttgcttgagatgctcgaaatatgtaaaatttgagtgagatctcatgaaattgtgaacgcctgatgggatgttggagagatagatgagtgcttgggtacgtggacagggaggggaaaaaaagagaggaatagttggtagttcatatggatgcgcacatcctcacccttgttgaggtggaattcacttctatgtacaattgcaattaagctctatatcctttccaattaaagatgtccaattccaatattcttaatctaaatgttctaccttttgttgagtggaacatagatgcttcatcggcagagaacaaatgctaatcttcgtatgtccaactagcaatcttttgtaatagcacctatacatggttgttgtaatttatgtcagtgatgatatactgatctccactattacaatattctagtatatatgcaaatcaggatcagtcttaatcagagtgttctaattaattaatactaggcctttttgagttaagtgaccaccctataaaaggccctcaaaccaaccaattattttactaacacatttggtttagccataaaaagtgttaactgtttagggcacccgcaatgattatctataggctctctacaagagatccatgtcagcatatttttctacttggaagagattaaatgaagagagagagcaaaactatctactaacctggagatagtctatagagaaaaacgagacaatggattagagagctatagataccgttgtagacataccattgaagtggtttactattaatctagtctattgctgagatgtacatgttttatagatagcaacttactttaccattgcgggtgctcttaggataggttattaatcataacaaattattcgtgcacattgattaccccaaagtctataattgttaatacagggaaggacttgcacttgcttttctgggcgtggggacaggagaaaggtgccaactgccaagtgtagtggccggagaagtggagatctcatttgtcggtgcagaacttgtggtgcaagctccatccgtagctagggccatagaaaaagcgttcttgtccataattcgatcccagtggcctctctgacacgcagcacattgcggattcgcggttggctctttccttcacggttacgaaggctgtctcatctcctcgtggaaaaacattattcagcgtgtgttttttggtcctattattgatcgatcatgcagctcgcatcacggtccatcaagctttgatgcctcactgtccatcaagcttgttgttgtccatgccggattgccggtcgatcgtacgggtcttgctagttgcatgcatgtgaacctaacacattcatcccgcatagagaacaagataacttttggctgcgttctttgctgggaactcccaactccccaccatcgttttctgcatgcacgcttttcaaattttattttacaaaaaagtttctatacgaaagttgcttaaaaaattatattgatctttttttaaaaaaaaatagctaatacttaattaatcacgtgttaatgtgaacatcgttttgcgtgccaaagaggaggggttcccagcccctcctcctgaacgcagcctaattactcctttcttcccataaagattttattttttgggtttttatctaacgtttggccatccatcttattttaaaaaattatgtatttttttaaaaaaataatcagcatatacttcctccgtctcatgaaaaacaaaactaaaactagaacatgttgtgacatacttcctctatttcaaaatataagacataaccacccttaacctaaagatcaagaaataattattatcacctcatcgtttagattacctaataaatagaacgcatgcacctaataaaattagagatcttgatggtggaggatttaaataataatattttagtggaaaatgtgtgctagttaatgacatgcatgcatgcatgtcttatattatgaaaacaatttttaaaagtagttgtgtcttatattatagaatgcagggagtattctagtggtaggatgtgtcacatcctgttcaaggtttgttttttttttaaacggagagggtaactagttacgtataagttaaaaataaaaatgaatcaatatgatttttcaaagcatcttttctatagaccttttttaaaaaaacatattattccacctcttagcaattgggaaaacacgcacacaaaacgagggagtagaagagtattctgaacacagccttagagtaagtttaatagtatagcccactattagctccaattcatctatagccaatgtaatagccaattaatacaatagttacttactatactattaatatatggtcccacctgtcatacacacactgcgtcttggagtccgtgctgcagctggctacaaatctatagcccactgccttctctctcatcttttatctcattaaaatatggctaatagtatgctattgtacctgctcttataagttcgtttccactacaagcagtggataaagttttggattttcgtggtacgcttttcaaactgataaacagtgtgtttcgtgcgaaaattttctatatgaaagttgttctataatatcagattaatccatttttcaagtttataataattaaaactcaattaattatatgttattaccacctcgttttacgtgaaacacttaatttttatcttcgtctttatcttcgtaagattcaaacaccaccatactagttgaaatggagcactttttatatattagtaaacgggattgtacagtaggacgcaaatcgtctgtccattaaacaacaggcccgagaagaaggatgatggggccggacggccggtccggggaagtcgcccgtcacaatccgaaaagcgcaaggaggaaaacgtgagcaagcgaaaccgaacaaccaaccaagcaagccatgcacgcgcgcccgcacgctgacgcggcgccgtgtcgtgacgcgccccccggaattagcaccagccgcgcgcgggggcgccaccaccggatcagttcccccatccgcggggcccgggcccagatcacgcgccgtgacctgacctgacctggccccgcacgccacggccacggtgggcggatatgccgcgcgcacggccgcggcaccgcccggatatgccgttttcccctctgtcgcccgcgagcagatcacgcgggagcgcggcagccaacccgaaaaggcccgggaatatgcccacggcggtggtggctatcgataaacgaggatggagaaaaggcgggggtttggtttggactttctgccaccgaccgctgctttttagtacgcgatctcgaactcgagatcccttttgcaatctcgtcgaaaacggctctcggtttcacatacacccaactagtcgtcctaccttgttataatcactactaatcaatgaacacacagggagttaattagtagtagtagtaataaactaacaaactactaacacacaacttgatgattagtagccgttcttaatcaggcacgcgtatctcgtgtggccaggaggaggaagaagagcaaaaatcgcaaatccggaaactggagtagcagcatcagcagtagcagtactaaacttgtactgcaacacatggcaagcagccagggagagagaagaagaagatagagatagggacagagagagcctgtactgcactgcactgctgcctagcctatctatccatccccatcgccacatgcctctcctgcagctgcggcctgcggccaactcgtagtactcctataaggcaaggcctcgctaccccaaccgtcccctttcgcctccgcgtttcatctcctcgcctcgtctcgcctcgcctattggccgcccgctccccgcatcctcccatctcgccgcgttatcgccttccgcctcctcctccgccgccgcctacgcttctcgccgccgccgccgccgcctacgcttatcttgttgtgctggttgcatgcgccgcggcgcaggggctgacggagaggggtgcgcgtggaattgagaggagtggcggatggaggcggtggaggagcaggtggcgccggagcaggtcatcagcacgaggggaggctcggtgctcgggaagaagaccatcctcaagagcgaccacttccccggctgccagaacaagcgcctctcgccgcaaatcgacggcgcgcccaattatcgccaggtgcgttgctcctcgttcctaatctagtaataatctggatggtttccggatcagtccgccgcgcgccgcgaattccttggtttccctggcccccccattccatgcgttcgcgacgggaatctgcagcaatttttggctccaatcttcacgaccacggaagaaacctgccttgcctgtttatgtctcttacatgttttgtgcgctgattgtctgctttatcggtaaccttgtgcagcatgaccgattcttatgtgcgcatcctatgataattttggtgttctttccggaagtgcctttacttgttttcagaatagtaaatgtaaatctcaaaataaattagtacaagaatgttaacacttaatgctatgcaaattgcatttggatttcttgatgatttttgttgatcacactgatgaacatgagcattaacacttccaatgcatatctatctgggctgtttctgctaaggcatcatagtcttcgatgatagaagatataacatttaaagaaaaacaatgtgaaggccgcatggaactttgtatgaactaaacaatccatctgacgtgtttattataaactcttgaatgaatagtcctacaaaatgtgttctccaatttgtaattttcttgtgtcctttttatccagtaaagattcagcaacagcctgggttctcaatcatctataattttctgtcatttactcactgttgccaactgtttttcaggcgggttctttacgagttcatggtgttgcaatgccgacaatgaagggaattgtaaatgtgttaaatcacattggagcacaaaagaaaggaaaacaaacccaggttctatggcatagtcttcgcgaggagccggtaagaacactggtcactgatagaaaattaagcatctctagcataagaacattaaattatgctcaccacttcaaaactacaaaaggttggaaacttggaatgaacaatggattttgaactgtctagaacatccgtttccaattctcagtaggtaggcataaataaataaaaaaacatagagaagagggtgtgtatttttcttaaaaaaatatatgaaaaggtttctaagtaatatgtacttatggaaattacataacttgacatgcatgccttaacagtatgtaaatttcaaatttcaagtgagttctggaccagtttgcttagcttgcagtaagtgtcctttgaacaggttacaccctttccttgttacaacaaatactacttctccctataataggatagagtagtaccttatatcttttttattttatgtttgacaaaaaaggaacttagtaagttgtaatttccaccaatgttgtacaggttatctacatcaatggtcgcccttttgttctgcgagatgttgaaaggcccttctcaaaccttgaatatacggtattctttgatgtttgtcttgaatttttctagtcatgcctagagtgtgtatgcagtatgtctctatgtttcttgtttttgtatgagaagtccatgaaggtgttaaaccaaaaatattttttcttgctaaacatccacagcagaagttatgatacagatgtcctgagacccaggaaaatatatagctctgtttcttaaaggaatgatgatgcattagtgctattgcagacttggaatgcttttcctgttaaatctcattttgatttgggtaattctagatatgttttcaaggctatagaaacatgaaccatattgagaaggcctatcccttcaaaacaactttgattccacatgaagttactattgttctattatcattttatttttccattttaacttttttttttggtatatgtactactactgtagggaattaaccgggaaagagtggaacagatggagtttcgcctgaaagaagatattcttcaggaagcttcacggtacgtcggctgccaatattgttttctacccgtatttactcttaagaggtttgtttgtttgttttacctgaatatttgatggagcagatatggtaataagatcctcgtcactgatgagctgccaaatggtcagatggtggaccagtgggagtcagtggtaactgatacagtcaagacccctcttgaggtaagaatagattcaaggtttggttatattgttttattatttttagtccctttgagaatttgtttcctttgtataggtatatgaggagttgcagcatcaaggataccttgtagattatgagcgtgttcctatta

SEQ ID NO: 33310 - DNA, 668 bp, Oryza sativa
tcccctccacgccaaagcagcagtagaagggacattgaatatgctccaggcctgattcctaatggaggtggaccatcttcccctgtcatcggctatcatgcccccaggactttaactccctccaagatctaatcagggaaccagcagatgcaggcaagaaaagaaaaactaggtcatcggctgtggacgttttggctctagctccaaagaaaaaaaccaagtcgaagaaaactaagacgactgatgacctgcctgccttagatccatccattgaacaagctctggatgaagaagagattggtgaagatgttgaccaggctgcagccgaagtgagtgacacagaaaaaacaccaccagcttcacccaagaagacacctccaactccttctgcccccactcatttctcaagagtaagcatatctcttcggcttcttttgtaattacttcacttttcggcgaactactcattgactctatggttgcagaagaagaaaactgctgtgaagaagaagccagcagcaacaattctcaagtcggctccaccagtaagatatttttaattcttttactagtcaatctcagccgattttatataacacttgtctattttacagcctcctcctcctcctccttccgtacagcaatcgtcaagtgaccgaactccatcg

SEQ ID NO: 33311 - DNA, 10008 bp, Oryza sativa
aagtatcgagaaagagaaacgaatctggatctaaacgatagagcaaagggcgtttcggtcatttcatgtgcgaagtctggtaaaaaaatataaacaaaataaaaaaaggctcaaaacagtccaaagtggcattttattaggctgtatcacctatggagtggcatctttataaggtcatccatagtgggcattctgttaaacccacatctatggagtagcatattgttaaattcctccagccatattaggggtctgttcgcttatgctggttgggagcagtctgggggtgttgggaacacagccacacggggtactgttgagtactgtcaagtcaagggtggctattactatcgacatgtggacctctgacaaccaaaagagaggttacatggctatcacaacacatttcattgatgaatcttgggctcttaggaatataatcatgaggtaactattgtcaacatcaatatgattgcatctactttgtaattttgtgctacgaatctgatgtcatatattgtttattcaaatataggttcatttatgttccaagtccccacactgctgaggttattagcgacgagctctatgaatcattagttcaatggaatctcgatgagaaggtatccactagtacacttgacaattgcactacaaatgatgcaacaattcctattcttgtgagaaagattggaaaaaccaagcttattaatgatggaaaggtgctacacatgcgttgttgtgcttatatcctaaacttaattgttaaggatggattagaacatttgaaagatgcaattgagaacattcgtgatagtgtagcatattggacagccacaccaaaaaggatagaaaagtttgaggacatagctaagtttttgaatgttactatcaccaacaagttagctcttgattgcaaaactagatggaattctactttcaacatgcttagtgttgcattaccctacaagactgttttcactagagctagtcgtgtggataagcaatatgagtgtgaaccaactgaggaagaatggttgtttgctgaagagaaggtggaaaaggcttaaaatatttaatgatattacagaattattttctagaactgaatatgttacttccaacatatttttccccaaaatctgtgagatcaaacagaaaattaggctatggtcaacttgtggtaacagtttggttgaagccatgtcagttgatatggtagagaagtttgataagtactggtctgacattcaaggtttaatgggtattgcaactctctttgatcctcgattcaaatctgaaatgttgtatatgtgctttgagtggttacttggtaaaaccagtgctctttgtgatgtggaggttagcaaagttacaactttgcttgctactttgatggatgagtacaatgtaccagaggaagaagataacatagaaccatcgacattgtcacttggcagtatggaagtcatatcttcctttagtgaacgtgttgccaggaaaaggccagcatcagttaggttccaatctgagctagatcgctacttggatgatgagttgatcccaatatcaacaaaagacttcaaggttttggattggtagaaggtggctggaacacgttatcccactttgaggaggatagcgagggatgtatttgctattccaattaccattgttgcttctgaatatgcttttagcactagtgggagagttctcagtgaacatcgaagcagacttatagctgagatgttggaggctctaatgtgcttacaggattggattagaaacaagtacaaaggtaaacatcgtgatgtgcatgtcatattatgtttttgttcactacaaactaacaccaaacatttgtttttcctttcagttcaacacaatggagatcctactagcttttggtcttgtctgcaagatattcaagaaggcttgtaggtactagctgaaaatccacaacaacatctctctttatcaatttactgatttccttgtgccctttattttccatttatgacttatccaatagctaactagctagtttgtctacccatgtaggagctgacactttgattcaagatgtcaaggtgtgtgtacctgctggtgtgaatctctgacaagtgcatatgcaaccctttttgttattaggtatacttttgattgtaatggctaatgatggacctatgaattatctgtatgatgagggctgatgactagggactaatgtattttgttagactaatgtgatggacggatggagtgatggttgtggtgatgcacttgtgcacttttgctacccaacatattcctataagactctacaacatgtgacattgtggattggcacatgctaattatgcttatcagttgatgtgatgaacaagctaagactctacaacatgtgacattgtggattggcacatgctaattatgcttatcagctgatatgatgaacaagctggttggtaccatatgttatgtaatgagtaatgatctatgatgagttatcagattgttcactgatgcaaccattatcaatttattgttgctgctgaattatggtgatctagtgaaatgcttcatgggttatgtgcctgctgctatgctactctgcttcatctgctgatctgcatgattgtcgggtgtggggacccggcgggtgcgcaatacccgcatgggaacgaggatggggaaggtgacgggagatttttctgaactcgggggcagggacggggtggttaaacccggcgggggcagccccattgccacccctaaacacggggtactgttgagtactgtagctgctacagtactttgcagacggacgtctggaggcattaggcacggcatttggctgccaacagcttccgtgaacaaaatggtgccgtgcgcattgagtgctgtagaaggcaactttgcagggcagttaagggggagctgctacgcgcacacgatcagcaggtcgatttgctacgcatcaccatttgagaaggaaatatatgctatccattgacgtgtgattacatgaatggtgtaaataaacaagtagtttgcaaccaaggacgttggggaaccaattggaaattaaagaaagagctgaatgcttctaaatcatggaggaggagaaaaatagataaaattcactagaatatgtggctttcataattggccggtgtaaaattacaaaaccacatgaatagtaaattgcacatatatttgttgcaaaagatataaaactatggagacaatttttattaacggtgtaacatgtatgaataaaattcaaatgtggtactactgtgttatattagatagctggaatcggactgcgaaataaaaaagtagtactatagaagcaattcatgttgtattgcacaataaatggctcactccttacatagctgttacgaacagcacatacaactcaactccaagagaaagcacattatgctgctacacaactttgagagcgattataaacctcattcgcaatgcattcacgccatatgctcatcgcttcctcgctgtttgttgcgtagtacatcacattgaaagatgcctgctgtgtcggaatgggatatctgttgtacggaggattagtgtaaacgcagttcacatcctaacaataaccttcctaaaattatgaagagcaaaagcaaaagcagcatgtatgatccgtggtggaacactggcatctcggtaaaacgtatctctttgagtattttccaccgctttttaatgatgctgaaagttctctccacaatacctcgcaaagaggagtgacaatggttgaagtgctcttctcatccttcgagtggcgccgctcctcttcgtcccagtcgatccctgtgttaccgtacatgtggtacggtgcaagaaatcccatcctgctaggaaaaccaaagtccacaaatagataccttcctgttgaacatattagggaaaattaattaaatcgcactgcaaggttttaaaatgtagaggagtgtgcatcccgaagtttgtaagtgaacaagttaagtgaactaaccatacggaatctgtgggaaatcatggggatagtgctgcacagcctcattcagaatcctttgatcgtaaactgatcctagccatccgaaatcacagaaaataattctaccatcatgatcacagatgacgagaacatttttcgtcgtgacgtggtgtctgtttatgtgttgcatcgtcgtggccgcagaagtcacaacagatacgtgggttccgtcaactgcacccacagactggtaaaatggtttgtaccattcctccgtttcaaacattcattgaaatgtactgaagttgggatctattgatttcaaaatattccctgccaggttgttcaaagcttccaatacttcagcgaaggaaatagacacgattgagttcgaccggacccaacgattgttagcgtctcttgttggacggccgccagccataatgaacaagaaaatcctcagtttttctagtgaacaattcccgcctatatcgacaagtccataagaagttaccaggaggctgtgcaactgtgtatctcgtcagcggtcagccggaacattgcccgaacatttcccaaatattgtccagcatccaactaataccagtctgaattggaatttggttaggtgctctcgcatttctctctaactcactgtccaacaggccgatgatggcatcgtcctcctcgctgctgctatggtctgcaggctgcagcccagccatagggaccggcaccgctactcatcgccgcaatcctttaaagaatatagcacccgaaaatggataaacgtagattggtcatgtaagtatgaaatagagtaatagatgtgaacatgatggaatataatgcgccaggaccatataaaaccaagtcgcaccaatttattttaagcagaaaataaagcataacacatgtatttaaccaaatgaatgttcacgccgaaagtgatgcatacactctaggggtgaaatcgggtcgggttaggtcagatctcatccgctggtggagaagttctttttagtcccggttcgtaaccctttgtagtctcggtttttcaaccgggactacgaatccaggactaaagatcgttatctttcgtcccgagagaattaactgggagtaaaaatccatttttagtctcggttggtgttaccaaccgagactaaagatagagttaggctagctagatccggttgcttcattatttttttcttttcttcattgtttttaatatattgagttcactccatccccatcccaaaatcccaaataaattatccccaaatcctcaaatcctcaaatccccaaatctatcatatccaaatacatcacaaaatcttaaaaaaaaattacatcacaacttctacaaaattcatcacaaatacatcacatattcacatcacacacaaatcaaatacacagatccgaatcacaaattctcaaaaaaaaaagaaaaaaaaaacacccgctgcggctgcggctgctgcgccgctcgccgccgcgaggccgcccggccctctgcccgccggtgcgccgccgcgaggccgccggccgcccggccctccgcgctgcagatgagaagtggggatgatgggggagggaaaggaggagaggagttagaggagaggaggaagaggaagagatgggaggaggaagagataaggtcagggaggaggagatataataggttagggaggaggagatataatcgaaggaggtaaaggctacttcaaggcaagatggtggggaaaaagactttgcctaccttactgaggtactcgattggagaagagcgtttaataactgatcccgtctcctcctcctcgatcttgcgcacgcctcgtactctccgccgcgcatgctgatcttttgttctggttggtgttaccaaccaggactagaaataaatctttagtctctgttagtaacaccaaccgggactaaagataatagggatctttttttcctgttggtgttaccaaccgggactagaaatagatctttagtcccggttgataacaccaaccgggactaaagataaaaatgtagctctaaccttttgaaccgggactaaagataatctttagtcccggtttttattgcaaccgggactattgtggattttggccgaccaactaaagatggtttctccacccgtgatccttcccatatcctaacccatatgtaatcagaatcggatcagacacggatagtgtcgaatacggatacaaacacggataatatcgggtacaaatacggaacgaatacgtaccaaaatggatatcaacgctatcggttacgaatacttattcggataccaagtcaaaacgacgaccatatataccacataggtcctgttcttttttccaacaagagttggatgaagattaatactttcgtggcacgtttttcaatctactaaacggtgcgtttcgggcgaaaactttctatataaaagttgctccaaaatatcatattaatctatttttcaagtttgtaataattaaaatttaatcaatcatacattaatactacctcgttttgcataaaaaaacttaatcttcatctttatcttcaggagaaaagaacaccaccatagacaatagatattcaaccacttcgtgtatccataatacgattatattagaccatttcatatatccacaaatttatattacaactgatacatatcaccataacagtgctcacaaacaaatgacttagccagttgccaatcatatcagctacagctaggacctagccaaccataccaaccatctcaaaccatcagttgcttcagatgggggtgacgccttttgatgccgtgatggccttcacaggcgcatgccgtgcagtggtggtggggcttcgaagggcgcggtgcagtactgcagcggcgcgatggacgcggcggcggcggcttcgaagggcgtggcgctgacggcgctctcctctcagtctcggtggtgattcgtggccagcattgctaaaaatatgtcgccataaaatatgatggatttcagtcgattgaaaccaaccgtcagatgcggatgcgaaattacggcatgtcacatgtgtacgcatatcatccctccgatttacttctcttcacggcatatgctatagttgacttttcttagccacttacacagtagttacacctcacttacatatgtaattagtatgtaatttttgaatttacatgtgtaattttagaacttacatatgtaattttgagatttacattgtaaatacactaaaattacatatgtaatttagaaacttacaatgtaaatacataccgattattttttggtgaaaaaaatatgacgccataaatatagctacacccaagtattatgatttaattaatggcgcattttccatctcgacacttccggccgcaacccactagtaatttagtccattacaaattaactcctttaacacggttggattagagcaagcatatactctggtggagaaagcgtttgtagtcccggttcgtaacccccctttagtcccggtttttaaactgggactaccaatccgggactaaagatcgctatctttagtcccggatgaaataaccaagactaaagatcgatctttagtcccgttttttttttgcatggccctgttgctgcatggtttatatatatatataaaccatgcatatatatgtttcaatacatatatatgcataaataatatatatatatatatatattatatttatatatgtttcaatacatatgtacatgcataatatatatgtatttatacatatatatgttatgcaaatgcatatgtatatatatatatgaccaaaatatatatttacattatagaaaatgtgtacacatgcatatagaaacatagtcatgtattaattataatccattatatgtcctagctagctacgatttcgacgtagtagtagtcgatatctcagaagctaaggacctatgaattgtatttccgtcgtagtagaattcacccttgggatcaaggatttgttcgttgatgaatcccatgagttgttcgtgaaccgccgcgataaattccttgtgtgtgatcaggttatccctcatgcgaataaactatatgaatgtatgaaattgattagtaattaaacaacaaatcgatacgtaatgaaattttgaatttatttgtacgtacatcgagctctcttgtggtgatgatttggtctgcaaggcagtggcaatactcgcacacctagtagccgcacaagttagttccctgcttttgctttgcgcactataaataaatgacaaacgatgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaactataacaagattcttaattaacataggaacttatgacagtacctgtctataagttcgaaaaccttgtcaaacatagactcttttttatccattgagtcatatacgttgacggtgcaggcctccaggtcgaagagtaaaagcacccagtggaatctgcaatgtgcgtgggatgcattacatatgaaacacttagcatgttcgtacgggattgaaatttggtataggaagacagtaaaattaaactaactctgtgttgtacggcaacagtatgaacgtcttgtaatgctgcgccttcaggagatggacgagattgtcctctgtggcttgtggatattggtcgagcattgcgacgtttactttccgagggtcgatgaatccagtatcgaaaaccccccgccgtcgggccctttgaatctccattctacaacgataaaagggagtatatattatatatagtctacttatatacaaggacctaattaattaaaggaaacgtagtaagaaatctaactgaacgatatacttacaaaatccagcaactcataatagagacgtcgagggcatccagctggtatagttcgtagattcccttgaaattgatccagagaatgtcatctccttgcaagaagtccgtgtccctgatcctcgatccgatcatctctctaccggtggcgctcatctccatgtacagctgatggaacttgtacatttgtgtgggtagggactgcagcagctcaggcttgacaagcggtttaccgagttcgtacatgtatttcacttccgcattttcgattggtgcgtctcgtagcaattgatacgtagttagcccggtgtcattaataaagtcttgtattccaaaatcttcaccggtcaccaacggctcgatctcctggtttggttgctctccaagctgagggactggtttggactttccagaagatgctttcttgagtgttcgctcatagtccgatagctttatggcctccttggcaggtgcagacatacccctgaagaagttcctgacactcgcgtctataggaatcttcttttctagacttcgaggcttgaattgtctcctgacttctgatgccacgtaagcgtcaagctcctcttgcgtgcagtcgtacccccgtcaactttcgccttcttcgttgcccttgtgggggcaggcggtggagcttggggggcccttgacttggaaggtgccagaagaggagcttgcagaggagtcggtgtaggagcctgaggaggagtcggtgtaggagcctgaggtggagacggtgctggagcatgaggaggagacggtgcaggagcctgaggaggagatggcggagccggaggagatggtgcacgagacgccgcttgtcgcccagggaggatgatgtaccgcttgcaccatagaataatggcgtggcttgtgtctcgtagatgcgtctcaccgtctcctccagggtaatccagctcgaggtcctcgtacgcgccttcgaccaactcaacttcg

SEQ ID NO: 33312 - DNA, 2917 bp, Oryza sativa
cctgcagtggtaagtatctgaagggtccgttgggatggccatgcccgacgccaccttcatgtggtgagaggttatttattagtaatcaacatatataagcagcaactagcggaatggccaaatctaaaatctataaactacaagcttacctttattgataagttcttgaagggagaatatgcagctcacatggtgtccgctgagtgatgtcatcaacggggcaggtggtttcgtccagggtttgcatggtgtccatgctctgtgatcctacctgccccgttgaggcgcagctcctacgatttcctgatgggctcagcattgcaggaggaatggtcggctggggatcatgggaccgatgtgcggccatgcgttcatcaaccttccttgccacctcctcttgcatgctgagctcgtagctcgataccctgaactcaagatctgcaatcttcacctcggtatctctcttgctcctcatccgactcctgtatgtgtggatgtcctccttgaacccaatcttccaaggaatcacccatttccctcgtgttcgtcctggatgctctggagtctgcagggcaagtgacagctcgtccctctctctgtccagtcggaacgtgccctgagaagaggcttccactgcgtctgttagtcgacgcgcagcctcatgtatctgatcgccgaagaccagggagccatcagctgggttgagcgttccaccgtgagcatagtaccagaacttcgatcgttccggccaattagtggtggctggttcgatacccgtctcaaccaagctagcctccatctcctcccacttcggcatcgcgacgctatagccgtctgaccctaagtggtgatggtacttcttcttggcggcattttctttgtttctttccatcatcgcctgcccttgttcacctgtcttatatgcaacgaactcgtcccagtgatcccttagctttggaaatgtgtcaaagttcggtgtctgccccttccggatatatttctggtacagatctcccttgaagctttgaaattgttctgccattttcttcagagtccaccttttcactttgtcctctgtacccgcgggaagggtgaatgtctctagcattgtggtccacagcatctctttcactgaatttgggacaaagctctcatgatctccgcgtgcccttattctgcgccagtacaccgtgctgacaggcacgttatcccgcacaacccaaccactatgacgtacatagttcttggcggcttctgccagggcactaggtcagccgtcttcgtccacttccgttatgatgtgccggccctcaagcttcttcgcggcacctcgttgcctgcgtgccctcttctgtccagcggagggttgacttccactagcctcctcctcctggttcccctccacatccctctccacgtgcccctcctggttcccctccacatccctctccacgttcccttcctagttcaaatactggtttggatcctcgttcccctcttcttcattccagtactggctgcttccctccgcgattgtatcgtacaatatttgttcctcatcgcgatcagccatctgttcatacaggaaacagctgctaagtcatgagacatttatgttttaacaatcttatatactaacaatcatatatgctaagtcatatatactacgtctaactgtcgtatatgcgaagtcatatatgcttagtctaactgtcgtatatgctaagtctaactgtcgtatatgctaagtctaattacaaatctaataatcgtatattaaaacaataataatcttatacgaaaacttaaataatcttatactaaaactcaaatagtgatatatgcttagtctaggtgacgtatattataggaccctagctagtcaataattatatactaagtctaattacaaatataataatcttatattaaaactcaaataatcttatactaaaactcaaatagtcatatatgctatgtgtaactgtcgtatattagaaccctacacaatcttaattatatgctaagtctaattacaaatctaataatcttatactaaaactcaaatagtgatatatgctaagtctaggtgacgtatattataggaccctagctagtcaataattatatactaagtctaattacaaatctaataatcttatattaaaactcaaataatcttatactaaaactcaaatagtcatatatgcgtagtctaactgtcgtatattagaaccctacacaatcttatatgctaagcctagttacaaatctaataatcttatattaaaactataataatcttatattaaaaccaagtctaagtgtcgtatattaaatctaatagtcttaattgcattacaaatataataatcatatatataattacgtcacttgcctgcgcgaattccttcgagggctagctaccacttcggcttgagggacgacgacaacaacgtcttttctgcaacatacaaaaatatgtattaggataaacgcgaagtaacatatattacatttgacgttcacgtttcattcacgatcgttcacgttcgcgttctcgttaaggtcacgtttcattcacctacgttcgttcgttcacgttcattcacctgcatatattacatttcacattcacgttcgttcatgttcacgttcgttaatgttcgttcacgctcgttcgttcacgttcgttcgttctttaacgttcaattctcgttcacgttcgttcgctcgttcacattctcgttcacgttcgttcgctcgttcacgttcacattcacattcacgttaattcgttcgatcacgtggcggcagcggagcggcggtgtggcggtagcagagcagcggcggggcggcgcggcggcggcatggcggcggcatggcagcgcgcgcggcatcggcgtggcgcggtggc

SEQ ID NO: 33313 - DNA, 8740 bp, Oryza sativa
ccgggactaaagatattttcccgctatttccaaattctttttaaacccggttagggttaagaaccgggactactgataaatccactgaatattaatttccattacatatgtgtttctaaaatagaaaataatgcgttaaaattatttaaagtagaaaaattaatgacaattacttcgaaaaattattgttgtctgtaataaattaagtggataaaacgtaataagaaaatatatgatttaaaattaataaaaattctaataataatatatacttagcatatgaatgatattaaattgttaaaaactctaattaacatatgtatatacatacgccatgcatgatttaaaattaataaaaattgtaataatcatatataattagcatatgaatgatattaaattaattgttaaaaactctaattaacatatgtaaatgccacatgcatgatttaaaatttttaaaaattcgaatagtcatatataattagcatataaatgatagtaaattaattgttaaaaactctaattaacatatgaaaatgccacctgcgtgatttaaaacttttaaaaattataattatcgcatataactatcatatacatgatttaaaattgttaaaatctctaataatcgtgtgtaattaacatatgccatacaacaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgctagggtcaatcgtcatcgtgaaaggggttgcccacactacaacatactatttattccgtaacataattttagcgacggtttcagaaaacgttagcaacttgctctcatttatattaagcccaaaaaaccgtaatgttttatcaattccgtcacgattcggcccagaacactgtaacgtttacacaaatccgtcgcgaacataaattaaaaattatcaggttcctatgtgaaacaaaattttaaaaaaatctgtcacgaacataaattaaaaattatcatgttcccatatgaaaaaaatttatacataaattaaaaattatcaggttcctatgtgaaaaaaaaattaaaaaaatctgtcgcgaacataaattaaaaattatcatgttcccatatgaaaaaaatttataaaaaggtgcaacatgcagggtttgaatccccgtcttgaattccatcagtaaagtgacctaccactataccatgcattgtgatgtggtaatgtctagtgacaaaatttatttttatagtaaatcaagtatttacccaaaaaaaacccagctcccccgaccgcttgggccacgtcactgcccgcctgcgccagctccccggccacgtcacgcgtgcgcgcccagtcagccgctcccagaatttaatccggcgcgccaaaaaaataggcgacggggcctggaacccacgacctggaggttaagaggcgtctgcattaccactcggctacaagtccggctgtgttggaacttagaagttttgctcttatatacttgaaaagttcgttgattaaacaacaacattcaggcatttggaaatttccccgattcagatccattccggcacgtgacggcgccgcctgccattgctgccgccgttcgccgtcggcaccattaccccaccgtccgtgcacgtaccgccgtcgccaccattagcacgccatcccggccaccagtccccaccacgccgtcgccgccgcccaccacatctcgcatcaacggctgccggaggatgacagcaacggcatcataggcttgcccgccattgccgccaagcgtggcgccggcgtggtgtgatgccgagcgtctcgtcgtccagcgacaggctccagcatgcgccattgcagacaatgacactgtctataaagtattctcggacgtcgttcgccagccccacggctacctccttcccgcgccacccctcctcaccgcctcccgcctccggtgcgccaggacgagcgccgccgcctggacgcctctttccatgacgccggtcgccgacccctgccgcgatctccttccttcggctcgtccgtctcgccggcctccgtcgccgttacgccggccgccgttccctagtgcccctcaccgcgcctcgctctctcctgctcgggcgcgcgcgcgtgagaaagagaaggggatcggaggtaagaacgagaaggaaagtggtaacgaagaggagaaaagaagagaggagagatacacttacaggtgggacccaatggaccccatggttactaatcaagctttgtgcagtaaatccctctttaatccccctctattatatcactgacatgtgggtccgattacactaatctctgattagatctcttttaatccctcagatgattacgtgtgggacccactgttctccagccgctcgcgcacctggtcctcatgcgccgggtctatgaccatcgggccccacgggccctaactgtgaaactttgaagctttgcattttcaaattttgaattgtagaacaaatgtggtttttcattttaatctctggctaaaacttgtaggtagtctttctcccacatactaacttcaaatttgattattcttttttctaaaattttctaaattcatgatctatcaatttgttgtgttattacaactattatttttgtcatattttcatgtgactttgttttatcaattgaagatttaaatttcaaaaagtggcaacttcaaacgatattttgaagcagtaaatgatttcagctaaaaaagtcatgaacacaaaagttgtagaactgattgagatctacaaatttatttttggtcatttgttcattccgcaaagtgatagtaatgtggatcacaagatttacacatctcccttataaattatgaaaccatgtgggagatatgtaaaacttgtgaacaatgttacaatcactttatcggatgaacaaatgaccaaaataaaaattgtagatttagatgtattatacaactttgttgttgatgactttttcagttagatctggatggttgagaatttcgtcagatagttgctctagattgttctgtcagtgttgcgcccttgcgctaattgctagactatatggttagtgaaatccaagttgtctcgtcaaactccatcttagagtttcaaagatagaaacgtttttctttttcgaatcacagggaataacgggaaaaattcccctcttcttagtattgataatatttgtttgtatatgcacgatcatctaagtatatacttgttcttaggtgcaaatcagaaaactttattgaggatatatgaagtagtgaatgttgaatgaccttctcaatggatttaaacgcctcagcattgcctgtggaagatgaacaaccttatgaacaacatgtcgaggttgattttgcataggaggatcatgttgagtctgctgttgctacaatgcaaagatttcactttttcatacagtgaacagagtatgcaggtagattatcaatcatttagttaacatcaagacacattttaaattggtcagaaaaatcatataaataaatgcatatgagttgaatactatacatgtatttggttagtggagataagattagtaaagaacctattagattgattatgaataaataaattggtatatggtgacagtagtagtttatatttaatcaagtgaccatagagggacattcagcagaaacactctgtaggaaattatgctgagcacctaaagataattggaatgtatatcttaacggtagagcatgtaaggaacgaacttgttcagagcatagcacgacaaatactagtttgtacaggtcatgagtaatataaagtttatccaatcgttaattgcatctcgtgagtaatataggtgcaagtctgtaacaatatcaaagattaatattctcatatagtgtgatgctagcagtatgtagtatttatacgattaatatgaatagtgagtgtattgatacatcttgcgtttaatgcagatctatgagcagaactagtaggtctctatagcatatcatcttaaaaaaacagagcagtttagagtaaagcagtcattagaccattcagagaaatcaatcaccatatgtttgtttcttgataaagttcagtaatcgataatctagaattgacatggttatataagttttcatccatataaataaatatagtgttaaagtgaagcttcataaggacctgatcatgatagtgtgttattgactctagtattatttaacttactgaatgcaagtatatataaggaacgatcatattagagtgatttcaaattttagtactgcattttcatatgatgatttctggaagcagacattcattcataagcatattggcataattcaatcatattaatttaattgatcaagtattactattaggcaatcagcggagcataccatgattccatgaatattcataggttgaccaataggacttttctaattagttgttgtgactgttgtacaccaagcatatcatagtgcatttcattagcatcggtactctttgtatttatttgtttcatcgtttatttcagttggttgttatctttgatttcttggagttcttattggcttattcgttcttcgatttcaggtatctcaggcaagtccaacacctttgaccaactcttgttatattttcgtaattgcaatctatatgtatcacattgcattaaattgtactttctataattaaaatatatgttccaaattgtctgatttatcttcattcctataggtttattctggtgacttatctagtggtgtgcttgttcaaccatcgacattgcgtgattatgatgacagagataggttctgcatttttcttttacctgggggtggcaacagaaaggttagttgctcttacttttgcggggtttcgtcccatagtttttatttttatttatttaagcaagcatatcttccttgagtgagatatctgcagttgacaagacttttatattaagaagagggcctctagtaaaaacccttgatgaagctagtgtagaactaattttttatagaaccattctaaactgccatttggttatctttttctagtgaaattccactaacgatgtgcaaacaacaatctctatcaggatattttgccaccgtatatcattgaagttatagtaaatagggatgttactgaggtggccttgttcgtttgcactgctataggcttatttgcacttccagttcactgccttacatttttggtttttggtcttgcaagcagctagaggatggcatgaactggtggactacatccagaattttcaccaccaacctggagctgctggtctgatgcaagatgctcctggttgagcttctgttctgattcaagatgctgatggttgagctgtcctattgttctttgtcctttagacttaggggcaattgcaaatttaccactactttgaatcattattgcaaaactgccactagaaaattgcaaaaatgccactagaactgtcattcgagtggtatccttgcaatattcaaaaaaccggtggcaaatttgcaaatgccccttagacttattgttcttgtgttgagcttgtgctcctggtgttgcaagttgggctacgtctcttagactcatgatttgcatgcttctgatgcaaaggtgaaacttgcgattgttcgcattgcttttgcatggatattgagctgttttgaaatggtctggctgcttctgttctgataatggtttggttgctgttgtgggctgaaatcattgtggactgaaatgtttatgggctgaaatcactccgagcaagaatcattgtgggctgaaatgtctatgggccgaaattttgggccaaaagtggcacacttctaaaatcggcccattaataaatggcccatgaatgtaaattcaacgtctatgtcagcatgcacgtcattgtccatgtcagcatccacgtcatcatgagtaccatgtaagcagcgacgtcattatccacgtaggcagccatgtcattgtccatgttggcagccacatcactattggctgccacgtcatcgtccacgttggtagccacatcactatccatgtcagcagccagatcactatccatgtcagcaggaatccgcgacgtttattttcatcgctaaaactgggctttggactgggctgcatgggccttggactgttctgcgacggtcaaaaaccgtcacggatcacttcaatccgcaacggttttgaagaatcgtcggtcgatttaatcaatcacgctcgatcaataacgaaatctgaaaccatcacggatggtgaattgtaacgaattttcaacgacccgcgacaaaatgattccgtcacagaataaatagcatgttgtagtgccatccaactgatcgtaatccccatcagtcttgtcctcaactccgccgatttttcttttgcctgggagaaccacgtgacgcttaggctcatcaggccctctgcccttctttcctttgctagacatgtccttcacgtaaaagacttgcgttacatcattggcaaggacaaaaggttcgtccgagtatccaaccttgttaaggtcaaccgttgtcatcccactgtcattaatcattacgccttcaccagtcaacctaacccattggcaccggaacagatggaccttgagaggatcatagtcaagttcccatatgtcctcgatggcaccgtaatacgtgtcagttgttcaattgtgtcccatggcatcgacacgaacagcgctgttttggttcgtgctcttcatgtcttgggctctcgtgtagaatgtgtacccattgatcttatatccctggaatgtcgcgatcgacccagacggtcccctcgctaggaaggcaagttgttggttgatcgactcgttacccatgagatgttgtcgtagccacgcggggaaagtatcaatgtgatgccgtgtaatccatgcatcggacttgccgatgttcctggcgcgaactagagccaagtgctcctcgatgtaaggagttaccaatgaagattgttgtagaaccgtgaaatgggctttacggaataaattgttgtctaccgtcattattgctttccttccgagagttccctttccccgtagtctcccttcatggcgtgattcaggtacctcgattgggcgaaggtcttcgataaattcaacgcaaaattcgatgacttcttctgttccataacccttggcgatacttgcctctggacgagcacggttacgaacatacttcttcagaacgcccatgtacctctcgaaaggaaacatgttgtgtaggaacacaggcccgaaaatactgatctctttgacaaggtgacaaagcagatgcgtcattatattgaaaaatgaaggtggaaatatcaactcaaaactgacgacacattgcaccacatcattctgaagggcttctaatctatccggatcgatgaccttctgcgaaattgcgttcatgtatgcacatagctttgttattgttgcccggacattgtctggaaggataccccttattacaactggtagcagttgtgtcatcaatacgtgacagtcatgagactttaggtttgtgaacttcttctccttcgtgcttattattcgcttgatattcgtggagtatccagatggtacctttatgctctccaagcattcaaacatactttccttctctgccttgctaagagtgtagctggctggactcaagtaatggcttcctttctcctttggttccgggtgaaggtcgacgcgttgttccatatgcttcagatcattacgtgcttccagagtatctttcgactttccgtatacacctaggaagccaagaaggtttacgcaaaggttcttagtgaggtgcatcacaccgattgcgtggcggacgtccaagaattcccaatagggtaactcccaaaatatagagttctttttccatatcgccgcgtgaccatcttcgctctctataggctggcttccaggcccctttccaaacactactttaagatctttaaccatagcaaacactgttttcccgctgcgatgtttaggcttcgtacgatggtccgccttatattcaaagtgcttgcctttctttcataccgggtagtttgctgcaaggaatcgacgatgacccatgtatacaaccttcctacagtgcttaagatacgtactttctgtttcatacatacagtgagtgcaagccttgtaccccttgttggactgtccggataggttgctaagtgcaggccaatcgttgatggttacgaacagcagcgcttgtaggttaaactcctcctgtttgtcctcgtcccacatggggacaccttccttcttccacaacagtttaaaatcttcgaccagtggtcttaggtacacatcgatgtcgttaccaggttgcttggggccctgaataataatcggcatcattatgtacttcctcttcatgcatagctagggggaggttgtagatacacatcgtaacgggcctagtgctatggccgctgctcatctctccaaaaggatttatgccatccgtactcaaaccaaaccgtatgtttcgtgcgtcctttccaaagtatttaaattttctatcgatgtttcgccactgcgaaccatcggcggggtgtctcagca

SEQ ID NO: 33314 - DNA, 3270 bp, Oryza sativa
atataggatacaatcattcggacatgcgtgaatcttctaaacttccagtcctagagggtagactatcttcttagcctcgtacgttgtctcaggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtacaacgacgttctatggtcctctaacatcttgtccaatttatgggcccccttttcactttcgcagtcctccttggcatcctgcaacatctgaccaagatcatccgcaacgtcgttaccatcagcatccctttccttctcgcccgtttgatttccttcaaatccaacgtactgagcaaagtccggaatattgtcgtcttccacttcatcttcttccatttcaacaccttgctcttcgtgggatgtccaacaattatagcttggcatgaaccccgactcaaacaagtggaaatgaatagttctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgacatgaaaaaaaatcgtacacaaataattattcttacaataatgacagtcatacaataattataagataattacaaactctttcaacagtcatacaataatgacatatctttattcatacaaaaatcataaaatattacaccaaataattcttatttactatttctattaatgtgttttacttcttttaattttaattttactttgttttctattatttaagattaactttcactatattttccttctcaactattttataaaaccttctttagcaaatcaactaaatttctatatattctttcttccccacacaaattttctctctcatcaacttacaactaaattttggagacaaaaaagtatgcaaaacatagctccaaatgtaatatgacaaaaaaaaactttggaggatgaagttgcaaaccttttaggcacctctgatttgtaagtaatcaccaaaataaattcactagaaattttggcatgacctcccctctcttttttgaagaaattttgaagcttgcttggccagctaggggaggaagaagacatatatatataggggtgagactttagtcctagttggtaacaccaaccggggctaaagatccccgggatctttagtcccggctggtaacaccaaccgggactaaagttaactttgcctgacaggccctgacagcatttgaaccgggactaaagatcaaatatgcccgttaccctttttaaccgggactaaagatcatctttagccccggtttttattgcatccgggactattgtggaattcggccgaccgacaaaagatggtttctccaccagtgataggacggatgatggatgctagctgctcgtgcaagggggtaggcttcattgggccctagcctaccctctgatttttaaaaaaagaaaatctgaaaaaaaaatctaagatgggcatgcattggagaagagaccagcgttgggaattgaggaagatatgcacattcagcgcttggggatcatgattgggatggacactcccatttggctaattcgacacttcacaccacaaatccactgctccctccgtcctaaaaaagacaaaccctagttttcgtgtccaatgtttgatcatccatcttatttgaaaaaattatgaaaaaaaataaaaagacaagtcacgcataaaatattaatcatgttttatcatctaacaataatgaaaatacgaattataaaaaaatttcatataagacggacagttaaagttagacacggaaacctagggtttgactttttttttagaacggagggagtagttatttggctgagggctccttagccaggattggactgcagcaagagctagacgtcatgttattatatagctagcgagacagtctatggagtatcacattatataattatctatatctagtataaaaaggagttcacccctaacaattctacaggtaaaatcatcacatctcatctcatccgtccatccgtcatctcatctaatctcatccgttaatcgctatcctgctcgctgtagaaatcatcaccaatctcacccgattcctccaccgcactttctgcccgcgcgatgactccgccgccacgaatccccgctgcctcctccctcctcctccctcccccatgcctagggaggccacgatgggctcctggccagtcaccgccgccagcaatgcccgacaacgcaacgccctactacgccaagggaaggccacgaggggcttcccgcttgccgtcgcggccgccatgccctcctccgcactggaccgctgccactcactccgcgcccggcgacactatggcctccctctgtcgcaccaaagggagcttcccattcaccgcctccatcgtgtcgtgagggacctccacttgtggcacttctgacgctgcgacgcagtggagggcattgcctctggtggcaccatggttctactgccatttaccggaatcatatcatttagtggtttcaatctcttctcccccttccaattcattgttttgtttctgcaatttggttgacaaagcaagttcctttattgtctggacatactgtattttgcccagtaggtgttcaattaaatgccactgaaataatctgaatcagagccggtttaatcatgcatctacgtggacacatcctttagttttattgtctaataggtattgattatgtatatagcagtgccataagaatttttctctacagctcattcaagcattcaacaatgctgggctgatttttggaatgagcaatataagtttaacattgttccatgtttttgcttgtaggatgtatacttctattgttgtccttaccctcatacctgcgtatgtgtagtaataaatattggttgcataagaatgacacagaagactgagtgggtctttgttgcgaacccaaaaggcctatagatcttactggtaattcctacaaggaccaaactccatttatagatatttgcacatttatgctatttgcttttgcttgttctgtacaatattctcctatttaccctctggggtcaacctgtactcaacacgtgccacaccaat

SEQ ID NO: 33315 - DNA, 3110 bp, Oryza sativa
  unsure (1)..(3110): unsure at all n locations
tcctgcagccctaatgtgcagcctctagacatattgcaaggaatttggcatcaatgtttttctgttactgtattttctatgtatctgtcaatgcttgactgaatattttattgccatttaaccacccatgatgtgttaatgccacaagcagctatgatagacggtgatgatgacaacgatgatgaaagttatctcatgagaggtcaaggtaattatgactcaatttctactgttggtcaagtttatcatgacaagtatcacagagaagagcaggctttcagatttattatgaatcgatttcattttcatgcttatactacattacaaacaatgcacatattggtaactctttacatcataagtggtagatcattttagaagccctgttcacttttagaatttacaggttgaatttgattggaaatcagctctgcaatgtcctctcaatcaaggaggagcctatgtcgattacttgagctttttagccatgttaatgattgttgatatcgcttgtaatctttgtctccaacaacacattgctcacaagtgggctggttgaactccatatgaatgtgcataaactcaaggtgactatgatattataaatctttctgttgatatttcccataagtcttccacttgagatatattagatattccaaatccatattaacctgtttacagtgaaatttggggccactttaaagaagaggggcgaagaagatctgtaagttagaaggtgtgctgcttcattagaatatatcatttgcgtatttctcaaataaaatattttggttgattatttccagtatgcactcctctgaagtaattcatggtctttgtatttttcttatggatgtatacttggtgttttctgttgttggtgcaaataggtgagcaacatggatggtgatggtgttctgacgtccaaatatgaaaccagccaaccaggtcaccactatgttgcattatttttcttcgtattgtctactcaatatattgctgattttaagtatagagtcaatcgttaatccatgtgtaggatgttcagaagcaatgctaggcttaattagtgcgattatcatggtgtggcagatgaggttgagttcttgagtttatagccttcagtgatgttttttaaaactaattcactgctgcatgtcactgttacgttgaattgctgaactacgtccctgtggcattagaggatccaaaattcttgccttgctacatgctactatgattaatcagggtcaattttctgccatacatattcatttgagcagtttttttgttatgttcaatcagtggatgaaaaaagtcaatgccatgcattttaatataggggaatacagaaatccacctcagttgctttcactcaattaggtagtctactcgaatcctctgctattatttgactcaaaccaaatttaattatatcttttttgtgtttggaaaaatgtgtctaatttagtttgagcatgggatcagagtaggattaaattaataatcaatatttgaattcaaaagataaatgataataatgctgatacaattaatcaaaattctaaaaatgaactaattgaggattatagataatatcttggtaaatatatggaggcattgtaagagaacctacagatcatatcagttgaaatagacatgcagattaccttgtgatgtgcccattctccatgttaatctggtacatctccatcaatttttcacgagttacatgagataaattgattcaataattgatattttatattttcagcttggcagcctgaagatcttttggaccaaaagggcaggcctctttcccaaggtgaagcacttcgtagctacaatatgcgagtgctcagcctatacaccatatccttatatgagtatgctgagagttttattctccattgaggtgaagtatgctcaaaagtttcgttaaaatatattcagtttagtgattttgttcatgaactaactcacttcactaccatgaactcatttctccaaaattttggatcttttattagcaaatctatggactgaagtggggttttggccagagctccaatcccctgcaaatcccaaatgcagtacgagtaatattttgcaaaattatgtactccagttctattggaattgatgtaaaaccaacaaattcttagttttgtcagttattaaaacgcatagatgcatattgtgtatgacattatatcaaacgtgcgttgcacgtacatgattactagtaactacaaaaagaacgtgcctcttggaacgcttgctaattgagcctgtaatattttatttagatattatttggaatatgagattcttttaaagcaaatagttttaagacttataaagttgatgtaaatatcatacgttaagtatcctttagtgtgttctagttttaattttgtagaataccgaggaagaatatcatggtgtggaataactttcagctccatccttaggagcataatatttgcaaataaaaattaatttatgaataaaacttttatatatgttcttaatgatctaaaagcaaatgctgaaaaataaactacaatgaaaacccctaaaatcaactctaaatttagagttaaaaattgaaatttaggctgataagtataagcataagcgaaaagataagttcgtttgttttaaattttaacttattggtgaagatgatatttttaatatataaatgcttattttttaaaatattctacaccgctttggtaatttttaaagttttgaatacaaatagttataataattagaataaaataatgtttatatttataaccttccacccaattccctgcatccttgcatcacatctccaacccctgcctccacgcgatcttccacaatcgtaccccccacctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 33316 - DNA, 474 bp, Oryza sativa
ctggactactcgagaaaaggttgttaacggataattcctcgcgaacgtcgtcggcttgatcacctgacatgattgtgaacggacatccggatatgctacaagttgggtgcatgagtcatcctggtcacatgagacgcacataataaaccaactctagcacttccattggtgtgcgagagatcattctacacgttcgctggtcctcgaaccagtacatagtaatctctcgcaccgcaagcttccatcggtgttcgagagataattctacacgttcgctggtcctcgaaccagtacgtagcaatctctcgcaccgcaacctccattggtgttgagagatgattctgcgtgttcgctggtcctcgaaccagtacgtagcaatctctcgcaccgcaaccttagatggtcgaggtacgactacagcaatagcgcaacggtcctagcaccatgaattcaaatgatcgagagacacctact

SEQ ID NO: 33317 - DNA, 3705 bp, Oryza sativa
  unsure (1)..(3705): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatttaatctgagcacaaccttgaagtaacagaaagccagaaaatcctcagagaatgtgtaagaaatgtggcaaaactatataaaatttcagaaaagaatactattatgccgagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaaattttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggccccttatgccacctataagacagcaatactgaacagctgttcaaaagtcaaaaaaattccaacgatttccaccaaagttttctacattattatttttttacttctgcgctgattaattcatgatatcactttgcatatgtttcaaaatttctttaatacttgaagattgataattgtattcctgttaattccattctaaacaaatagctgttgaattcttgtcatttgtattgtgccttcacacatttactataaactgttcaagatgtccacatatgatcgattaataactcgatctttatcatgatgaattctagagggatgaagaaattagtatggcaccagaggaaccagtactggtagacaacaacaaccaagaggaaaacagtttgcaacaattgaatctactggctgatacatcagagtggttcaagaacatggatgatgatgatgagtcacccctatggctaaacgtactgctgagaaccgcattctggaggaagtgtgacgtgcatgatcagcttgaaaatacacatagggctgaggaaagcatcttctgcaccaactgcctcaagacaatatgcccacactgcaaacatgatcaaccgagccaccaactcctcaaggtccgccgctacatcttccgcagcgtcgtccatgtcaaggacatgcagaattttggtattgacatgtcttacatacaggtattacttagataaaattaatgcccatgctttgctatggataaaagaaaatatattataatatgcaatagatattttaaaattatcgaatatgttagtatcacttgtttacttgtttgaatatatggtatttacttgtttgaaccaaatatttggactattccataatatcaaaaaaaataaaaataaatcaggagcatatttgtaaaaaactgtaaaagcagtggtgaggggacttttaaaggagtatagatgtatagttggcactgtggttaatcaacttggaaagttagtttctctagctccaactagtttaattagcttgtttcgaattaatcatgataagttcgtttgtgtaaggtttgtgtgcaataaatctttgttatttaaaactcctaatttgatggaagcaacaacaaattataatctgatcactatttgcttcatttttcttgtttagtcctagcattagtaatgataatttattttgcgacaatgtgggtttgaaggcaaataggctggtctccatttagagcccttgcaaacccatcctaactggttcactgatcagctagctagaccacacaggtcagacacaatttgacacaactttgtttggaaacaatttgacacaattagagtcgatcaaacgcactgaatttataatgaaatgaacaataatttttatatataagtgattgcacagtagcgtagtaaaggatgtgtcttgcggcctaatactactaggataaatggcaattaatagtgtcccggaggtgaatgccatgatcatctgaactcaacttttttttatttaaattactaccattctgaactcaactttaggctagaaataaaagatttaattttgttcaaacacatggattgattagaaaactgttttagctcatctgaaatgcataatttggtgcatatatatttattgattcaaaatatgtatctaattaatatcatgtagttatgcaagcacatctatgtaatcaaaatatttacaaagatatgtgtactcatataatgcatccatcacatgaagtgatcaaatcttcttatgaccatattacattgtataattcagtaataacttagtgaaatcttgaaaacatgaaagcacacattttttttttgcctttttagctttcatgtcactaagttattattacgatcatatcagttttgataattcagtaataacttagcaacatgatttcccatgaaatctcgaaaacatgaaatcaaatattttctagggttaagttctggacatatatacgcagaaataaactgcgatagttgcatacacagaaatagttataaattaataacataaatatttcacatcgaaacctaatagtgttactgaagaaaatcgatcggtaattactacacattttctcacatgtacatataatagttaatactacaataacaaacttgatcagccacttactcccccatatatatatgtgtgtgtgtgttatcccgcaatgctagctagcattagatcgatccaaaacctccaactgtatcggttcttcaaaaatcttttttttttgcatttgatcaatttgtactaactttttccaaaactgattgcattttctcatacagaaacatactccctgcgtcccaaaaaaatttcaattctagggatgaatctagactcttttttttttttggggggggggggggacggaggaagtacatacaaatacatcttgggaaatcatgcatgtttggtttgcatagtttatgaatatattggtat

SEQ ID NO: 33318 - DNA, 7012 bp, Oryza sativa
gcaatgggcacaaagtagtgcacctaaggcccatgaagaggtccaaacatcacagacctaaggctgggacacctcgctgcacgacttgccagtgctggctccacaatgcacccagcctcacctgttcacttagctgcaaggttattttcatcatatatgcacaagtactgttatttatcatgatcatgttgactcaattgattttgtttagtgggcaagctatgtgctatatattgatggataaggttgtttgttgtgctttactagatttcaccctacgtagctagactactagctattgttaactttttttttctaatatctctcttctccaattctgatagaaaaaggcaggtatatcaccaaatgacttctcagggtctgaagcttcaactcgagtttctcgttcacggaaccaagcatcagatgccaatcagaaacgtccaattgccaatacaaagctgcgtaaaaggccttgcaagcaagcgaaccctgaaagggctccattcttttgatgtgaatgtgtcccaaaactgctgaataatttagctgcaagaccgcagctttcgtgcgtattatttatttgtcatgtttaagttgtactgtgcaacatgtttgtcacattccgactgatacctggcattagttgctttctcatttgctggtcctttgctccttatcaaaataataatccagtttaaactggtgaacattaattattttgtgattgactattgttctatcccttcttttgtttcttattctgaacacaggtgttgcattttctttctgagatttgtgtttgttgatttggtgatttggtctgactttgaaacgataattacctttccctttcaaattattattcgaatattcaatatgtgagttgacatgagtttgctaacttttgttggagtcaattttgtcgtgaattttcattgttatcttgttcagaagtccaaactaacatataaatagtatatggcatccgcattgcaattttttgctttcttattctattgtaacttaaatcgagcaaaactaccaaccgtgatgcaaaatctctatctcagttcacagtctacctaatgagatgactaggagacaaacacaaagaacaagattacacaaacacatgaagttcctcgggtctaggtaattccttcccgccctctgaacacaagttcaagaataaaaacaaacaagaactaagcacacccaacaaccagaagagggggaggaaaactctaggcactcacactacacatggtacaaaaggtgcacaacacaaattgatttatcctcagcctctgtagcgattgaaaaacaccttttcccaattgctagtgcattgatcccgtccccggaaaagccagggtacacttcaacaatcatgatacaaaagacacatatttattgtatcgataatatttacattattacaaaggctcttcaggcctaacaaacaaaaaataaatagcagcagaccagcgggcctacgacaacatcttcataggcgctcaactggggtataagccaagactccacctcggactcttttctaaagtttcttttactgaaggttggaaagattgagcaagaatgagtacaaccacagtactcagcaagtcaaaccgggagaggcatgattaatgcaaggggtacaaggagtaataacatgggggttaggttaaaaattagtttgactccaaattgaaaaccatgcttctcaacaaatgaaacttttctatggttgacatgtacactctttatttttgctaacacttacttgtgaacatatatctattgtaggaacccttgctaatctaagtaattgatatttgtgatatggagatgacaaaagaaattcctttctaactgtcatgatatttgggattttatctttgcaaaaaaataaatttttgagcaatactccttagtgactatatgattacctaccaaaggccaaatatgattcatcttgcaaaccatatattttggttgcttgacattacattgagccttgtgtgtgacctatgtgagatgcttttcatgctttatgatcaagatcacacacactccacatagattaacatcctgaacttctacactagaagctagtgtccatttcatccatcatccacaaaataaatactcctcgttatttatgtatttttctccaaagttcattcaaaggaaaagggaggcatggctatgcaaaagaaagaaagaaagaaataataaagtcttgctcatacaaatatgaagcatgagaacaaaaagatagccatgccatctctcaagtctcaaaagaaggagaaagatgtgtagaaggagttatcattttccttttccacccacaatcatacacatgcacattcttgatcagaaagtgtgacttgctatctccttggggccccttttttggcctggcaaaatatgtgatgcaggtacaccccgattgatccctaccgagctccacatatatagccttctagaatagggacaattcggcaatacatgccttggtgaggatccaacaatcaaaatgagtgattcaagagagtcatatgaggagtatagctatattttgaaaatatatgaaaaactcaagtgattgacaggaggaacaggaacgacttgagtcacgaccattcgatttatcaattacccaagatggtaagatagacactgcaaagttcataggtataggtgtggcttagaataaattgtatactagtaccataccttgggatgttttattccacaatagtccttaacctttagtcgagatgagtaaagagctaagtgtgggggtttgttgtaatgccccgattttcattcaggattaaaaatcaattaataatgcattttctagaaattaaataaaagtaaagcaatttaatcaagtgaaattattgagggaatttaaaatttcctttaaaaatcatggccgggaatattttgtaatattctttgcgccctaaaatattctctaaaattttcccgtgaattttcagagctcaagaagtaattataataatacaaagttcattaaaccaattaaataaaaacgaaaacgaattaaaatcctccttctttgatttgggccgtttccggcccaagtttcctcctcctcaggccggcctccctcctctctccttccttctcggcgcccaaggcccgtccccttgcaaagttcacttctccttccccaaccgtctcctcctccctccctcgccgacaggtgggcctggtgaccccacttgtaagctcctccttctaccttcggcctccagagccgaagccgccatgcggcgcctttgccgtcccacgtcgcccatgattccggcctctcccgctcgtgccctcgcgcccaaaccgcatgaaatcggtttccctccacctcctctacactctccccatgtttcccccaaaaatcgtgccgggatcgaactccacttggcccatgatgttgcccatgtcgccggccattgccgcccgattctgccttctcgaccacaattttcctcccccgcacccatataatgcatcgcccagctctcctctaccgtttcccctcctcccccgagcttcccatagcctccctcgctctccccatgccatcccccacttctgccgctttccggcgagctacagccacgtgctaccgccgccatagccgccgtcgcaccatgccaccgccaccactggctccgcagcgccgagccaaagcccggccaccacttcccctccccaaaccgccgcggaaaccccgtcgccaccaccaatccgagccaccgccgcctccaggtgcctcccgccatcgagcgtcgcctcgctcagccatgccgccgccacccacagcgccccgtccaccgctcctcttccccaatgcattgccaaaacgccgccgccacgttcaccatctctctccgccaccattgccgcctccagccgtgccgcgtcgcctctctggtccacctcgcgctgcgcagtcgccttccccagcaccgcagccatcgtgcgcagctcggcatccactccatctccctcctccacccccgaagcactactcctaccgcgaacccaagccgccactgccattttgtcacatcctgatttttgtttcaggatttataaattatttaataaattattaatagaatttatattaaatgttctttaatttacaagtgaagttaaatgtgggaaataaaatttcctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggaattattaaaaatgatcttaaaagcctaaaagagaagatctaattttaatttgctaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctctccctcggcccaagtcggcccagtccgcagtcgcagccgcccgcgcgagcgccctcggtcgctaacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcgtaagtatttatcgttttagttaatttgatgaatctgtatattaaattgtcagtttgtgtacctcggctgattcctggacgaggattttatgcacagataagttcggaaattactagtgaatttccgggcgtgacaagttggtatcagagccatctcgactgtaggataagccaaatggtcaaaccttaaggactaattttccgaaaatatgatttgtgaaaatttctcctttcttccttatctagaattctttgcaaattgtttcgttgtctactcccctctctctttcaacttgagtagttctgagacattgaaacttgaagacgccaatgatgtcaacttatggaggtcagtcaagtggatcgtggaaggaccgaagtgccaagtggtcaagatggaatgaagtttggatcctatcttagaacctatgccaccaaactatcctcgaagaatagttagtagggtagaacgtttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttatctttagtgtaacccctctccttctatcttctctaatatgcaacagatggtgaacactcgcgccagtggaagtggaaacaataacaatgaagggaacccaactcttgctcaagttctggctcaacagactcagttaatgaacatgatgatacagcagatgcagaaccagctcaaccaagggaacaacaatgctccaccgacgcagaacaagttagctgattttcttcgtgtgaggccgcccaccttttctagcactaccaacccagtggaagcgggtgattggctgcacgctgttgagaagaagttggaactgctccagtgcacggatcaggagaaagttgttttcgcttcacatcagttgcaaggacctgcatcagaatggtgggatcatttccggatgaacagagcagaaggtcaaccaatcaattgggaagagtttaccgaaggattcaagaagacacacatacctgtaggagttgttactttgaagaaacgtgagttcagggcattgaagcaaaaggatcgtaccgtggcagagtatcttcatgagttcaaccgtctggcacgttatgctccagaagatgtgcgtactgacgaggaaaggcaggagaagttcttggaaggcttaaaggatgaactgccagttacgttaatctcccatgactatgttgattttcagcagctggttgacaaagtaattcgacttgaagacaagaagaacaggatggataaccgtaaaaggaaaatgactgtattctaggaggcacaaggtagtagccagagacagcgtatcaagccactccaaattagtgaacctttttccgctggtcaaggacagtcgcaacagttgaacatcggtggtgagatcaaatcagagactaatgaaagcaatgaagttaacatcgagcaagctaatcagccggtgccagttcagcaggaccagtctcaggagaataacagtagtggaagggagcagcaggtatgtttcaattgttacaaggcaggccactttgcaagagagtgtccgaagccgaagcatcagcagccgcaaggtcaggtctacaacattgtcgtcacaggagccaatgcggtgccagttgtgtcttcaagtgttacaactcagccaccagtttcaaagcggcagtagttttctttaaagccttagaataattatcggagttatggaataagatagactgcagtttacctattcccttttctttctagccgttccgaatctcgggacgagattctttgtaaggggggtagatttgtcacatcctgatttttgttttaggatttataaattatttaataaattattaatagaatttatattaaatgttctttaatttacaagtgaagttaaatgtgggaaataaaatttcctaaat

SEQ ID NO: 33319 - DNA, 13690 bp, Oryza sativa
cctagcgccgcgccgccgtcgtctccttccaaatccggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcctccaaaccccgatctttccttcgtgtcaccggtcgccgtgggccttcgtcaccgcctccttgcccctttaaaaggacccccggtgtctcctctacccgtcgccacccttgccttcgtctctagccatcggaagcgccctagtgccgtgtgacctcgagccgccgtcgtcgccgccgctccagccgtgcttcgccgtcgctccagtcgtcgccgtcgctcggggaggtcgccatcatggtcgccaagtcgtcgccgtccccgtccaccgcttcaccgccgccgaagaccgccggagcaccgtcgtcaccgtcgacccgaagaccgtcgccgcttcttcctcgtcgccggcgccgtccgttgcttttccgccgttgttttggtcaccggtgagttcgccgcgtcgccctctacccgttggtgccctccgtttgcgtcgtcgtgccgtcgttcgccggcgagcatgcgttgccgagccgccgccggtgctgacgtcatcgctgacgtagtcgctgacgtcatcgtcgccgttccccgtggctcggtcgtggaccgtttgatctcggccgtccgttttggataggatcgacctcggccgtctgttcccgtgaaccgttgccgtgcacccggtccaccgcaaaccctagccgctgacgcaataattcccttttccttttcaaaaataattcaatattgcgtcataattcaattaaaatccatataagtgttttaacccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattatatttaatctagtaaaattcataataaattcatttgaagtcagaatgaggcccttcaagtctcataattcatctaaaattatgatctacatgtttgtttactttttatgtattgtttatttagtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgactactttattccttgataccttgggttattataacttgactagttgggctttatatatattggttcagctagatattagttatgattgcttagccatgcttagaaacattagcacactattgggataacttatgactcactattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagctagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtaccttccagtatcgcgacgcatggtagacatgatgttgaggctgtgtcttgtgggtacagtggtacacctctggccagagtaaaactattcgaatagccgtgcccgcagttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaattcctaattaattactccactgttttacttctcttaaatgttttgctaaaagctgcttttgcaaatgagcctatattatgccatcctttggtatccttgtgcacttgcatatttgctgtgtggcttgctgagtatgtcatatgctcactttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttattgttttagttaatttgatgaatctgtatattaaattgtcagtttgtgtacctcggctgattcctggacgaggattttatgcacagataagttcggaaattactagtgaatttccgggcgtgacacatttgccacctccagctgccgctcgtcgccacttccgaccaccccaagtcatgccacgaccaccattagctccaccaccgctccactggctccaatcaccgctccagccttcttctccctgttgacgtcgtcccggtcgctgtccgtcacctcacgcccgcagtacaccgtcagaccgccgccatcgtcctcaccctgaggagctcaccgccacctccctccgtcggccatctccctccgttgccgtgtcgctcggtaagcatccccctctcctcctcccatcccttccatcgcttcccgcgccaccgctcgccgtcgattgctggtggctgtgcgccgccgcctcttagctgtccggccgtgagccaccgccgtcccctttggccgtgcaccgccaccatggactcggtccatggtggagcaactcctttgacccgctgacgagtgggccccccgctttgtggacgtggtccgcgctcctcctcttgctgacgtcagcgagcacctattttcctttgagaaaataattattaattgcgtcataaattggtaataattatagaaatttattaaaatggctcaaaacttctaaaattcatatctaattcatacgaactctaaattgggccattcaagttgcaaaattcatctaaaattgagctctacatgtttgtttactttttatgtactgtttccttggtttttattagggtttttcctcgttttgcatgccaacgtgtagtttccgcagtttcggaagtccgcggtcgcgaggaaaagagttcggaagatcaaagtgaagaagcaaggcaagtcacacattacccttgagcatattgatgctactttataaatgttttgtcgtttgcaaataaatatacatgttttgctaattacatgggatccgggtattacctatgctcgcttgtgccatgtttacttgttacccgacctttgtcaacctcgggtgataatttatctagctcgtgatacttatgttgtcctagctagaattatatatgcttagccatgcttaattaccactagctcacaaaatgggataattacattattagacatctagtattctgacgagctgtgtgctcgatgtcacgcccggaaattcactagtaatttctgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggctagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctgaaaaaccagaggcatggactccccagcgacccccgtggacttctcgccacttctcagtctggcgcactataatgaatcacgctatacaaaaaataaagtcgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagtaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgatccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggaaaaaaagagcaacggggaggcaagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaataatttataaatcctgaaacgaaaatcaggatgtgacactcgagacatctggccatgtttcatggtcgtaattatccaactaaaatatgactgaatggtgggctatgggtgcatggttttgtgagtcgcacccatggcaattaaggaccagttcacgggaaaccctagaagacatacagtgcttgccacaagcgggagtgggtaactgcttgatctgaagtatagctcaaccctttcctaggcatcggtggcaagggtgggcgtgatggagttaggtcggccggggtgtccggttgtctagctgccggattcaccgcagcgcacaaggggactgcccacctccggggtagggggtgggggtgaaaccttagagtggtgtggatggttaggggagggttatatgaagggtcttgtcacaatcactcgacatggtgatgtgtcaggcctggcgcggtgacatgacgatggattgtgtcttgtgggaacaattgtgcacctctggccagagtaaaactattcgaatagccgtccccgcggttatgggcgatcgaccagattcaccgtgattagtcccaccttaataaattgactcaatgcactgtagttcaggtgggttggttggacctgttcaacgtggtgtagcgttgatcagtggagatttaatgttactttaattactcaacagttttaccgttttgctcaataaaatgttttacaaccgcctttatgcaaattgccacaaaccgtccttgtatccccttgcacgtttgcatcgttagtgtggcttgctgagtacggtggttgtactcagccttgctattgttcccccttttcagaagtgtagtgcttctgagctgaagatgaagttagaggatcaaggctcataccccagttgagttttgcctgtggagtggagctaaagcccagctaggatcgcctttttccgctgctactgcttttgtttcggtgtgaggactaagtgctcttctgtaagtattttacgctttatttacgtttggaactatatattacttgtcgttttgtgtaccctaactggtcctagatagggatttaatacacaaaatagtttgaaaatttgggttaaatttctgggcgtgacatttgttgacgactattaaataccaaatttacgtcgtcaatacctgcataaatatgaaaatatagaacatccaacatagtggtagggtttatttctaacaaattccacgagtgttggtatatatttggatgcatgtgataaattacaaaagttgagatgaaatgtacataaaggagggaaagaattacattcgtatcgaagcccatagactcttgggcccataaacccaacgaaatacctgcaactaggccaaactaccatgccaatgaaataaggacccacatgccatggcctaagaggaaggagtgggccagggggagccagccaggggtcagtcgaccacgcgccgatctccaatggccgcgtgccgtgcggctccgaaacagccacgcagctgctcgtaagtcgtagccatccctcctttgttttccctcctcgtccagtccttatctccttcaaagtgattgagccgaagttcgctattcctctgtagacatcaagagctaatctcgttttcatcccaaaacttctcctgccagatccaagtccggctgtgcagccgtttcgccggcgtcaatcttctgccactgcaccacggcaccgcaggaacacctctcatcggtgagaacatccccaacctttctccccttctttccttgcttgggtcgagctcccatcgtgctcctgtccaccaccatggctaccaccgtggtcagtttttccggcgcctcatctatatcaactaaccacaaaaatggaaccttctcatcccggaacgcattttgacacgctcactcgccccgttcgccaccggagctgccacttccatgcccggtgtggcggtgtcaccatagctccagatctggaactcgcgttccggctagcttcgttgtcttccagcccagcgtccacgtcctgtgggggtgtcagcctgtggaacacgtcatgctatcgtatccgtcgccgttccctcactggagctctagagcttttctctcacctctgttactcacgtgaaaagccaccggaagaagatgaatggcagcactgtttcctattggtaccatcaaaaccacctaaatagtgcctaaccacagtaaaaccagtccaaacaattctattatgatgtttttctcatgttcgagctctaaaacaccaaatcaatttcagttttcacccttgtcatctatagcattaattgcaaattgcaatcgctactacatataccatgaatcataaccctagaataaatcttttgtcatccaaatcaagttaactcttgatttatcattttcttttgttcgggctccgattcacaatatttattttatcgtttatttataatatttttattataggcttatttggtcgtttcttcgtgtgcgcatgttagatcgtgttgaagattccaccggattcacaggaactgaagtggacctagaaggctacgctcaagcttcagaaggccacgttccacaaggcaagccacagttccaatctttgatcatattgaaatatagtagagaaccacttagttattttctgcattgagtatttataaaattattttgcgtatgaattattttttaataaacttgttagtttagttattacccattattacattgttattattggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggtgaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgctaccaatccgggactaaagatcgctatcattagtcccgggtgaaataaccgggactaaagatcgatctttagtcccggttggtaacaccaacgggactaaagatggctcagccacgtggccggatgagccatatttactcccggttggtggagctgaccatttttttttttcatggccctgttgctgcatggtttatatatattttatatatatatataaaccatgcatatatatgtttcaatacatatatatgcatatataatatatgcatatatatatatattatattatatttatatatgtttcaatacatatgtacatgcataatatatatgtatttataaatatatatgttatgcaaatgcatatgtatatatatatatatatatatatatatatatatatatatatatatatatatatatatatatatatatatatatatatatatatatatatagaccaaaatatatttacattatagaaaatgtgtacacatgcatatagaaacatatgtagtcatgtattaatatatatgtatttatacatatatatgttatgcaaatgcatatgtatatatatatatatatatatatatatatatatatatgaccaaaatatatttacattatagaaaatgtgtacacatgcatatagaaatatatgtagtcataaattccttgtgtgtggtctggttatccctcatgcgaataaaatatatgaatgtatgaaattgattagtaattaaacaacaaatcgatacgtaatgaaattttgaatttatttgtacgtacatcgagctctcttgtggtgatgatttggtctgcaaggcagtggcaatactcgcacacgtagtagccgcacaagttagttccctgcttttgctttgcgcagtacaaataaatgacaaacgacgagagatctaattaatatacacttgtatgtatttgaatcggagaaatataaatgtagagcatgtgtactcacaggaaatttgaacttccgcctaagtctttctctccagttgccgcggaccaaatgacggaaccgataccaagccctacatggagtttaaagctttgattcgtagtagcaattaacataacaagatgttcttaattaacaaaggaacttatgacagtacctatctataagttcgaaaaccttgtcaaacgtagactcttttttatccattgagtcatatacgttgacggtgcaggccgccaggtcgaagagtaaaagcacccagtggaatctgcaatgtgcgtgggatgcattacatatgaaacacttagcaagttcgtacgggaatgaaatttggtataggaagacagtaaaattaaacttaactctgtgttgtacggcaacagtatgaacgtcttgtaatgctgcgccttcaggagatggacgagattgtcctctgtggcttgcggatattagtcgagcattgcgacgtttactttccgagggtcgatgaatccagtatcgaaacccccctgccgtcgggccctttgaatctccattctacaacgataaagggagtatatattatatatagtctacttatttacaaggacctaattaattaaaggagacgtagtaagaaatctaactgaacgatatacttacaaaatccagcaactcataatagagccgtcgagggcgtccagctggtatggttcgtagattccgttgaaattgatccagagaatgtcatctccttgcaagaagtttgtgtccctgatcctcgctccgatcatctctctaccggtggcactcatctccatgtacagctgatggaacttgtacatttgtgtgggtagggattgcagcagctcaggcttgacaagcagtttaccgagttcgtacatgtatttcacttccgccttttcgattggtgcgactcctagcaattgatccgtagttagactggtatcattaataaattcttctattccaatatcttcaccggtcaccaacgactcaatctcttggtttggttgctctccaagctgagggactggtttggactttccagaagatgctttctttagcgtttgctcatagttcgatagctttatggtctccttggcaggtgtagacatacccctgaagaagttcctgacactcgggtctataggaatcttcttttctggacttcgaggcttgaattgtctcttgacttctgatgtcacgtaagcgtcaagctcctcttgcttacaatcataccccgggtccttgttcttggcggcttcaactttcgcctttttcgttgcccttgtgtgggcaggtggtggagcttggggggctcttgactttgaaggtgccggaagaggagcttgcgaaggagtcggtgcaagagcctgaggaggagtcggtgcaagatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaactttgaccttggagtatcttgctagaatcggcctgcagtggtaagtacctgaagggtccgttgggatgaccatgcccgacgccaccttcatgtggtgagaggttatttattattaatcaacatatataagcagcaactagcggaatggtcaaatctaaaatatataaactacgagcttacctttattgataagttcttgaaaggaatatgcagctcacatggtgtccgctgagtgatgtcatcaacggggcaggtggattcgtcctgggtttgcatggcatccatgctctgtgatcctacctgccccgttgaggcgcagctgctacggtttcctgacgggctcaccattgcaggaggaatggtcgactggggatcatgggaccgatgtgcggccatgcgttcatcaaccttccttgccacctcctcttgcatgctgagctcgtagctcgataccctgaactctagatctgcaatcttcgcctcggtatctttcttgctcctcatccgactctgtacgtgtggatgtcctccttgaac

SEQ ID NO: 33320 - DNA, 2636 bp, Oryza sativa
atcaccccttttccctcgtgtttgtcctgaatgctctggagtctgcagggcgagtgacagctcgtccctctctctgtccggtcggaacgtgccctgagaagaggcttccactgcgtctgttagtcgacgcgcagcctcgtgtatctgatcgccgaagaccagggagccatcagctgggttgagcgttccaccgtgagcatagtactagaacttcgatcgttccggccaattagcggtggccagttcgatacccctctcaagcaagctagcctccatctcctcccacttcagcatcgcgacgctatagccgcctgaccccaagtggtgatggtacttcttcttggcgacattttctttgtttctttccatcatcgcctgcccttgttcacctgtcttatatgcaacgaactcgtcccagtgatcccttagctttgggaatgtgtcgaagttcggtgtctgccccttcaggatatatttcttgtacagatctcccttgaagctctgaaactgttctgccattttcttcagagtccaccttttcactttgtcctctgtacccgcgggaagggtgaatgtctcgagcattgtggtccacagcatctctttctccgaatctgggataaagctctcatgatctccgtgtgcccttgttctgcgcccgtacaccgtactgacaggcacgttatcccgcacaaccgaaccgctgtgacgtacatagttcttggcggcttctgccgaggcactaggtcgtccgtcttcatccacttccgttatgatgtgccgaccctcaagcttcttcgcggcacctcgttgcccgcgtgccctcttctgtccaacgaagggctgacttccactagccttctcctcctggttcccctccacatccctttccacgtgcccctcctggttcccctccgcatccctctccacgttcccttcctcgtttaaatactggtttggattctcgttcccctcttcttcgttccagtactggctgcttccctccgcgattgtatcgtacaatatctattcctcatcgcgatcagccatctgttcatacaggaaacatctgctaagtcatgagacatttatgttttaacaatcttatatgctaacaatcatatgctaagtctaggtgacgtatattataggaccctagctagtcaataattatatactaagtctaattacaaatataataatcttatattaaaactcaaataatcttatactaaaactaaaatagttatgtatgctaagtgtaactatcgtatattagaaccctacacaatcttatatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatactaaaactaaaatagtcatgtatgctaagtgtaactgtcgtatattagaaccctacacaatcttatatgctaagtctaattacaaatctaataatcttatactaaaactcaaatagtgatatatgctaagtctaagtgtcgtatattaaatctaatagtcttattagcattacaaatataacaatcatatatataattatgtcacttgtctgcgcgaattccttcgagggctagctaccacttcggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattcacctgcctatattgcatttcacgttcacgttcgttcactattgttcacgatcgtgcacgttcacgttcgttagtttacgttcgttcacgttaacgttcgttgacgttcgttcacgctcgttagttcacgttcgtttgttctttcacgttcaattctcgttcacgttcgttcgctcgttcacgttcgttcgctcgttctcgttcacgttcgttcgctcgttctcgttctcgttcacgtttctttcgctcgttcacgttctcgttcatgttcgttcacggcggtggggcggcagcgggacggcggtgtggcggcagcggagcagcggcggggcggcccggcggcggcgaagcgcgcggcacgacgccggcgttgcgcggcggtggcgtggcggcgcggcgccggtgccgtgccgcggcggcgtcgtggcgtctcgtcgtgtcgtgccgccgtggcgtcgttgtggcgcgacgtcgtgtcgtgacgaggtcggcgtcggcgtctgcaacgaggcggccggcggcaaccgagagggagagagatagctgatgagagggaggcggcggcggcggagatggcggcgatgacgacgagcgcgagacgacagcgagatacggcggcggtgtcagcacggggatgccctaggcagtggcggcgaaggagaagccaagagagatcgatcgggcaaaaacttctaagtgttggtggagaagatgagggcgcgcatcgggaatatatatacccctagatcttt

SEQ ID NO: 33321 - DNA, 9523 bp, Oryza sativa
catcaaccgggactaaagatatttttccgctatttccaaattctttttaaacctggttagggttaagaactgggactactgataagcgcactgaatattattttccattacatatgtgtttctaaaatagaagataatgcattaaaattatttaaagtacaaagattaatgacaattacttcgaaaaattattgttgtgtgtaattaagtggataaaatgtaataagcaaatatatgatttaaaattaataaaaattctaataatcatatatacttagcatatgaatgatattaaattggtaaaaactctaattaacatatgtatatacagacggcatgatttaaaattaagaaaaattgtaatcatcatatatacttagcataggaattatatcaaattaattgttaaaaactctagttaacatatgtaaatgctacatgcatgatttaaaaattttaaaaattcgaatagtcatatataattagcatatgaatgatagtaaattaaattgtgaaaaactctaattaacatatgtaaatgccacatgcatgatttaaaacttttaaaaatttgaatagttatatataatttgcatatgaatgatagtaaattaaattgtgaaaaactctaattaacatatgtaaatgccacatgcatgatttaaaacttttaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataattgtgcgtaattaacatatgccatacatcaattgatttatatggataatcaatacatccaaaatagtttacatcggagtctttctcagagtcccaattgctagggttgtcattttgggtgccatcattgatactatcgttgacatcttggtgaatgatgttgacattgcacgcttgattcgagtggtcactattggggcaagaagcatggttgttggtggtaacatcatcatcattagtattgctaatgttgttgtctgcattgtgtccatcttcttggggcggaaactcttgatgcgcaacagaagatccggtgatctgaagtggctcagtgcgctgtccttggttaccacatggaaatactgggatgttgaccatccttctcttgcagttcgtcatccgattatgctcactttcaagttgcatggctttgtccacaagtttctcaaaatcttcataatcctctaggagtagttgcactgcaagctcatcttttaacccctggagaaacttctcttgtttgtcttcatccgcttccacatcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtgggtacttgaacgttggttgcccctgctgggttgttccaattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtagaggttgagaggggaagcatacaaggaaagaatcgaccagaactagggacaagaccttaaaggaactaactctttttgttgatgtgttgtttgttttgcttattctgcaggttgattaagcaaacaacctagcatggttacatcacaacccaccgatgcaaaccacgcgctacacacacaagcaaggaacacacgactaacaacactaccctatagggtggcttaggttctgcgatgggttcccaagatcttcactccttcacagctggcttcactgcttccttcacttcactagcggatcctgcagccttctggagcttcggcagacaattgacgacatcttcttcttcactgacctgaccatctagtactagttgaaatttgaagaaggaagaaaagggtaaaccttgtgcaaatagcattagggaaaggagaaaaagagaaactttcgcaaatagttttatttataaaatatgtccttaggttttatccacttggcttatcctacagtcgaaatggctctgataccagcttgtcgcgaccgagaaaattgtattttcccgaacgctagtgtattaatccccgtcccaggaaaagccggggtacaccatacaaacatgatataaaagacacatctttattatatcgataatatttactttattacaaaggcacttaaggcctgacaatcaaaaataaacagcagcggactagcgggcctacggctccatcttcacaggcgctcaactggggtataagccaagactccacctaagacttcttctccaaagcttctcttactgaagaggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctaaagctacacagtattattaatcaaggtcgtgaacccgcacgaacctgccttaacccaaggcctacgatgattcagaccgaactggcaacccgaccctgggtcccaactcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccataaacaagagtaccgacccaaccccacctacggccggaacccccgggacaggcaggcaggattgagccccctagcagcaggacaccaaccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgattagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtgcccactagttggggttttgtttattctagggtgaacaaggcaataataacaatagcaataataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttcttcatttaaattttaatttaaaaacggatttattgcgtcagccgaggggagggacgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgatggccgggtcccacatggcagccgcggggcgcgcccgaaggcggcctcgccggcacagccgacgggaggcgacgcgcccgcgccccgatggtcgccggcggcgacctccggcgcgacggagcggcgcccgagagaggggagggaagggggaaacgaaagggcggtccatggctcaccccgggtcgacggcgacgacgggaacggcgaccgaagcggagagaggcggcgctgcggctcgggtcgacgaggacggcggcgttccggcggtcggcgggcgaaacgaaagagtggacgagatcggcgaggacgcggcgaagccgaaggtggcgatgccgaagcgggaggaggtccgaggcaacgactgcggcggaccggagctcggcggtgacggcggagagaggggacgacggcgcgagctcgattccgacggggagagagagcggcgagaggcggaaacggaggagggaggcacggggaacgtttatatagcgttgggagggagagagggcggccggagtggaaggaaaccggcgcggcgatctcgggctccatcaaagacgccggcgaggtttgcgggaggattccaaacgaatccgagggagagagagagggaaaagtggggggaaagagggagggaatcacggggagtgatttccccctctttattgcgcgcggggacggcgggaggcggcgggattcgcggcggcggcggcgctagggcacgggcgaggcggcgggagcggcgggaggatagggatgataggtgggccccacccgtcagcgagggtggcgggcgggcccgcccgtcagcggcgcgcgcgcggggagaggccgagtgggccgcggggaggaggagagagagggaaagagatgggccgagccggcccaagagggggagggggggaaaagacttttagggatttttctttttataaaacctttttaactttgtttatttcttaataattattatttgtgctctgaaaattccactaaaatttgagggttccttttagaccaaggagaatttaacaaaaattctccggggcacatttgaatttttattgtacgtattttagtgtttgccaatttcttttcgaattttaattaattctattattccttttagagaatgatttttatttcgggatgaatttatcaggacgtgacattgttccatcgtgtcccatggcatcgacacgaacaacgctgttttggttcgtgctcgtcatgtcttgggctctcgtgtagaatgtgtacccattgatctcatatccctggaatgtcgcgatcgacccagacggtcccctcgccaggaaggcaagttgttggttgatggactcgttacccatgagatgttgtcgtagccacgcggggaaagtatcaatgtgatgccgtgtaatccatgcatcggacttaccgatgttcctggcacgaactagagccaagtgctcctcgatgtaaggagctaccaatgaagattgttgcagaaccgtgaaatgggctttacttatgttcgaagtgcttgcctttcttccgtaccgggtggtttgctgcaaggaatcgatgatgacccatgtatacaaccttcctacagtgcttaagatacgtaatttctgtttcatccatacagtgagtgcaagccttgtaccccttgttggactgtccggataggttgctcagtgcaggccaatcgttgatggttacgaacagcagcgctcgtaggttaaactcctcctgtttgtcctcgtcccacacggggacaccttccttctttcacaacagtttaagatcttcgaccagtggtcttaggtacacatcgatgtcgttaccgggttgcttggggtcttgaataataatcggcatcattatgtacttcctcttcatgcatagccaggggaggaggttgtagatacgtatcgtaacgggccaagtgctatggccgctgctcatctctccaaaaggattcatgccatccatactcaaaccaaaccgtatgtttcgtgcgtcctttccaaattctttaaattttctgtcgatgtttcgccactgcgaaccatcggcggggtgtctcagcatcccgtcctgttgacgctcttcagcatgccatcgcatcattctagcattccccttgttcctgaacaaacggcttagccgtggtattatagggaaataccacatcaccttagctggaattctcttcttttttagctgcccgtcaacttctcctggatcgtctcgtctaatcttgtatcgtagtgctttgcaaacagggcatgcttctaggttctcatactcctcaccacgatataggatacaatcattcggacatgcgtgaatcttctgaacttctagtcctagcgggcagactatcttcttagcctcgtacgttgtctcgggcaatttgtttccctctggaagaatgttcttgacgagtttcaataaatcgccaaatgccttgtcactaaccccattttttgccttccattgcaagaactccagagtggtatccaactttttgtgccactgctcgcaacctaggtataacgaagttctgtggtcctctaacatcttgtccaatttatgggcccccttttcactttcgcagtcctccttggcgtcctgcaacatctgaccaagatcatccgcaacgtcgttaccatcagcatccctttcctcctcgcctgtttgatttccttcaaatccaatgtactgagcaaagtccagaatattgtcgtcttccacttcatcttcttccatttcaacaccttgctctccgtgggatgtccaacaattatagcttggcatgaactccgactcaaacaagtggaaatgaatagtcctggatgcagaatactccttctaattcttacacttattgcatcgacaacaaataaaacccctttgcctgttagcttcggccactctcaaaaaatagtgcacgccgtcagtaaactctttggaccgccggtcagcgtacatccattgccgatccatctacatgagtcgaaaaaaaatcgtacacaaataattattcttacaataatgacagtcatacaataattataacataattacaaactctttcaacagtcatacaataatgacatatctttattcatacaaaaatcataaaatattacaccaaataattcttatttactatttctaaagttttaaactaattttaacgtgttttacttcttttaattttcattttagtatgttttctattatttaagattaactttcactatattttccttctcaactattttatgaaacgtactttagcaaatcaactaaatttctatatattctttctttctcacacaaattttctctctcatcaacttacaaataaattttggagacaaaaaagtgtgcaaaacatagctgcaaatgtaatatgacaaaaaaaacattggaggatgaagttggaaaccttttaggcacctccgatttgtatgtaatccccaaaataaatttactagaaattttggcatgacctcccctcttttttgaagaaatttagaagcttgctcgggcagctggaggaggaagaagacctatatataggggtgggattttagtcccggttggtgttaccaaccggtgctaaagatcctcgagatctttagtcccggttggtattaccaaccgggactaaagttatgatctttaatcccggttggtgttaccaaccgggactaaagatcccgggggggcctgataggccctggcagcatttgaaccgggactaaagatgatctttagtcccggttggtgttacgaaccgggactaaagatcaaatatacccgttaccctttttaaccgggactaaagatcatctttagccctagtttttattgcatccgggactattgtgaaattcggccgaccgacgaaagatggtttctcgaccagtgcatactcaacccgggtatccccagacatgtcctctggcgtcgggtcgtctccacccctgtccagcacctccttgaggttcatctcggggtgtgtgagttttaggcacatgagaacgtgacatgcaccggtccgaacaccagagcatgtttcatcggcaactcgctcggcgagcttggcgggaactccttcgagtttcccgattaaaaagccaagcaaggactccacggtggtctcatcggggaacgtggggcccgcttattggattctcaggttgcgtgccaccacgtcgagccatggctaatcgaatccaggtggccctgcatctccatcatcagcttctccatcccctggcgctgccccacgtggctggcaacgaggtccttgaatttctacaagtcctcctgagcctccgtgggcatgttctccagctgtgcaacactcccatccgaggacgaaacgattttctcagttcgtttgatctcggcgagcatgtcgcatgtgctggcttcgagcaggcgacgcgcctcccctactatattagcgccggggcgggacgtggcggtgagtggggtgaggcagaggagcgagcattgttggtgcagtggcgataacagtcgggtaggagctggtctccacgcgcccaacgctttgagcggaagcagtggaagaaacgctgccaaagacgaagtcggaaatgctaatgggtgggtgatcgctcccccaccagcctagcgatcacccgcctgccccctctctatactagatacactcctccctcctcccctactacagtacacaacacaaaaattttttaaaaaacaaaaagttagaaaaatttatgtatagaaatactatatataaaaaatttaaattcaaattcaaaattgaatcgggtatgtaaacattttgacttataaactttgggtctataaattttaggtgtataaactttagatgtatagaaatactatatatagaaaaaatttgaattcaaattcaaatttgaatcgggtatgtaatctttcgacttataaactttgggtctataaactttaggggtattaacttta

SEQ ID NO: 33322 - DNA, 4362 bp, Oryza sativa
  unsure (1)..(4362): unsure at all n locations
tatatagaaaatatttgaattcaaattcaaatttgaatcggatataattcaaaattcaaattgaaacaggttgaatcggatataattcaaatataaatttgaaacatgtatctaaactttagatgtgtaaacttgaggtgtataaactttaggtctataaactaactttaggtgtataaagtttagatgtatagaaatactatatataaaaaaatatttgaattcaaattcaaatttgaatcggatatatgaacttttgacttataaactttgggtctctaaactttagatgtgtaaacttgaggtgtataaatttactaaaataggaaagtaacacggtgccaaaaaagaaaaccaggtggagggaaggaggggggaggggggtanngaatntgatngctacccccattggcgggcgatcgatcacccattagggctgcccagacgaagtcagcgagtacgctagatgatgtgatttgatatatgagaatcaggggttagtttttgacttactcaggcttcagccgctttaaaagtctgtccctctttcgtgtagagggagcagccactactacgaaaatgcaatccgcccgtttgcaaaaacggtttttgtagtagtgagcaccgagggtggcctgcaagatgtataagtgagaatcctatacttatctcaagaataccaagcaaggatcggagattgagatttacctcggagcttctcgtttgtacgagcgtcccaacactaggcgaaggtttagatatccctacccatttccgtttggagattttcgtgccactgctgctccaagcggcagcgacatcagcctgcttggacaccgccttttccttaagagatgaggtggcttggtgatcgatgagaggaccgatggcatccgtcaacggtagatactatacaacttcagattactacgtctttggatattgttacaaaagcaaagaggggtagtttgaagtcaattacgttgatggcggcgtccttgttcgaggacaggaggtcacacaagtgggtcgggaacttgtcgtagcctgatggagaattgatcaccaggtgacctactcgtgtggccatagtgttgttatcgagctccgcaaatggaatagtaacattagcatttgagatcaaggcattacacaactcgaggtcaggagggttgtgagaacgactaccccgaaccgagatccatgtcttattttcagttcctaagtaatcgtacgcggggtgagcgcgagcttgtagtggctcgatctggcgacgtatgaagtccctagcaagttcataccccgacaactctcattctcggaggtcgtggattttttctatggaaacttggagtgagggttcaatgaaggtttggatgtccaagagggaggccgttcgggtttctcttctaggatggcaaggttggaggggcggtcctctacatggaggtagaaccatttagacctccataagctccttgaggaagggcagtcgaaggggatgtgctctgccttcatcccgtccaggagatggaaaaccacaacattcggagattctgtgggactctatccatctgagctcataaaaatgcctaaaacagatctaggaaggtgattgagttggggtttaggtggagcagatgtaggccatagaagttgaggatcaagagaaaaaattcggaaggagggggtagaaaaccgcatcgaacaaaatactcaagaactatgatttgacctaaagagggattaggttcaatacctccttccgtacgctccaagttctgtcaccctgttgacgaccaaatttggtaagatatgaaccaggttcgacattggaatcgaggcggattcggtaaagagatagattcgaagaacagagtttgcatcggctgtgaaggcatcggctggagtctgcatcggctgagatggatcggatagaggacagccgatacagccgatagaggtgatgcagccgattccgatgacgatggtttcaaggatgtttctagaatcgatcaaattgcttcacgaggattgccacgatggagataaagttctcggataggcaaatgtatctattaattaggatatttcatgtaattttcttagagatatgtttgggcaaaagtctgccgtaaaggcttatggtatcttagagtttattagagataagtgtcgtgtccggcaaggacatattttgtaatctcgggtataaatataacccgaacccatgtaatcaatcatcacacgatcaatacactttcggcgcatcgccaccctttttactttcgttctatttcggcgagttcttgctttcgggttgagctgcatcgatttgatcttcaactagaggtaaacttgtcatggcggcttgcgttatcgggattagtgcttccatatttatgacactctaatcctgtttatgtaattcgtcgagttatcatatacacgtcgcaatctttgttagtcgcattatataacttgttatcgactggttcttattgctagaaaacaatcgatagggttatgttctgttattaatctagattgtatcgtgtatctaccatctcttagagtttttcatcatcttgcctagatcttatacttgtctttatgcttaatgctgcatcggttgagatcgatctattaagtaatatctgtaattatgatatctggcatgttttatgattatcaagagagatagtatcggggttttagctgatcttacctgattgtgcttgattgatatgctaagtctgccctttatattaagatcctattgcaataaagtatattaagctacttgtttgatatattctacttgttctaatatcttaatatagagtggtatcggagtactagccgatacatgctagatctatctgatcggctatgctataagcgtttataatctttgtgttaatgtatacttcgatctaagtgatttatactgtctcagtatggcgaccgatctatcccaatcacttggtttaaatatacatcaacagaaggattacataacgttaatatctacagccgatcgagtagatttagtcttactttgcgtacttataattgccgatcgattcacatatgacatcggcttgaaaatacatgatatgtcatcggcgactggtcgatcggctatcgtttatggatttaaccgcggtttttcttgtttttctttcttgttgattgcaggatcaaatcaactggcacgctcacgaacctaaaagcaagattttggatctgcactgaagttaagcagatcttccaggcagtgtgcgtttttcgcatcaacacgcttttggcatgcctggtgggaccgacaagtaataacaatgtcagcagaaaagcaatcaccgccattaacaggcaagccgccagtgcctcctcaaaccaagctgccgaaacctccagggactaatctaccttcaattggggttgagtccaaggtcaatgagacaaacatcgtcccagtcactgtagacaagttatcaccagaacaaaagaaggagtatgaactgatgatgaagagcgctcaggagcagttcatgaaatcgtttgcagcaacccgacaaggaaaagttatccaaaagtacaaggtgaaggtggttgctgccgatgaagttggaacaagttcatcccaaggtggtaaaggtactgcagatggctcaggcgataaaggtgatgggcttcaagatggtgtggttgaagatcttggtgaagatggtactgaagtgcgggaggaacctcctaggtgcacaaatttccaagaccaagttgattatgccgtacaacgtgccttgatcaaccaatctggagtgcttgtcaatacactaacaaataagatcaaatttgtcattgatggcacgatagctgagtatgagaacatggggccagtctacctaccaggtggtgtcttcccaaactacaggaatttggtgataggaaatcagcagcatgcttccaatgcaccatcagtccagccgacggcaacagtttatgctccagcaccggttgcaccttcgtcagctcaaaggcaggtggttaatcctcgtctcttgtctagagaccagccgcaacatgttgggcagaacatcaatcggctgactcaggagcagactgctacaatgttcccaacaactcagccgattgtcgagccagtacagtcagcaccaattcagtagatgtcaccaagagaacagatggcttagccgattcagtagcagacggtgcagtagatatcacctggcctgagaacacctgataatcggcagaggcaacaaaatgtggcccaagttattcctgagcacctggtacatagtgtacaaccaaatcaatcggttgtagcccaagtta

SEQ ID NO: 33323 - DNA, 4559 bp, Oryza sativa
ggcacccttatcctgagtggtttgagagagttccactgccgaaccgatacaaagtgctagatttttcaaagttctcagggcaaaacaacatttcgacgtacgagcatgtcagccgattcttggctcaatgtggagaagcatcggctgtcgatgctttaagagttcggttgtttcctttgtctttgtccagatcagcattcacatggttttcttcattgccctgcaattctgttcaaggttgggtcgacttggagaaacaattccatagttacttctacagcgggacccatcagatgaagctctctaatttcacggcggttaggcagaggcatgatgaaactatgcaagattacatacagaggttcagagatatgaggaacaagtgttacagcttgtctttgacagattcccagttaaccgatctcgcattccagggtttgatagctccgatcaaggagaaattttcatcgcaggagtttgaaagtttgaccatgcatgagcaaaggtttgtggaggctaagaaaagtttcaagaagatcaatcacgtgtatccttatatgtgtgattttattttgtttgagattctgtaatgttttttcttttgtttgatctgtaaatcaaaaagaaactattgaactagaatgcaaaaatattctcaagaagaagccaaaagaaagagaggtgaaacagagtagagagaatcgggtgcttccagtgattagttgtcagaaagcattgttttccatatcagattctgcgcctatgggccactataactatccaagaagacactcgaaaaaggaaggataaacaaacctacccggtggactgccgagttctagaaaggaagagaggtatgacattgatattactaaagctgataaaatttttgacttgctacttcaggagaagcagatacaacttcttgctagccacataataccatcggctgaagagctagggaaaaggaagtattgcaagtggcataattctgattcctactccaccaatgattgtaaagtctttaggcagcagatccaaacggctattgaaggaggaaagatcaagtttgatgattctaaaaagccgatgaaggtggagagacttccttttctcgtcaacatggtgcacacagctggcagagcagctgatggaggaaagactcgaagttctcagttgaattcagccaagatcgtcaataaatatcagaaaaggcatgataagcaacaggagaagtactacgagcaagatgatggtggttttggtcctcattagggttgtgagttcttcaggttttgctagaatgaggggatgaggctgccatcaattgaagattgccctggctgcaatgacaacgcaggaagttcaagccgatcttatgatagaagcaatcggctgagtgataagagggttcctgttcattagaggttgggtccggtcaatcaagattgtcatcaagatgagaacgaggataggaagacgcaatggtgctcttctggtattttcacgaagaatcagaagaggagggttcaacggatgaggaacagggagcgtttccaggaggtagaacaagaaatcaatcattggctaaaaaagacaaaacccaggcatgagtggcgtgtcaagagtaaggttgcaacagccgatgaagttgaggccgacaaagcaaaaaggttggctagaggaaagaatgtcgcatctacatcggtgaacatggtgtttatgttacctgcagaatttgacgctagataagccaatgttgatgatgttgaagaggcctctgctagattggttttgtcgccagagcaagcaatttttgagaaaccagaggggacagagaatcggcatctcaagccattgtatgttaacgggtttgtcaatgggaagccgatgtctaagatgatggttgatggtggggctgctgtaaatttgatggcataggctacattcaggaagctgggcagaagttcagatgatcttatcaagacaaacatggttctcaaagattttggcggcaatccattggagaccaaatgtggagctgacagtcagtagcaagaccgttcctacaacattttttgtcatcgatgggaagggttcttatagcctattgcttggaagggattggattcacgctaattgatgtattcctttgaccatgcatcagtgcttgattcaatggcaaggtgacaagattgagatcgtgccagccgacaggtcaattaacgttgctagtgccgatttagctctttgggagatggacgggattgattgcctgtctggaaaagtttgggatggagatttttatcgacggtcgttatcgatcagtttcgactgtcaatattactaaaacaggagagaactagtgatgcttgcaatgcataaatatgttagaataataatattccactagtattaggtctactaaccttttgcagagaatgacaataaagtgaaggagaatcgacatcaactcagacgataaatcaatcggacgatgttgagaaccatacttatgtatgaatgggtgaagaacgcagacttgacacgatgaatcaggccaaaattcacaagtctacgaagtaaagcagcagaggaggccgccagccgaaatttggctgggttgggtcagccccaggttttggctggatggtggagatgaagccccaatgacggttggagggtattaccgaccattccaaccgtcacaaccgtcatagttcagctataaaaggatttcaccttctcacttcactcacacacctcaagcaagaggtctctcattcctctcaagtttagtttagtattatctagctggtggaatagaattagaataggaatcaggagtccggaagcctttggaagagttcgggtatggctatagtagctttcctttcctcttttgtaagctttgtacttttatccgaatactcttctaaatacatttctagtattgaaatactttccgagtatataagtaccaactttacattatgttcatgttatactgaatatacggctagctaatctgggagatgctttggtgcgggtatagtgtttgcttatgcaattactctatgtcatgacgatgatattagagtagtatttggtagtttaggcgtggtgtctagagtacgggatatcattatttggggttacatattgcggataagaggtgagccgctgatggtgacagctcactacgagtattcctccgcgcctatatataatcctaagttaatttcctggggagggtattcctccgtatttagccccggttggatggtcatgacgggctgtcgtaaggaactcggcagtcaggggtggtttctcgaagtaccaggagggcatcggatagagggtattagctagtatatcagttaactagaatgtatgtatactatgtgtattagaagtataggaatagattctctttctcttttctttccacctagcttagatgtcacaccgtaaaaatcccaaatttataaattgttgtttaaatggaattattagaaatgattttaaaagcctagaagaaaagatctaattttaagtaataaattcaaatataaaagtgggctagataaaattttatcaaatacttcacttgattagttcctagatttttctaggatttatttgagccaagaaagtaactataataaatggaattgcatttcatgaataatttaaaaggaaaaaggtttaaaaatccttcttttggttttgggccgagagttagcccaagtctctctttctctccggcctgctcgcgctcggcccaagccggcccatcaagccaatccgccctctctccctcttctctcccgctggcgggtggggcccacctgtcggggtcgtcttccatctcccgccgccagccgcgccctagccacgcacaagcctccgccggacgccatgggcctagctgccgccccctagcacctataaaaggatcctcaggacctcctctgttcgccgccaccttcaccctagcccgccgtcgcttgtagcgccgcctccacgtcagcccgtgcgccgtcgtcgccgccgcaagtccagccgtgcgccgccgccgctctggtcgtcgtcgtcgctcgggaaggtcgccgtcgggatcaccaagtcgtcgccgtcctcgtcccgtactccgtttccaccaaagatcgccggagcatcgccgttgtcgtcgacccgaacatcttcgctgcctcgccctcgccgccgtcgccgtcgtttgtcgtccgtcatcgtccgagccctcggtgagttcgccacttcaccctctacctataggtgttgttcgtttgcgccgccgcgccgtcgttcgccggcaagcaagtggtgccgagccgccgtcggcaatgacgtcatcgtcgacgtccgcgccacgtcagccgtagacccatggtaggtcggttagatctcggccgttcgttttgtttagattagatctcagccgttcgttccgtagaccgcttctgtccactcggtccaccatgaacccgagccccgctgacgcaataaatcctttttccgtttcaaaaataattctt

SEQ ID NO: 33324 - DNA, 10432 bp, Oryza sativa
  unsure (1)..(10432): unsure at all n locations
aatgattgtttgtgtactgttttggtgattttactcttttatgcttagattccgacgttctcggagagtccgattttgtaggagaagactttgaagaattccaaggccagcaaggcaagtcacacagatcccaaacaacccttggagcatgttaatcctgtttaaatctattgtttctattcaactattgcatttatttttgaatacatcgggtgggaatgaactatttcctttgttatagtcattttgttattgattaccaatactttgtcacctggttaataattgtgtcagggttatggttaccacatacctaatagtagttgactaaatctcagcaggacccactacataccatatcctatacggaagcaaccttcggatatatgaggagttccggataaggaaagacaaccagagttctacatgaaaacgagaaggactactcggattgtatccatattggtttccctagttctacttggacaaggggacaccaatgagtataaatacaagcccccttaggaggagaggggagaggagacgatcaacacgatcggcacccaccatggaggatcaacactcaacacaatcgacatagaagccacaacatggaagcctacatacgccaagacacgccgccggatatcgacttcagggataagcacgacttccgaatactgtcaagagagacgaaagcgctatctctgatcttgccaggcacggatgcgaggagaaaggctaccctattgtcgactatgagtcagaccgccatgtcgacaacagttagataggctaccctaaatattgtactggtgtgattatcatgaataagagcaataccggcttcggccaacaggatgtagggttattacctgacaatttaggggcccgaacctgtataaaaatccctgtctccatctcttttacctcagtctcgcatatatcctagcaccgacgatccccatactatgcaaataccagaattgcgacatcaaacgtcgacagtggcgcgctaggtagggggattttggtgcttcaggattttgacgagatgggttcaaaagatggattctccaacaacaagctactcgatgacttcggctgtggggagatccaacttgtccaagtacatcttccgactagatcaggaccatcatcgtcattgacaacttggtctatcgagatcatccaagcctcaagatacgcagcgtaccaaaagatgtcagatcatatgatgtcgaacgagtacacaataaggtaattggtagattggtttttcaaattgatctactaatttcgtagatacatccggcatgtatctacaaaggtacgcaatattttatctgcaatttatcgtacctattcagatcatacagcattgtcagatccatgatttattatgtttacctagagcatgttctttatacaataatatcggttgcgcgggtgtccccgatgttaaatcgactacgatctaacgctgggggcttgctctgtcttcttctgtataaatcatgcttgtttacggtttacataatgccctgacatttacatctgctcgttatatcctgataatactagaagatccatgcagttttttgagtacatactcgatattctctgctatatatcctgccttctagaaaatatttttcaggaacaattgagcactcgagtaagttgtggtcgagtacaccacattatcgagaacgatctcgacaaatgcagagtcgtcgcgcccaacctaccaacgaagaccgacnnnnnnnnnnnnnnnnnnnnnnnnnnctggactactcgagaaaaggttgttaacggataattcctcgcgaacgtcgtcggcttgatcacctgacatgattgtgaacggacatccgcatatgctacaagttgggtgcatgagtcatcctggtcacatgagacgcacataataaaccaactctagcacttccattggtgtgcgagagatcattctacacgttcgtggtcctcgaaccagtacatagtaatctctcgcaccgcaagcttgcatcggtgttcgagagataatcctacacgttcgctggtcctcgaaccagtacgtagcaatctctcgcaccgcaacctccattggtgttgagagatgattctgcgtgttcgctggtcctcgaaccagtacgtagcaatctctcgcaccgcaaccttagatggtcgaggtacgactacagcaatagcgcaacggtcctagcaccatgaattcaaatgatcgagagacacctactcactggttctcaaccagtcaatcgtagcgatctctcgtacatttacttacagtggttgagttacgactactgcttggttcttgaccagctgtgtagcgattctcccactatttccacttctagtggtcgagttacgactactgcctggtcctcgaccagcggtgtagcgattctcccactacttccactttaagtggtcgagttacgaccactgcctggtcctcgaccagcggtgtagcgattctcccattacctgtactccaacaaagttgatatcaggtacacaagatcgccaagtgttttacccagagatcccttaccacaaaagacacctagcgttgaaacctatcatattgtccctttacgccgtcatgacaaggcctccgaggaacctaagggaacttcggctggggacgcccagagccgataaggccttgtttgatccttcagagacgaaagaccacgtaagatctggtcgtgtaagagttctcgccgtgcgtattaaccaagccgtgtaattggaaattgagttttccaacttcatggctgggggctaggatcagtgcttgttcaaccgaggcaggtcaaaggtccaagagccttgtcatccgagaacgattctccgacgacaaggctgggggctagggagagtgtatgactctgcaaactgactgatcggagtcggtaagagagaagacgctcatatacaaaacactggtctgtacattcaattcactagtctgtcattttataacatgtcaccctttgagcattcgctcaggggttatttctatctaatattcttttctgagtattgatttcaggaaaattctattcttttctaagtattgttgaggaatacggaatgaagagatggtgtacccgccgagataaaatttcttgacttcaatccaaattctcgattacagcaagacgggagacttagttgtacgctctgtactttctcggtcgacatcagagattgacttagacaaaccctttcggtgcccgcacgaggctgatagaggaagtctaacgttatctctaaactcaccgagaacggtcacatgagctcgataacagttcctccaaagtctgcggttgagaatatgaactcgttcatttgcatcgaagtcgggggctactgtcagggttatggataccacatacttaatagtagttgactaaatctcggcaggacccactatataccatatcctatacggaagcaccttcggatataggaggagttccggataaggaatgacaaccagagttctacatggaaacgataaggactactcggattgtatccatattggtttcactagttctacttggacaaggggatacctatgggtataaatacaagcccccctaggaggagaggggagaggagacgatcaacacgatcggcacccaccatagaggatcaacactcaacacaatcgacatagaagccacaacatggaagcctacatacgccaagacacgccgccggatatcgacttcagggataagcacggctagtaccctacggtgtctccggatactgtcaggagagacgaaagcgctatctctgatcttgccgggcacggattcgaggagaaggctaccctgttgtcgactacgagtcagaccgccatgtcgacaacagttagataggctaccccaaacaggatgtagggttattacctgacaatacaggatgtagggttattacctgacaatacaggatgtagggttattacctcagtctcgcatgtatcctagcaccgacgatcgccatactatgcaaataccagaattgcgacatcaaacgtcgacaaatttgattagcaagaacattatatggttttagctaaagtaattaggatgcttagccatggttagagacactagctcatatgaatgggataactaatgattcactattacttaatgatcgattaatggtagctcatgatggtcaatcgtgataggatggtttattaagatgccaactaaaacatggtaatggtgggttgtgagcacatggttttgatggtcgtgctcatgacaattaaggaccggttcacgatttttggttgtgaaacattaaccgtgccaaccacaagccagcgtgggcaacggctttaccttttgtatagtgtggttcattgtgttgaaccagactgagaagtggcagagataagcccacgggggtcgctggggagtccatgccttgttttataagggggtgattatgatccaggaaaggtgcactgctttgaattgtgttttgcggagggtattgtcacaatctctattcacaatctctattcgagttcttgttaagtatcgcgacgcatggttgacatgatgttgaggttgtgtcttgtgggtacagtggtacacctctggccagagtaaaactattcgaatagccgtgcccgcggttatgggcgggtctaacaatgtcttttgtgattagtctcacacctctcaccataataaatgatgctgtaattggtaataacttgtttagctcctggtttggaatggtatattcctggtttggagatagaactgtgcagccgggaatggttgttcagaatggttgggcctatgcaacgggtatgttgtatagagttggattaatattgtttaattaaatgctttactgtttttctaaattctgaagtatttattgattgccatttatgcaaatgagactatattatgccatcctttgttatcccctgcacttgcatatttgctgcatggcttattgagtatgtcatatactcaccttgcaaccattcatcagaggagttctatagtgaggctgaaggtgtggaggattaggcgtagccctggtcaagctgcttgtgggatggagtcgcctacgctctttattttattttccgctgcttagatctttattgtttgagaggaactatctatctctgtaatgaatttatatccgtctattaattagagtaataattgcactctattatcaatttgttattgtatgcctcgactgattcctggacgagggttttcacacatgtaagtgtttggagttttggatagaaattctgggcgtgacaagttggtatcagagcctccttgaccctaggttatgccaaatggttacctatagaagccctctaaaaatattaaaaaagtagaactgttcttctctctttctcttttaattaaaccaagctaatggcacatgcagattatagtctctttaattgttctcattaaaaatttacttattattcctgtgttgttagtactgtacatctattactgtactaatgacccatttaccagcaaaggttttacaacattatttttatttaatcatgttgcaatataataaacttagcatgttgattttataactctcttttattttagctttttttaaacctgttattcaaaagtgcaaaaatttgtgatcctgttttcaacagttccaacttatcttagtttactttatttacctttcacttcgattttctaactttattcaatttaatccaaaaccttgtgctattaattggagaaatgtcttaactccctcctttcacttgtctttagatgccacgcttcaagcctgagtacttgttcggtattgagggatttgtccaggagctgcgtacgatgtcctttaccataggattcgagactgcccctttgtatgcccagattcctcatgatcgtgatgaagagaagtgccgtgtcatggtcaccttgaacagtgatcgtgaagacatcccatcgatgatgttcgaggctagagggggaagctatccttatgcttgtcaggaggcggcaaggatcgccataggagagctccgcgaccgttacaatgatctgttggccgacactgagtatcgttgccatcctcgtcagccccagggaagtgaccgtgccagctatgttgatcctgaaggaattgagaatgatgctaccataagacatttggtcgagatgctgtgggccatggatgagtcccgcgctgaagttgtgtcagctgctcaagctcgtgaagattggaaccgtggtaagatttgcaagctagaggacaaggttgatcgtctagagaaggaactggccgaattgaagggagaagcgccaccacagaaggccagggttcatcttactgcaaggaagagagctctttttgttccctgctaccagttggtgcccaaggttcgtgtggtggcaagagaagctgtcctagtcccagtggatcctccggtcgttaatttaagtgatgaggaggaagaagattcaaagcgcacccattcaaaggttgagtggggtgctactcaagatgatgagaacgagccgaacgagccttcaatcaactccgatgccaggaagaactacatgtcttgttaagtcgttgacttagttcgttgtgttagtttgcttgtttaagtttggctatgtgtgggtcttgcatgaggtttacatcattggtgggatgtaaatgcatgcgtttgtttggtttcgagtgttaggaagtttgagttaagtggtgtgagagtcttcagttttatgtaataatgaaactcagttaagatcaataaaagtcaagttagtagaaattaattctctgtcctaagtagctttcccccttgtttctcttcttgtgctcttgcctatgccagatggtgaacacccgcagcaatggaaatgggcccaacaacaacaacaacaacaatggagagaatcccacgcttgcccaagtcctagctcaacaggcgcaactcatgaacatgatgatgcaacaactccagaaccaacagaaccaggggaacaatcatgctcctccccagaacaagttagcagaatttcttcgtatgaggccgcccactttttccagtactaccaatccagttgagactggtgattggctacacgccatagaaaagaagttggacctgcttcagtgcactaactaagaaaaagtctcctttgcttcatatcagcttcatggccctgcctttgagtagtgggatcacttctgtctcaacaaggctactgctgaaccaatcacttggcttgagttcactgctgctttcaggaagactcgtgtaccatcgggagtggtgtctctcaagaagaaggagttcagggcgctcactcagggatcctgttctgtcaccgagtacatgcatgagttcaatcgtctggcccgttatgctccggaggatgtgcgcacagatgaagagcgtcaagagaatttcttagaaggactgaatgatgagctttcttacccgctaatgactggggattattctgatttccaaaagttggtggataaggccattcgtcaggaggataagtacaaccgaatggaacagaagaaactcaggattgctcagttcaaagctcagcaagggaatagtcagaggccgtgtctcactatgggacctcaggtagtgtcacagggaggatcttcatctgttgtttgtccacagcgtcagttctacaacaacaatgctggcaataacaaccgcaaccaagctccacgtcctgttgcaactccagtccagcacccgcctgtcaagagggagcaaggaaacaagccaggggtgtgtttcaactatggtgaaccaggtcattattctgacaagtatctgaagcctcgacgtgtgaagattgttcctgtgcagaataactccaatgcaccagcgtcaaaggctcgtgtcaatcatgttgctgctgtagaagccaaaggtgctccagatgtgattttgggtatgtttcctgttaactcagttcctgcaacagtgcttttccattctggtgctacacattcctttttatctatgagttttgtgggaaatcatgggatggagatagaagatcttagatgtcctttgatggttagtacccccagtaaccaagcactctcatcacaacgtagcccttctgtcagaatagagattcaaggtgttccatttctgaccaaccttattttgttagaatctaaagaccttgattcatcctagggatggactggttagccagatataaaggtgtgatagattgtgccaatagaaaagaaactctcaccagcaatgatggtcaagttgtaactgttcatgcattgccttctgaacctttaaggtcaagtttgaaccaaataactttggaagagattcccatagtacgggactacctagatgtgttcccggatgatttacctggtatgccgcctaagagagatatagaattcagaatagatctggtaccagggacaaccccaatccataagagaccttatagaatggcaaccaatgaattagcagaggtcaagagacaagtagatgatttgcttcagaaaggatacattagaccaagttcatctccatggggagctccagtcatttttgtggagaagaaagatcatacccagaggatgtgtgtggattattgtgcactgaatgatgtgaccatcacgaataagtacccgctgcctagaattgaagatttgtttgaccagcttaaaggtgccactgttttctccaagatcgatcttcgatcaaggtatcaccagtcgaggattaaaaaggaagatatacctaagacggcttttaccactcggtatgggttgtttgaatgtactgtcatgtctttcggacttaccaatgcccctgctttcatcatgaacttgatgaataaggtgtttatggaataactggacaagttcgttgtggtcttaattgatgacattcttatttactcccgaaccaaagaagagcatgaagaacaacttcgtcttgcattagagaagttacgagaatatcagctttatgccaagtttagcaaatgcgaattttggttgtctgaagtaaagtttcttgggcacgtcatctcagctggaggagttgtcgttgaccctagtaatgcggaatctgtaaccaattggaaacaaccgaagacagttttagagattcgtagtttcctaggtcttgcaggctattaccggaggttcatagagaatttttccaagattgctaagcccatgacacgcctgcttcagaaagacgtgaagtacaagttgtcagaagaatgtgagcagagttttcaagagttgaaaagtcacataatatcagcacccattatgattttgcctgatccaaagaagggtttccaagtgtattgcgatgcatctaagcttgggttaggttgtgttctgatgcaagatgggaaggtggttgcctatgcatcttgtcagttacgtcctcatgagatgaattaccctactcatgatcttgagttagctgcagtggttcatgccttgaagatttggcgtcactacctctttggtactcgtacggaggtgtacacggatcacaagagtttgaagtatatcttcacccagccagatctgaacatgaggcagcggagatggttggaattaattaaggattatgacatgggaattcattaccacctgggaaaggctaacgttgtagcagatgctctcagcaggaaaggctattgcaatgctacggaaggacgacagttgccgtgggagttatgcaaggaatttgaaagactgaatttgggaattgtcagtagagatttcgttgcagctttagaagcgaagcccactcttattgatcaggttagaaaggctcaaaccaatgatcctgatatccaagatctcaagaagtatatgagaagaggaaagactatcggttatttggaagatgagcaaggaactatatggttgggcgagagaatttgtgtcccagacaacaaggagttgaaggatacaatcctgaaggaagctcatgacactttatactccattcaccctggtagtaccaagatgtaccaagatctcaaggagaaattttggtgggcaattatgaagcgtgagatagcagagtatgtagctgtgtgtgatgtatgtcagcgagtcaaggcagaacattagaaacccgcaggtttgctgcagcctttaaagataccagaatggaagtgggaggaaattgggatggatttcatcactggtctgcccagaatgtcatctggccatgattctatttgggtggtagtcgacaggcttaccaaagttgctcatttcatccctgtgaggacaacatattccgaaaatagtttggcaaaattatatatggcaaggg

SEQ ID NO: 33325 - DNA, 1940 bp, Oryza sativa
tcctccacgtgcgttctcctcgccgtacacccacgccgatcagcaccgcaaaccagcggcgcctctactggtatccacacgtacagggacggaatgccacgcgcagatgtgctagcacccgcgcgcggctagggttttgctcggggagggaactgacggctagggtttctcatgtgatgcaatgcctcagccggtcacacccctcacgaatatataggatccatcactcgggcctccaaggcccgtaggactcctattcggatccctatccaaattaagctcatattggatctctatccaatccccttattccggcccattaagcgtgcgaccctgtaggttcatatatactcagctgtaacccgaaaactccttttcggtccacgcgtcaacggcggctcctagcagaacgtattgacccaccgggcatacataaatatcatatcggctgaacctctagtgtttacttgtatgaaccactttgcctcacgatatcgattaagctcaaggctagatatgtgccatcctctaatagctcaaacattcaatcgaacttgttgatagattatataactcctcaatcaccgttggcatggccatgcacttccataatctgcaacatcgaggggcccagagatatctctccataggaggggcaaatcccatcttgattattcatatcccattacatgtttcatagcatacccgaaaactacttttatagctacccatttacggagtagcgtttagcagtccctaagtaagctactacacatgttgaaaaccatgataatctcaggtctaaggattcaacaccaacactaaatgagatcactgatgacacaacacatggctcttgcagtgtctcatgttgggtctatccaacaacatgttcaccaacatgtgtccacattattaatttggtatctctataccatgatccatgagacatgatcatcaattaatacatgtgctgatcatataaacatatttgttgcacatatgatatttgatcagggatcctttagaaatagtaacaaacaacataaagagtctcttgaaagaatcacatattaattcaccaataaggagttatctattttaaggaacaatgtcggataaatatgtaaacatagtatgtgatacaatcatctctatgattgcctctagggcatatcactaacagtctcccacttgcactattgtcaatcatgaacgcatcttatacccattaccctagtgtgtgcctcatgcttaggctgagggagtggctttgtcaacgaatctgcaacatttaaatccgtatgtattttgcatatcttcacatctcctctatccactatctcgcgaatgaggtgataccgccgtaaaatgtgtttggacttttgatgcaatctaggctccttggcttgcgcaatggcaccactattatcgcaatagtggtccatagggctagaagcactagtcatcacacctagttgagaaacgaatttctttatccaaacagcctcctttgctgcttcagaagcggcaatgtattcagcttctgttgtagaatcagccactgtatattgcttgcaactcttctaactcacagtgcctccattcaggcagaacacaaatacagactgcgatctaaaatcatctttgtcggtttggaagcttgcgtcggtgtatccatttacaatgagctcttcctgtcctccatagactaggaacatatccttagttcttctcaagtacttcaggatattctttacagctatccagtgactctcacctggatctgattggtatcggcttgttgcactaactgcatatgaaacatctggacgtgtacatagcatagcatacatgatggatccaattgccgaggcatatggaatcacactcatcttgtttcgctcatcagtcgtttgaggacactgattcttgccaag

SEQ ID NO: 33326 - DNA, 25349 bp, Oryza sativa
atggaatggagaaagcaaagaaagaattgtatggatgttgggaggaaagttttcaattgttgtatagttggaaggaagaggtacttaggagatcacctggaagtgttatagaaattgacattagttgatgggagagcatactttcataggtttttttaacaactcagaggaatgtggacttggaacaatacgttgatatggtttactcagtgcagaaattcagggcttcatatgagagagagataccagcaattccagacaagtcacattggccaaaggtgaaaatgcctttcgatttgggcgcaccactagagaagaggggtgttgggagacagaggaaattgaggattaaaggatgccttgagaatggtggcaaaagtagtgcgaagagtgatggcaagaacaagaaaatcataagaggtctagttacatgcaaaagatgtggtgagaaaggtcataggcaagctagctagctacaagtgcccattgaatggaacaaaaaacggtattaatatttctgttttttcactttatatcctttcaaatttgtggtgtatcatcctatatgtataaatatatgcatgaaaaggaagcctaggaaaagcaaccaaaagaaccttccacctgaaccttcgacaccaaaaagaacaaccaatgaagctacaataatgcaagaaagcccgggaatgtttacaaggaagctacaataatgctcaaatctgacaagttagaattattctacttggtgtgcatgcttcaaaccaattgtgtgtaacttggcttttgtgtatacatgcataggcgccttacaatgctattgggagaaaccggtacttctggagtggaagggctaaagaaatggctagtacttctggaggaacatctatcctaagaagaaaaaaatgactcccaagaaaatgaagacaacctaatgtattttagtcgtcaaatgtgaacttcaaagagatgtgaactagtattgtagttgcaaatgtgaacttgtcacacatgtgaactcctctttttgggtctctttgatgcttcatgtaaccaagatatttgctatgtgatgtgctgcaatgctctgtgcatatgctgctgtgtgctatgtgctgttgtgctatgtgctgttgtgtgctatgtgctgcaatttatttgtatatatgtgctgcaatgctgcaatttgatgatggtgtatttttgttgctgcgatgcaatttaatgctgcaattggagggaacaatctgacccgaacatgtgagaaaggatccaggggtatgctgcaattagagggagcaatctgaccctaacatatgagaaaggacccaggggtatttttgtcatttcgcatgctatttctgattaaaaggctcaaaacagcccaaagtggcattttattaaggtgtatcacctacggagtggcatatttataaggtcatcctatagagtggcattctgttaaagccacctctatggagtatgatattgttaaatttctcgttggggtcatccgttatgaccgacactgataaccccgagccaaatttgaaaatttagctgccataaattcatgagtgctaattctagccacagattagcactgataaatgcctcatcagtgccaatttttttccaccaattggcacagtccaccacatcaatggaggtttctttcttaaaccgtactgatatttgtcactagtgccagttgttgccctcccggagcgtatgcggggctaagcgggcaggagactatcaatgctggtttttgtttgtgtctaactggcactaattgggcgtcacatttaaagcgttctatggttgtgggacacatgctcaccaatattatctctttacaaagagttaccagcagatcaccgacagatgcaaatagaccatccaacattgaaaagaaccaagaataaacatggaacacaattccaagaacatagagatcacattaccgtgctaaagaatggacatagtttccccaccgccacaggctgccactacggattaagtcgctactgctccagatcaagtcgttgttgctattgatcaggctatcatcactccaattcaagccacagtgaaaggcacaaggaggtgggaggagggggggttgaatatgcgttctgatttatgaaatattctccaattgccgtaggtagaatcaataggcaggcacttcctaccaactctcagccaactctcgagtgatggctactacttccgagcttgtggaccagtaaagttttggttggctgggaattgttcttcctagcccctcacagaaagtataaatgtgattaacagagagcctaacacagagcaaatgcggatcacaaaaattgcagcaatttgaacacatacatgagggaccaaaacaaggggagacaaagatttttttcccgaagtcggactgcacggattgtactctccgttgaggagctccatagagtcgggtatctattaaccccttgcctcaccgagctagccaatgggaagaagtctttagcctccaagcaaccacctaggtttcccttgattccaagcgaccaccaagatcacaccttgggcagtgagttccaatcactagtgaagcttgctctaccaagataacctccaactcggaattcactcaaaatttcctcttttccttgcggaggtgcggttcaccctcacaaagttgcttggatcaatgacagcttgaggaagctcatgggagacacctagccatctaggaagtcaccctccaagagtaataagcaccaagcagtagcctggcgatgatccccaaatgcgcatctccttctaagtcacttacaagcactaatcctcaccacctccaaagaatcatactcgaatcaccatggtagcttaggaagtagttggaggaggtcaagaaaccctaggaaaagctaggagatagataaacgaaagtggaattgccaaaggagatgtagaggggaagggtggattttatacccactatcatatgtcatgtagccgttactcacatagttgaacttgataggtgccaaagaagttcgagccaaaaccactaggaatttttggccaacacttaaacaccttgaaaaacaagggccaagaagttttgggccagaacaccaagaacttccgacccacactttctgtttacatctgaacccgtgtaggttttgtacaaatgtgtctctcatctacaaggagtggacagtgagcacttggataaacgcaagcaaccatttcagtatgctccttaacagtgcagctttcctaaagtcaagagcaaaagatacaaagatttttaaataatgccatgagtccttgcgccgctttcgattctgtttgtaggggtctctatgcacacctaggcaccccgggacaaattatctgcaccactacaaaaaaaagctcatagagatttgttggagggacggtctgaccggtttagtagggcggtcagaccatcagacacatcctaaaaggtgttttagcctccaacggctagttttggtggttgggggtatatatacccactccccagcagcaagggtaaggttttggcattccattgcattatcttgaacccttgcgagagctctcacatacttgtgcacttagtttatctagtgaggtgttggagagtgagtttatccaatccatgtgcattgctttattgttagagctagtgcggcacttgatcatcctcggtaagcatcccaaacttgttactcttggaggttgctacctcctagacggtttgaaggagttgctcggtgacctctccgagaaggttctggaggaggcccggtgttgattgtgagtggctcagtgttcaccatctccggagtggaggaagaacaaccatagtgatagaggcttgggagaccacttcatgggccagcacccaccttgctcaccccttgacgaagggggcttgcggtggcttcgtggtttgagctatgaagaagttggacttgccacaacggtgacgtaggaagttggcaagcatccgaacatcgggtggaaaaatactttgtcacttgcctcctttattttgtgaaaatttactttgagcaagtttacatactagagtttatttgtgctattatcaccctagcaagccataacataggctagctactttgtgcacttagttgagactagttgatttaggttttgaactgtgcaaaaccgttttgatttacgtttccacgtacaaaactcggttctagccaaaagttttaaaaaccgcctattcacacccctccctcttagtcgacctccttgatcctacattctctctctcaagtctgtcttggtagcagccaagtggcggcccggaggaagcggaagtgacggcggcggccgcaccctcccctcctccagattctcctcctcgtcgtccttagcagatgccggtgccactccaacctcctcgccgcctccgagttgcaccaccccggatccggtagcctagaggtcgggggccgctagatccagcctcctagagttcagtgctctccggatctagtggcctgtgacctcaccgtcgtctccgatgccggcaccggcgctacggccactgctggtcgctggcactgagtggtgggtggtgggggccagatccggcagccccaagctcgggactaccacgttggcaagaaggatggcgaggaccgtggcgtcggggtggtggttttcttgattttgtgttgggtcttcttggatttggggggaaagggaatatgcaggagtttatgttctaggcagaaccaaacattgtttgcaatgtgatgaatattcttgattcttttttgagtgaaatatgatggatgttcttgattttttttcttccatggcttttccatgtatgcaagcttgaagcatcggctcgattcattaccaatagactattctttagtagtgttgtatacatcttgataaaatcattagtcccttataacagttttgtcatcattccgccaaaacccacttagggggctagatgcatttttacatatctcctacggattgggccactgccggcataatatgcttagtccacaccacctcttgtctgagtccagccacccccaactagcctccctgcacaacctaccagatctgctggtagatagataaggtttggacatagagacgacaacagtagtaggaggacttagctggctgagcaagtcaccatggcatctcgttcattgtgcccgacatccgccgaccatgagctgatccttgttatgttgtaagccaaaccaccggtgagctcaaggaggccacctcactggtgccaagaaataggagcattcggatggaggccctatttaattcccacgaaaaaactttttaccttgtctcatcgatcgtttgaacacctgcatgaaatattaaatataggctaaaagaataactaattacacagattgcgactaatttgcgagacaaatcttttaagcctaattgctccatgatttgataatatggtgctatagtaaacatttgctaataacggattaattaggcttaataaattcgtctcacggtttactgacgaattctataattagttttattattagtctacgtttaatacttcaaatgtgtgtccgtatgttggatgtgatacgccaaaacttttcacccctggatctaaacacagccgggacagtgaactacgcttgcgtcttgataatgatagatgtactgtgggccagagggcttctggtgcgtcccgaatttgattaccatttgaatagagagtggatagagcaaaaaggaaggagatcccacacatttgagttattgttagcgacctataatgggctggtgcttgcaaggttgtggcgtccaaatatggctggagatggtgagcaactagggaggggacaagaatccaccgttggcaggggcggatccagcaattaggattcattaggctgtagcctatcctccaaattttgcaaaaaaaaagaactatatgtgatatatgagatgaacatgcattcgagaagaggaacggacaccgggaggtcgagcaagatagaaaggaacacttggcattgttgtgattggggcagatgctaaagtggtacttcctccgcttcacaatgtaagactttctagcatcacccacattcatatagatattaatgaatctagattcatatgcgtgtctagatttattaacatctatatgaatgtggacaatgctataaagtcttacattgtgaaacggagggagtacatcttaatggcccatttggccaatacaacacttctttggcatggttggactggagcaagtgtatgggacggggaacagtggtaggctgctcatgtaggggtggatctcgcaaagcaaggtccaataggttcaaaccttaacattttaaagtacatatgatatctgatatgaacaagcaatggagaagaggaacatgcatcaagaggttgaggaagatgagcgtgcttgggctgattctaccttcatggctgtgcgtgagtgctctgcaaactccggtgtccaatccaatcctctcaggattagtcattagtttggtggctggtgggccttttgggcttggtttagtggtttaagttggactggttgtggttgtttttgggcttgctatccgggtaatatccaaattatttaccggatactctatatctgtcagatatcaagctcccgaacctgatcttgtatccgagagaaaatacacggattgggatccgctacccttgtaagcatccgcgtaccaggatttttgacccgaaattgtcccaaactaatatggtcaggtgggtgagcaggaaatacctgccccgttttcacccctaaacactcaacacagcacaccaaatgttagcatgcacaaattatttcacatagcaacaggttaatttggaaaacaacacataggccttgtttggctaatgggtttgggaaatgatttcccacccatcaaaaagcatctttaaatcctaaccattcattctccctcttaatcttaatccttcattcatttttcaattccaatcccacctcttatttcccattatccaaacatagccagaagacaagaaacgaacatgactagtagctgatagaaggaactactgcgaaccaccagatgcagaaccaggcccgttttcactagttaaaatatattgcaagtgcccagctgcgtctgtgaggcgcgcgaacataaagcagtggccattgcttgcatcacgtagcaagcgcgcagccatataccacactggactacctggacggtggccatcattttccaccatctccatgcaagtctcagggccggtagccttcgctgcagctagttcccttgcgcggctctccaaggacgccatgcgcagggtagcgagcctatcaagcgtctcgccagtaccactgctgcaggaccgcttattagaacttccagaggcatcaccctctgatgccttcctttttcccttactaccactgctctgagcatactgtcctttgatggagacagcgccggtggtggaggagtgtacgctgctgtgagctgctcgacatcaatgggctgccactgaacgggttgttgcggcgtgccttgggcagccccagcgacggcggaatggttgcggacaacggtgcgcatgctaaacaccgcatgatgaagatcaatgtgcttcaggggatcgtttttgaaggctatcacacccttcctcacctgtcacacagttgtacacatggaactttatacagcaaatatatgaaaaggcacagtacacacaagaggacataaatacagtataggcagcatgacaattattactgaagtttgcgacatgattaacatatatcatagccataggactcgaccactatttataaacattgaaaggaagaaacaagataagcctccactacaagaaatcttatgatagatgacgcttcatttacgtcacaaatacataaaatttcgtcacgtttcgtactgtgatgctcgcgtgacgaaaattcattcgtcacctatcatacgtttctaatggcgttttatgacgaaaccttttttttctgtcattaatctagtgacgatccttctatcgtcataactttgtgacgctcatattcgtcattatctagcctaaaaaatgtcataaagtatctgatggcccattaaaatccatgtattgagcaccatgtttatgggcttagcccaatggcaagcccaactagattttagcctagcccatcatagatgtagcatatttcagcccaattctattatatccatttgctttaataacaaataatgaatgaataaatgggccagtccattgcaaaagcctatataggcccaaatattataccacaccattttcagcccattatattatcatttacattagtatcaaataacaagtgggctaagcccatatagacccaacaatcaaacacaataacaacacatatagcacaaaggctacagcccaatagcatctaacacaacccgacaaacatccaatacaacacaaaatttactacccaggtaacagccaaatccagccaattgctcacacctaggcaagcacaaatcctttcaaatctctaaaccgactgccatgagagcacccccaaagtcccttccataagctaaactgaaaatctgccaataccagattaatgatgctcagtgcagtttctagctagattgcataaactcaaggatatcacataggttcgacattatttttgctactgtggctgtgtggcataccagcattcatctctgtaagcattgtccatgacagaaacatcttgtctgatagcgtcacaagcttgttaccctgacattttgtagtaattggagttttcaagaacaaaagaaatgcagcacgaaactatgatagatgcagctttgacattctctataaggagtacatacctctagattcaatctgaataacttggaacagccagcaagttcatctggcagtacggatatagtgttgtttgattcctacatgtagggcactacattatgtttaggacagaggatgaacagggaagctatagaaatgacagctgtatatattttcatcaaacaaagaaaccttatggtgaaaataaggaatacatcgatggtggcttacattgagttctgacaactccaggcaactggcaagactagctgggagatctgtaaggcgattatttgagcagtcaaccctaacaacaacaatgcatcaacttacatgaatataatcatatatagtctcaaacattgcttctggtatttagacatcatactaattgtcaacatcattatatctaaaatatgtgacaaatttgaaattcaaattcaaattattgaaacaaagtcatatagcaaaacgaacaaaacaaaagttgtagatcttgataaattatataactttgttgttgagaattttttcatttaaaattatttactacctgaaaacttatttgaattgagagaagggaggcaaaatggacttctcggcgagggaggagcaaaagggttggaccgcggcccaaagagggaggaggggaagggaaagccggcccgaggaggaagagagaggctgtgggctgaggagggagaaagtaacacttgggccgaagaagcccaaggggagagagagattttaatttgttttccatttattttaatatgttaaatgaactttgtggtattaaaattagttattgagctccgaaaattcacggaaaaaatcagagaataatttagaacatatagaatattaaaaaaatatttccagccatgatttttaaagaaaaattttagtttcctcagtaattcacttgattaaattgcttcaccttttaatatatttttctagaaatgcattataaatctgtgacgtttgcttttaccgcttatgacaaattaatattcgtcacaatgtcccattgaaatactttatgacgatttctagttggtattaacgacgaacacctttttttcgtcactaagccaccccatctcatacttatcgtcataaaatggaatgtgctaatgacgaatagctccgatgtcacgagaaattcgtcacagaaggtcatatttcttgtagtcacacatcaaagtgttccccttctcagtgcactgaattttattccgacatatctgaaaagtttttttcattttggatggtagtttataaatttgagaatgggcaatgaaaactaggggggcagtgaaagcaaatgccatttcatccaagaaacaagaaagttgtaatgaaaattgcctttgtgcaaacagggcccatccatggttgaatctaaagaggctctgtttgcattctctttttttttgtcccactggattgtctatactgtgatggcagtaaatgagtaactccaaaaacttgatagcagcatgatccttcagcagctggatcatttacaaatgtacttggcacctacagttatgaagctaagaaattatgaactattaaaaaccaagaaagaccaagttgacagcatcattctgttctagcaaacaaaattatgtaccaggagcttctaaattacaggagaacactatttgttattacaaggagctagtcagtgatactcaacagtcaattcaagccttcaaaattgagcctaactgcctatgttcatattacacatgaaggtaacaccatggtagcaagatatttggtttgcaaaatgaatttgcggatgagttacataccccattttggctttcccaccagctttcgtcagtgacaatggctgaagtaagggggtcccggccttgtccggttgcctgcgattcaagccacacccacagctggaaccgcttctttgcactgccccagatgtactccaattgcccttttgtcaccttcttcctgcacttggtgaacattttcttcgccaagttctcccatgccttgggtttgggggagttcgaggtgttgttgtatgccgccatctcctccaagcaacactcaagaaacacacgcagctcgaaatcggtccagcgaccacgcggttcggacatctactgaaatgctagtcaacaaaaaatgaaagagagaaaagaactacacaagtcaattgaacggctgacggtggcaaggctcattcgacgcacgaactcgataacggctttgggggacttggcacacaccgtacagagggcattggcgatgtgcacgacgtcgtcggctagagccttggcggtgcccgtgtccgaggcgaccgactcggaggagccctcgccggactccagagtggatcggcggatagcgattggtagaggtgacgtggttggaacaatctccctttccaaggcagggtgtgacagctcaacctctcctttccgcttcttccccctcgcctccattcccctacttcaatttattacactccgagtttatgttgagcctaacagctctccacaccacctcgttactatatgcacctggaatgcacttcatcggccggaaacgatcaaaagagcgacgtgactgagtgtgcaaaactaagatcagctccattcatctgtgtagtgcattcctcaccatatatgtagtctgcaatttcaacatttacatttatttttagtcggactgaaattctgctctaaggaatgttttatattaccaaccatttgttatttggtaaagtgcaggtgttgttagaaattctaattaatctgtgaaccatgtactactagaatttatttaagagctagtatatctaagcaagtaagagtttatttagctgtggattgtggttccatattaaccactgtgcagaccactaatgtgagccctaaaactcccaactcctcttctctctccttatgtctttctcacgcacatgcaagctgctgcagctagcttagctcctctttcttcctgctgcctgctgctgctaaggctcttcctccttcccaaatcacggtccaaaccatggctaccgatttgccgctgctaggtgtggatcagctctgctttgactgcggctgtggcggtggctgctgcagctacgactgcggctgtggctatggtgacggaggctgctgcagctgcggctgtgctgtgggtgctctttctctccctctttccttccctctctggctctagcatttgtgcgctgtggatacaagtgcagagaaaatcgatgctcatgccatgactgctctatgtgctaaatgaatgatggtaagaaatgaggggttcacctttgtgtaggtgacgaattcgttcacagtcatgcacccttgtgcgtcctcgccgatctgttcacctcccctcctcctcggtaaatcacctccctgcctacccgttttttttttttttgaaaatgtcaacgggggcgaagtgcccacctgaatatattacgccaaacagacttacacatggcaaagcaatgacgggcaaagcaatgaccgcgcaagtgcaggcgccctggaggataacagagtgaatacatggggaaatacaagggaagagaaacacacaggggcaacataaccacccaaaacacatattgatgttttccatcaacaagatcacaccgccaaacacccaaaccggctgtatgagtatttggcctgattggtaatgaaggttggttcttgcagtggatggggcagattcttgcatttcactgattcgtggattttggggctttggctatttcttctccactccctgctactccctttcttctccccaactctgctcattgctcaatcctgccatgtactacttgggtttcctatgcatatgcaccggcttgcattaattgctatagacatggccatactttgaccgcttgactgcggtgcgctaagagcgagaacaatagcaggctataagtcagctgtaaatatatatagagaagagagaagagagagaaggaaaagcggactacagatccccaagtccgctatatttgtgtaacggatttgctcaaatttcttttccgagccgatctagggtttccaaaaccgattccgttttggccgttaccgcgctctcttttaaatagtaaccaccgctcttctcgtttcacggcgtcacttccgttttcaccgctctaaccaaaaactttccccaatcttccacctcgagttctccggcaacacccttcaagctttccggcgatccgcagacgcttccggcgactccaatctccgccaatgacaatgtcaacctccgccagtccaccgagctcgttggccaccgaatacatcgaggtaagtatccatcggctaaatcccttcttttcctcgtagatttggttcttcttccgctcaatcctcgattttcttcctctgtagcacctcacccaccaggttgcaattcctagtgtagccgatgaattccagtttttccttggcccaatcggaaacttagaccccacagagttcatcaatggagaaaccaaccgaatccccttcagattttgccaatcctgaccttagcccttggaaaggcaccttcaaatcctggccatcagccgaagtcagctagcctgcgtggtacaagaggatgttgactagcaaatcaggtcactggaaagaaattggcatagcccaagccttagcccttactgcagcaaatatggcaaggaatgaacccatgatggcagcatccacctatttttggtccatagccatgaacacgttccttttctctcaaggaccgatgaccccaacactattagatatcatcatgatcactggtctagatatcacttcatcggctaacttgtccagcctaaacactcaactcacccatgagttcaaaaccagaagcataggtggttggtcaggttatgttgccaagaacatgggaactgggccggttaccccaagagaacacacagcttttcttatgatgtggctggaaaagttcttattctgtggtccaagctgtggtccgaccgcaaactggcaatgggttgctgaaaatctagtagaaaagaagcattttccccttggcaagtatctgctaggctatttgtatcagaccctcaatactgcaattgacaaaatagcctctggaaaaacaatcggcacagggggtccatggtggctactccaaatttggctgaatctgcataccagaaaagtggccaatcggccagcactagccgatgtagaattcccaagattcgagccgatcatcagggacgatggagaaacaagcaccacatgccgatgtatgtccttcgaagaagcagcatcggttagcgcaatgtccaagctatcggctgaacctttcagggaatggttcaataatttctatgatgggttccccaagaatgataggatctggtttgcatatgaaggatctgctagctttgaactaccaggtgacttttgatttgatgaaatcaactctgacaaatatgataaatctagagaagtattctcaacagctatcagccccttcatcatccatgtcggcatccatcaaggcaagaatatccagatgacttacgaattctatcatccaacaagcgctgtaaggcaattcggcatgggacagctaccaattagcctattctttgctgacaagatccaaagtagaggagagatttcatcattccttatgatggatcggctgctgaatctaccaggaccacctcttggcagtattgacaacatcagactaaggactttcaggagtgtggcctttgactgatggtggatataatggaaaagacatttgttccatcaattgccgtccatatatttgacgaacctgtttcctgacgatgtcccacaggtaaaattctcacattttgttaattttattaaccacaagccgatgcgtctttaacttatgcgatcctgttctttatagacaacagaatcttctcctcctcaccagagcaaaagtggtgtggaaattgaatatgcactagggctcctacctaatggtggtggactaacacctccagtcatcggctataatgcccccaagacctccacattgctgcacggcctgtctcgtatgccgattgctcgtgctgctggaaggaaaagagcaaaatcagctgcggcaccatcggctgcaaagaaaaagtctaagaagcaaaagactgctgccgatgatctgccagccattgatccagatgtagcagatttcctggaggatgaagcaatgtccgaagaggtgaatgaagcgactgaacacatcagtgaaacacgggaacagacccccctgccgatccacctggccctcagataacaccatcacctccagtacgtcccacttatcagcccagggtatgcatctctttctcattcattgtccttatactttagaaccgatttctgactttgtgctttgcagaaaaagaagatagcttccaagaaaccacaaggagcagctgcaccggttaatttccctgatcctatcaattctctttttcagttttcaaccgatgctaacttgtactcacgttttcagccccctcgacattcaactcctgtctttgaatcaagtgaaagtactccatcggttataggaagtcatcatgtagaagaagaagaagaagaagtagcaccaactcctgctgtccctgtaagtataaaccttaattttgaaaatcatatcgctaccaatctttctaataatccacaatatcaatgtttctctctttcaggttctagccgatatgttctcttttgacatcaggctattcttggatgatgaagaagaaacaagaagctaagctctagtgcccctagccgatgatatcaaggcaaccttattggatatctcgaaacaacttgaaggctccctggagactttggttacaagctgcggatccatcacggacagactcaatgaaatccatgacaagatcctagatgagcaccagcggcatatcttaagcaacattggcttaaatttgaaaaagcccaaaagagaattgccgatcagcgtgaaaggagagatcttgaagcaaccatccaagccaacagaacgtccatcaatgaagaaaaagctaagctggatgagttggaggctggtccaagtgcaactcaaaccaacattgatcagctaaataaatggaagatagaactcatagctggactagagcaatgcaatgcacaacttgctcttgaacaggaaaagcttgccgatctgccaaaagccatcgaagaccaaaaaatccaagttgaaagcatctgtgaagcatctaactgagctgaccaagtcattgaagccgatttccagtactaatgcagccgatgccaagataatcaatgaagtagatcaagttaggcaaaaggcaatatcggctattcaaaaatatgtatccggatgagccgaaccttgtaattttcaactttaaacttacaaacttttgggctgtaatgaattccatgttaaacctctgccttcaaatttttgcttttgaaatccatattttctatatctctgcaatgttgaagacattgataaaattataatttggactaagggcgacataataaatatcagccatcatatatcggaggaatacaagcgattatgataataaaaacaagtaagggcgatacaatccatatcagccatcatatatcaacaaaacatagctgattatgctaataaaaactgctaagggcaatataacttatatcagccatctcaaggcgatgtcaacacatcggctagcatgcatcggcaatactcaactgatcatgaattgacccgaacacttgggtaatatttcttcagatattttccattaagtgctcatccataaacttcaccatcaagtccttgcaacatataagctcctttggacacaaccttatgtatttgaaatggcccctcccaatttggagaccacttgccgaatttattatcccgagttcctatcggcaagattaacttccaaattcctggtaaaaaaaaaagattaacttccaaacaagctctccctcagaaaaagacttaggcaccacttttttgttataatgccgagcagcccattctttatccttggtaacttttgcaagagctctcagtctggattgaaccaagtcttcttttttcatcggcaatgatattataatattcattggctgtcaactcattctgcaaatccatccttctcgagccgattctaatctcccatggtaaaactgcctcgtgtccatatacaagtttataaggaggaacttgaatcaatccatggcaagccatccgataagaccataatgcttcagccaaccttgtgttccattgccgaggtaaatcaaaaatcttcctcttgatcaatttaagcaaactcttgttagatgcctcggcttgcccattggcttccgcataatacccatactatcagcaaactgaacaaattcatcagatacgaaaatagagccctgatcggttgtgatagtctgaggaattccaaatcaataaataatatgttccttgacaaactgtattgcatccccagaatcaacatttttcaaaggaattgcctccacccacttggtaaagtaatcggttgccaccaatataaacttgtgtcccttgcttgaaggtggattaatcataccgatcatatcaattccccaacctctaaatggccatggcttgatgatagggttcatagccaatgctaatgctctctgaattgctccaaacttctggcaatcttgacatcccttgtaatatctgaagcaatcttttaacatcgtcggccaaaaataccctgcgcgccgaagtaaccacttcatcttgtgagcgattggtgagtaccacaaataccttcaagtacctcctccatcacaaccttagcttgatcagtactcaaacacttaagcaataccccatcaatcgtctgataatagagctcatcgtctaataatgtatacttcaaagctttgtagcacaattttcgtgaagccgattgagatggggtctacaaatattgaaaaagatcgtatctccaatcatcggctgcaattgtggcaacttctatttcaatatctttcaccatcggcttatatcctgatgccccctgagccaaatcattagcttcaacattttgctccctagagacatgcttcaaagttaccagccgaaaactattcatcaattcccggcacttttcattgtagatcatcaacgtatcatttttgcattcatattctcctgccaactgactgattaccaacaatgagtccctcatgatctccacatcatcggcttccacttccttgagcaactgcaaccccttgagaactgcttcgtattcggcctgattattagttgcataaggtttaatagtataagcaaactcaaaacttgccccccgaggggaaattattaccaagccgataccacaaccatgagtatacaccgatccattgaagaataatgtccaaggtgcaatatcaaccgagccaatcgaattatctcgatgttccacaatgaaatcggctatagcctgccccttgatggccttgggcgattcatacctgaggtcaaattctatcaaggcatatatccactttccaactcttcctttaagaaccggagccgataacatatatttgatcacatcggctttgcatactatagtgcattcattggataacaaataatgcctcaacttggtgtaagagaaatataaacacaaacataacttctccaccggaaaatacattgttcctgcgtccaaaagcctgcgtcttaagtagaaaataagtctttccttgccttcgagctcttggattaaaactgagccgattgacttctcgccagccgacaagtataatctgaatggtattcccttctgtggagcaatcaatactggaggagagctaagatattccttaatattattcaaagccttctgttgaaacaagatttcggcaatacgaaaagggggtggctatcaagcaggaaaagtggatgggtttagagacaaggaattttatataggttcaggccttctcaatgagaagtaataccctactcttatccggggattgattcaccgagtgtattattgatcgtatgatctgggagaaaagttatgcccaagaggcgcccggacccctccttatatagtgagaggagtccgtattacaagatacagcgcatattcctgacgaaataggcaagtaaaaataaatacaatcgtaaccgactaggatctcgggtatttccttgatacacaagttaagatataactcgagccctttaacgatatcttatctatatatggtacccctatacccagtcggatatacatgccgtgtgggtatggggtatccataatctccacacattctgctgctctgccccccaagtgaattcttgatcggctttcaaccttagcaagggtgtaaaaggttccaatctcccagataagttagaaataaaccttctataaaatttaccttgccgatcaacttctgcaattacttcttgtcttctggaggtagaatcttcttgatcgcattgacactcctctgaattactttgatccccctctcatgaacaagaaaacccataaactgcccagccgatacattgaaagcacacttcgtgggattcattttcaagccatatttccttgttctttcaaaaacctttttcaaatcggctctgtggtcttccacctcttttgattgaacaaccacatcatcgatgtagacttcaaccaacaagccgatcagatcatggaatatataattcagtgccctctgatatgtagccccagcgctcttcaagccaaaagtcatcacaacccactcaaataagctgattgcaccaggacacctgaaagcaatcttgtgaatgtcttcttctgccataaaaatttgattgtaacctgcattgccatccataaaactgataatcttgtgccttgaagtagcatcaaccaattgattagcaatcggcattgggtattcgtccttaggggtaaccttgtttaaattccaaaaatctatgcacaccctaagcttgccattcttcttgatgaccgagacaatatttgaaactcattcagcgtatcggcatggcctgataaaaccaacatcatataagcgagttacttcagccttgatagcatcatacatatcggctttgcatctccttggaggttgctggtaaggtttgtacccaggtttgataggaagtcgatgttcaataatcgattggctgagtcctggcatctcgtaatattcccaagcaaagcaatctctatactctttgaaaagctctatcaacgtggttctaaactctgtcaataaatttttactaataaatgtcggccttggcctatctcctgggcctatgtcaatctcttccaaatcatcagccgacatgaaaccctgtcctaatttgccatcgagatcatccaccgtgtccttggtgtagaaatttgaaccctccacgatgccctcaaaataataatttggggtctccatcttcaattggttgtatatcacaatcggacacttttagaaaattgttggtatttcttaatgacattactagaaatataatttccagcaatggcgcagaaatacttctggtatattatggttgtagagttcatccacaagcgcatggatataccattgtagcatttcacccgagattattccaagggtattgtatttattttatcccgtgggaagattatgtagagagaactcaactaataatttatatattacttgtgataatcatattctaagcgggggttacgaaaatccaagggtagagtgacacacaagcatttctactcattctcataataaataatctaatgtcatgcccggaatttctatccaaaactccaaacgcttacatgtgtgtaaaccctcgtccaggaatcagtcgaggcacacaataacaaattgataatagagtgcaattattgctctatttaataggcgaatataaagtcattacagaggtagatagttcctatcaaacaatagagatctaagcaacagaaaataaaataaagagcataggcgactccatcccaccagcagcttgaccagggctacgcctaatcctccacaccttcagcctcactgtagaactcctccaatgatgaatggttgcaaggtgagtatatgacatactcaacaagccatgcagcaaatatgcaagtgtaggggataacaaaggatggcataatatagtctcatttgcataaatggcaatcaataaatacttcagaattcagaaaaacagtaaagcatttaattaaacaatattaatccaacgctatacaacatacccgttgcataggcccaaccattctgaacaaccattcccggctgcacagttctatctccaaaccaggaatataccattccaaaccaggagctaaacaagttattaccaattacaacatcatttattatggtgagaggtgtgagactaatcacgaaagacattgttagactcgcccataaccgcgggcacggctattcaaatagttttactctggccagaggtgtaccactgtacccacaagacacaacctcaacatcatgtcaaccatgcgtcgcgatacttaacaagaacctgaatagagattgtgaatagagattgtgacaataccctccgcataacacaattcaaagcagtgcaccattcctagatcataatcactaccttataaaacaaggcatggactccccagcgacccccctgggcttatctccgccacttctcagtctggtgccccataatgaaccacactatataaaaggtaaagccgttgcccacgctggcttgtggttggcacggttaatgtttcacaaccaaaaatcgtgaaccggttcttaattgtcatgagcacgaccatcaaaactgtttacacccaaatttggcacctaggattaaaataggaaagattgccaaaatttggaagtctaccggtttcctccgagtaggccggtctgaccgccgtgtgttcgccggtcagaccgccagttgagggccggtcagaccggcggtgtgtggccggtctgaccggcaggtctgagtccgactgtgttttgtcgggtctcgaggtttccttgctcgggaaggcatgtttcgggtttcctttggtttctgccccgagttggacgtggaggagggcctgtagagggcaagaccaacccctatataagggacatggccggttcattgtaaaaaaccaatctacaatcaattaaccgaatcgttttttcatattgcttttagttttctcttagtttgtccatctttatcggtttgcgccgtaaaccgtccgccaccgctgcgagagtgcgacatctctttgtaggtttgtcctgaaaaccttccgttttgcccacgagatgggtagttatctagaaatcggctccgctagccggtttagttatcaaaacccatttaggtttagctctttgctagatcgaggtggttggcgactctaggatcaccgcaggcttaaggtgctgcgatcgtgcttgtcaacttgtcaaaaaagttgccaacacgatttttgacgactctgctggggacgagatctgttcatcgtcaactcaacttcgacttcgtcatgacgtagccgccatccaagacggaggtggagccatccaatatgatgccagtcaccttggataaattcgaaggagaagaccgtaaagctatggaggagtacatcaacgaactcacacgggaggcattgatgagggcaagcactaggactcgtcaaggtgtgaccatcaagcccgggccacgtcctaagctcgctcctgacttggtaagtaatgatgaggtaacacaatctatccaacaacaagtagcatctacaatagattcatctatgattgcttttaaagataagttagatgcaacttttgaggataaatttgatgagtttttaagggttaaattcggccctcttatggccaattacatgtcaaaaaataaagcctctaccactgctaaccaacctcctatagatcaaacgggtagtaaaaccgatgaagcggcgcatgcggccggtctgaccgggcctgacggccggtcagaccaggacttagccgtcggtccaaccggccaaacggtcggtcagaccggcactcaagccagtgccggtccgaccgcgcctctggatgccggtcagaccgggccttgggccggtcacaccggtgcaattgttccgatacaaggaatacatccaatgactaatgctggttatttgtatcatcttagaacatttgatcctcctgtatctactgctgcaagtagtccccaggttcccccacatgttcctaatgcttataatgatgttgctagggggtatccccccgatactagacaaggccaatataatcatattgcgccacaaacacaatctattaggccactgaatccaccgccaagtcaacatgggcctaataatatagaggatataattagtgagattattaggaatagattcgggattgaaactaggaatcgtgctagggtttacaaaaagccgtatcctgattattatgatgatgtgccgtttccccgtaattttagagttcccgaatttaccaagtttagtggtgaggatagtaagaccacatgggagcatgtagatcaatttttggcacaatgtggtgaggttaatagtgatacttttaaattgcgcttgttttctttatctttgtccggtaatgcttttacatggtttacttctttaccggcaaattctattcatacttgggctcaactagaagaaaaatttcatgattatttctatactggagaaactgagcttaggttatgtgatttaacatcggttaagcaaaaatataatgaatctgtcattgattatattaagagatttagagatgttagaaaccgatgttataccttgaatataactgatagagatttggctagtcttgcttttaatggtttaattgctcctcttagagaaagattagatggccaacaatttcttgatgttagtcaacttatgcatagagctctggctcaagaaagccgggttaaggataataaaaaacttgttagaccatatgacaaaaggcctaatgttaatgtggttgattaccctgaggctagtgatagtgaggaggagggtgatcatgatatatatgttgccgaatggtcatggactaataaaaataagccttttgtttgttctaacctaatgccaactcctcgcaaagatcgacaaagtgaatttaaatatagttttgatgtggccaagtgtgataagatttttgattatcttttgcaagaaaaacaaattagattacctaaaggccatgtcataccatctcaagaagagttgaaacgtcgtgcatattataaatggcatgattctcattctcattctattaatgattgcaatgtgtttcgacgacaggttcaatcggccatagatgaaggacgattgaagttcaccgatggctccaagatgaagcttgatcatgatcctttttcggtgaatacaattaatttcaatgataaaaaggtgttgattcggctggagcaagccgaatctactaagggaaaaggagtggtcattggcgaaccaagacctaagatgatagtgccaaagaagccggaggttggcgtttggaaggaaaataagaatgaagcttcaacttctaaagcccctaggaagaccaaagtgacttttgacatgcttttggaaaagtatgagaaacaaggtggtgagagagctcgaaataaaggaaaaagaccaagatcacctcctagggagcgatttggttattcaccaagacggtcgcattcacctccatatcatcatccacaagacatgtcatggggttcttatccaatgccgccgctgggttatccttatccttattacatgccatggggagcaacgccgccaatgttcaatcatatgcctctaatgcaattcaacctagggtggggaggaccaaggaggccaattcatgagcatttgtcttcaccaaacaacggccggttttatggtaaaaatcgggctaatgaagaaagaagggaaggaaagcgcatcaaggtggagggaaggacttcggaagtaattaccatcaaagaggggtctcatgatgtgccaataccttctggagatggagttggagtgtccccgaacaaaaaatccgaagccgataccagctcatcgcagtcggccggtctgaccgcagccatacggccggtctgaccgccggcccgacagcggtccgaccgacgcctcagggccggtctgaccgtacgccgagtgtcggtctgaccggcacatctggccggtc

SEQ ID NO: 33327 - DNA, 11521 bp, Oryza sativa
aatcctaggtggatgcctaaggatttgacgtctgctcaaaagagaaggttgcaatgtcttcgggctcaagagataagagagaaaaaagccgaagaacaaagagataaaaggtttaatgagttgcgaccaccaccggtatggaggcgtaaatccatagagaacgaaaagtcggttgttgtagaggagaaggaggaacaatcggttgataagggtgaatcatctccaaaagaagacatggatattaacatggtatgtatgttgcctatggatttttgtgctatggatgaagccgaggttgctcaattctcattaggtcctaaagatgcggtttttgagaagcccgatgagtcaaaccgtcacatgaagcctctctatctcaaaggccatgttgatgggaagccggtctctaggatgctagtagatggaggtgccgccgtgaacttgatgccgtactcattattcaagaagttagggcgtgaggatgatgagttgaagaagaccaacatgattctcaatggcttcaatggtgaaccaacagaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacagcgatgatgttgaaattgttcaagcggatacatcggccgaggttgcaatggccgatgctacttttgagtggcgtcatgggaatatccaatgcttatcggggagggatctttctagctatgattttattagtatctctgatggcaaatttgtacctatctctgtaaagccggctagtgtagcacgggtaagccatataaatttgtataatgagtaaagaggctaatttagagtggttacaaaagagggtgcaagaatatcggtctacaaagaacgatattggtgaaaccgttgaagattttgatgaagtagagaagcttggaaaagggtttacatcagccgatcctttggaggaagtagatataggtgatggaactaaaccaaggccgacttttgtaaacaaaaatatgagagccgattataaggtaaaaataatcgagctacttaaagagtatgttgattgctttgcatgagaatatcatgagatgtcgggtcttaaccgtgagctcgttgagcatcggctttcaattaaaccaggttttaggccttataagcaatcacctcgtcattttaatcctttgctatatgactgagtcaaagaggagattgatcggttgttgaaggcggggtttattaggccatgtcgttatgcggagtgggtttctagcatagtcccggtggagaagaaggggagtggtaagattagagtttgcatagattttagagatttaaataaagccactcccaaagatgagtatcctatgcctatacccaccataatgtttaatgatgcgcgggttcataaggtgattagctttctagatggtaatgccgggttccaatcaaatctttatggcggaagagaatatgtacaagacggcttttaggtgcccgggatttgttggtttgtttgagtgggttgtcatgacctttgggttgaagaatgccagcgcgacgtatcaaagggcaatgaatttgatcttccatgatttgctaggtattattttagagatctatattgatgatattgttgtcaaatcggatggtatggaaggacacttagccaatttgagattagcttttgagaggatgcgccggtatggtttgaagatgaacccacttaaatgtgcttttggtgtgtcggcggggaagttctaaggattcatggtgcatgagagaggagttgagattggtcctaagaagatagaaaagattcgtgatttcaaagcgccggcatgcaagaaggaagtacaaaagttgctaggtaaggtgaattatttgagaaggtttatttctaacctagcgggtaaatcgatacttttgttcctatacttcgcttgaaaaaagaagccgattttacttggggggcaaaacaagaagaggcgtttgaagagttgaagaggtatttgtctactccacccgttgtgcgagcgcctaaagccggaaagccttttcggttatatattacctccgaggacaaagtcattggtgccgttttgatgcaagaggaagatggcaaggaatatatcattacatatttgagcagccgtcttttggatgccgaaacgaggtatgtctttatagagagactttgtttatgcttatactatgcttgtaccaaattgaggcattacttgttatctagtacatgcatagttgcttgtcaagccgatgttattaaacacatgttgcaaaggccaattctaagtgggagaattggcaagtgggcatatgctttgatagaatatgatttggcttatgaaccattgaaatctatgaaaggccaaattgtatgtgattttatagtggaccatcatgtagatattgcttatgaggaaaaggtttgcttagttgaagttataccttggaagatttattttgatggttcttcttgcaaggaaggtcaaggcataggggtagttttgttttcacctaatggcatgtgttatgaagtatcggttcgtttggagtattattgtacaaataatcaagccgaatacaatgctttattattcggcttacaagttatggagatggttggagctaaatacgtggaggcttttggtgattcggaattggtggtacaacaagtcgccggagtctacaaatgcttggacggatcactaaatagatacctcgattcatgtttagatattattgccaattttgataattttgctattagacatattgttaggcatgataattctagagcaaatgacttggcacaacaagcatctggctataatgtgaaaaagggattatttctggtattagaagagccggtgcttgattttaaatctttgtgcaaaattggtaaaactggagaccaggggcggtctgaccagctgcttgccgtcggtctgaccggcgatcccgagcagtctgaccagccctgtgtggccggtctgaccggttctgggcagagcactggggggcatgtttcaatcaatttagaggccgaattaattgtgaatttggacgtttgtgcccaggaagcagaacaagattggagaattcctttgattcgatatttgaaagatcctacacttaaggttgatcggaaaattcggcggcaagcattcaaatatacattgcttgatggagatttgtatcaccgaaatatagatggtgtcttgttgaagtgcttagatggagatcaatctaaagtggctacgggagaggtacatgaaggaatttgtggaactcatcaatcggcccacaagatgaattggttgcttaggagagtggggttctattggccgaagatgattgatgattgctccaaattttatagaggatgcgaggcttgtcaacggttcggcaatgttcaattggcgcccgccgccgtgttgaatcccataatcaaaccatggccgttccgaggatgggctttggatttcattggtcaaatttatccttcgtcatcaaaggggcataggttcgtgctagttgctatggattacttcaccaagtgggccgaagccgtgcctttgaagaatatgactcatacggaggaaattgactttattttgaagcatattatccatagattcggtattccacaaacattaactacggaccaaggtacttcttttatgtctaaggaagtgaagagttttaccgaatcttatggtattaaattgttgagttcttctccttactacgctcaggctaatggacaagccgagtcgagtaataaaacattgttgaagttagtgaagaagaagattgaggaatacccaaagaggtggcatgaggtgctttctgaagcattgtgggcgcataggatatcttaacatggtgccactaaagtcattccttttgagttggtttatggtcaggaagccgttttaccggtggagataaatcttggttctcttcgttatatcaagaaagatgatttgtcaagtgaagattacaagacgttgatgggagacaaccttgatgaagtcatcgagaagcgcttgaaggcattggaagagatagagaaagagaagaagagggtggccaaggcgtacaacaatagggtgaaagcaaagttgtttcaagttggagacttggtttggaagacaattttgccttcgggtactcgatccaaggagttcggtaagtggtctcctagttgggagggtccttatcgagtatacggcattgttcgagggaacgcatattttttggagacacttcaaggggagcgctttcagcgagcaatcaacgggaaatacttgaagaaatacttcccgagcgtttggcaagacgcttaggaggtactatggccggtaattagattatcgtcctaagaccaaaatatgttctatgcttttagattcacgttgttcatcaaaaaagcagggggacatgtgtttacacccaaatttgacatctaggattaaaataggaaagattgccaaaatttggaagtctaccggtttcctccgagtgggccggtctgactgccgtgtgttggccggtcagaccgccggttgagggccgatcagaccggtggtgtgtggccggtctgaccggcaggttcaagtccgactgtgtttcgtcgggtctcgaggtttccttgctcaggaaggcatgtttcgggtttcctttggtttctaccccgagttggacgtggaggagggcctgtagagggcaagaccaacccctatataagggacatggccggttcattgtaaaaaaccaatctacaatcaattaatcaaatcgttttttcatattgcttttagttttctcttaatttgtccatctttgtcggtttgcgccgtaaaccgtccgccgcaactgcgagagtgcgacatctctttgtaggttgtcctgaaaaccttccgttttgcccacgagacgggtagttatctagaaatcggctccgttagccggtttagttatcaaaacgcatctaggtttagctctctgctagatcgaggtggttggcgactctaggatcaccgcaaggcttaaggtgttgcgatcgtgcttgtcaacttgtcaaaaaagttgccaacaaaaaccatgtgctcacaacccaccattaccatgttttagttcgcatcttaataaaccatcctatcacgattgaccatcatgagctaccattaatccatcattaagtaatagtgaatcattagttatcccattcatatgagctagcgtctctaagcatggctaagcatcctaattactttagctaaaaccatataatgttctagctaatccaattattaaccgggtgacaaagtacaagtaatcaataacaaaaaggctataacaaaggaaataggtcattcccacccgatgacatagttgaatcgaaacaatagctataaacgggatcaacatgctcaaagggttttttgggatctatgtgacttgccttgctggccttggaattcttcaaagtcttcaagactaaccattctgtcctttccacacttgagtagattcttcagatagttcactcttgggcgtttaggatcaggatcaacagcccttgtcttgtacagcctcaaaggattgctttaagaaccaggctcatcctcattgccaccatcatctgactcagatacagctggagagggagagcggggtgcatcacgaatgacaatgctaccagccctcctggaatggatcggaatctgactcccactgtaaaaatctccaactttttctttgcccaatcttcccctaggaccacgaaccggggggctcgagtcagcaggaacatcttgagaaagcttctatctcttctcatgaggcataatgaccactgcaacaagaatcaacaaggttggagtgcaatggttaaaagaaacagtagcagaatcaaggttactggctgattggacagagaccggaagttccgggccaagaacaccgaaacttccagccagcaaaactgaagaacggaggatttaaccaggccagtgcatgtgacaaaaaaacctatcgatcagcaatctacaaggtagcaggaacaattctatccaaaaggttttctccctaggttcacatatttagagatcggggcagaaacatgatgaaccaaaagagaagatcaaaagtgctaccttgagagggaaaatcgcaaatcgatcacgggatgaacctcctagccaccaatgtggttgattccacggagaggaatcgaatttccacggttggaagagaaaatcgccgagaggagcactgtagcggcggctagggtttgggaatcggggaggagaagaagtgaggagagagataccaggcttgggctccccctgggtatttatacccccgacccccggaagttccggtcagttccggactggggtgaccggaacttccggcctgacagaacagagcgtagttaggcgcaagttcaatggaatagatgagaattcaatgatttggaaatgaaaacctatggacataaagagacttatgatgtatatgaccagccaacaatcaacattacagaacaatggttaatatacatcacaagaagggataaaaaccaaattttcgcaataaaaacacatacaaaatttttcacaaaaggatttttttttggataatagagggaatgtttgagctttattcctggtatcaagaccatcttctacacaagaagtgatctcaagacacaaaagctcaattttttttaatttaaattttaatgacacatgtttggctatgaattagccaaccacccatcacctaatgttacgagagtctaagatattgagctcactcctaagctcgcaaaaccttttctcatctaaaggcttggtgaaaatgtcggctaattggctttcagttctcacatgggtaaggcatatgtccccttagtctcatgatctctcaagaagtggtggcgaatgtctatgtgcttggttcttgagtgttggacgggatttttggctattttgatggcactctcattatcacataggagtgggatcttggtgaagttgtagccaaagtcttttagggtttgtctcatccaaagaagttgggcacaacaagaaccggcggcaacatattcggcttcggtggtggataaggcaatggaattttgcttcttagaggaccaagaaacaagggaccgcccaaggaattgacaagtcctggttgtactttttctatcaaccttacacccggcataatccgaatcggaatagcccaaaagctcaaagccacaacccttaggataccacaagccaagattaggagtgtgaactaaatatcttagaattctcttgacagcaatcaaatggcactctttaggctccgcttgaaaatgggcacacatgcaaacactaagcatgatgtcgggatgagatgcacataagtaaagcaaagatcctatcatggagtgatataccttttggtccacacatttaccattatcgtcgaggtctaggtgtccattagtaggcatgggcgtcttgataggtttggcatcctccatcccaaacttcttgagtatgtctttcacgtacttggtttgagagatgaaggtgccctctagtgcttgctacacttgtagtccgaggaagaaagtcgaactcgcccatcatagacatctcgaaccttttagtcatgattctactaaattcttcacaaaaagaggcattagtagaaccaaatattatgtcatcgacataaatttggcatatgaataaatcactcttaaattttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagactaactccgagataggtccattgagaaagtcacttttgacatccatttggaataacctaaaatcaaggtgagcggcataggctaaaagaattctaattgactcaaggcgagcgacaggtgcgaaggtttcacaaaattgagaccctcgacttgggtaaacccttgcgcaactaaccgggctttgttccttacgaccaccccatgttcatcttgcttgttgcgaaagatccacttggtgccgatgacattttgcttgggtctctccaccaaagtccatacttgattgcgagtgaagttattcaactcctcttgcatagccatcacccaatccggatcaccaagcgcatcttccaccctggttggttccaaagaagagacaaacgagaagcgttgacaaaaacttgcgatacgagagcgactagttaccccttttcttatgtcaccaagtatgttgtcaacgggatgatctctttggatagtgtgatgtatccttgaggatggtgcactggggggacctgagcctgatcagaatgctctaaagtgccctcagcatcgatcccatccacttgtgccgttggcacgtcttcactgccattgatccggaggttccggactgtagaacccggaacttccgggcctggagatgtccggaggttccgatcaataggacccagaacttctggctcagcagatacagcacttgtagggctattggatgtcgatgacggaggttgatccctatcttcttggtcatcctgcgtctcgactggtcgtatgtctccaatagccttggtacctatagcttgatttggatccacatcccctacaacatgtacaacaacttgctctccttgggagtcattagattcatcaaatgtcacatccctagtgacttcaacaataccagaggttttgttgaagacacgataggcatgtgcatttgatttatagcaaagtaagaatccctcatccaccttaggtgagaacttagatgagcgaggcctcttacttaaaataaaacatttgctcccaaagacacgaaaatatgaaacattaggcttcttaccactcaagagctcatatgaggttttctttaggatcttgtgggggtacaagcggttgatggcatgacatgcggtactcacggcttccgcccaaaagacatccaaagtcttgtactcatcaagtattgcccttgcggcttcaatgagggttcggttcttcctctcaacaatgccgttttggggaggatcatagggggcggagaactcgtgcttgattccttcttcatcaagaaattcctccacttgagtgttcttgattctcctccattgtcgcttcgcaccctcttgatagtgagatcatagaggttttgggcttgctttgcgaagcgcttgaagacatcttgagcttcgcttttgtcatggagaaagtacacccaagtgaagcgcgaaaaatcatcaacaatgacaaaaccatacttgttacctccaatgcttatgtaggccacgggcccaaataaatccatatgaagaagctcgagtggtcttgttgtagtcatgatgttttttataggatgtggactcccaacttgcttcccggcttggcaagcactaaacacacgatctttctcaaaagaaacattagatagaccaagaatgtgttccccttttagaagagatgccaaattcctcattccaacatggactagcctacggtgccatagccaacccatagaggatttagcaatcaagcatgcctccggattcactctatttacgtcgaaatcaacgagacagagatcaccctttaacactcccttgaatgctatgcaagagtcatctcgcctaaaaatggtcacatccacatcggtaaacaagcaattaaatcctaacttacacaattgagacacggataataaattgtagcttaatgaattgacaaggaggacattagatagagattgattcttgaaaatggcaatcttaccgaggcccattacatttcctttaccatcatctccaatgacaatattttcacgacttccacccttctcatcaagacttgtaaacatactcccctctcccgtcatatgattggtgcagccactgtccacaacccaacttgagccaccggaggagtatgcctacaaaagaaattaagcttgggatttaggaacccaaacttgtctaagtttgggtcccttgatgttagtcaccaaagcctttggcacccacacacaagtgcggtactcatcattgtaattcccattaaaataagcaaccactttgccctctgaatttttggaaattacatatgaatcatagtaaagaccctctggccggaacttccggccagccccttcggcctatcagaagcccggaacttcctgacaaaatgtccggaacttcctgtcttacagggcaggaacttccggtcattttgcccggaacttccgagtgtctgaccagtgaggggacaagtcacctcaattgcttgtggagcttttccttctcttacaaacatcaagcattctttcccatttaccatcacacgcttagacacaggacttccaccagaaaacccgagcccgtgtctatccttgttaggatgagcggtgatggtcttgtaaagggcatcttttgaatggtagtcttcatgcatccatatctcaccaatgtgcccaacctttcatttcttttttaagagcttgcatagcatcaacattagtagcatgagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaacttctcttgaagagtttcattgacatccctaaggctagctagagaaccattagccaaattaagctcattagctagttgttcatttttagcacattctttagctaggctctcctctaaggcaaggtttcttttcttctcaagaataagtaattcttcttgcctttcgagagattgttttttactatccaaagctctcattaacttagccaaatgttgcatagcgggtttgctaaagctcttaagcacatcatctaattcattatcactttcctcatcactagaatcaacatcaagagaggtgtgagagggcttttgagtcatcaccttgcagccttgggccatgaaacaagagtagtggtaggagtcctcgtcgtcattactcaagttgttgaagagacgctccttgcttgaagaggatgacttgaaggtgacggtagcaacaccaccttctccttcaaccttgtcttttggcttgggcttgggcttgacctcgagatcttcttcatctgcagagtaccacacctccgccatgtgtgcctctgccacatgagcacg

SEQ ID NO: 33328 - DNA, 720 bp, Oryza sativa
  unsure (1)..(720): unsure at all n locations
gagcacccgagtaagttgtggtcgagtacaccacattatcgagaacgatctcgacaaatgcagagtcgtcgcgcccaacctaccaacgaagaccgacnnnnnnnnnnnnnnnnnnnnnnnnnnctggactactcgagaaaaggttgttaacggataattcctcgcgaacgtcgtcggcttgatcacctgacatgattgtgaacggacatccggatatgctacaagttgggtgcatgagtcatcctggtcacatgagacgcacataataaaccaactctagcacttccattggtgtgcgagagatcattctacacgttcgctggtcctcgaaccagtacatagtaatctctcgcaccgcaagcttccatcggtgttcgagagataattctacacgttcgctggtcctcgaaccagtacgtagcaatctctcgcaccgcaacctccattggtgttgagagatgattctgcgtgttcgctggtcctcgaaccagtacgtagcaatctctcgcaccgcaaccttagatggtcgaggtacgactacagcaatagcgcaacggtcctagcaccatgaattcaaatgatcgagagacacctactcactggttctcaaccagtcaatcgtagcgatctctcgtacatttacttacagtggttgagttacgactactgcttggttcttgaccagctgtgtagcgattctcccactatttgcacttctag

SEQ ID NO: 33329 - DNA, 707 bp, Oryza sativa
ttcctgcagccccagaatgtctagatagttgtacaagtgcgcctttatgtcttgagtatggggcgatttcagaaccagcagctccaactgttggtggggtgatttcagaactagcagctccaactgttggtgtagaacaaccaccaattcattatgttgattgggatagcttggagatagatggaacattagatgatgagggaaggattcacgtcatgaatgatgaccaattgtttgcactcctaggcttgagggataagggcaaaaaaatcagtgcatgctgttggttcaagtagtaatgttcaaacaagtggtcctggagtccttgagggcatcgagggtgcaacaattcctgtcgacaatatagtaccgggtgagcttgttataatctacgacaagaataacccttgtatggatcgatacactaagtacccctcaatgaaggaattcagattggctgtaagatagtttgctatcaagaaggaatttgagctaggcaaagtgaaaagtgacccagagaggtatagggtaaaatgcgcggtggagggatgtacatggagtcttgttgggcgtaggcagagtgataagaaaactgtaatggtactaacctgaaacataattttttttgacattaattctagtgtgcctagtattgtttacctggttttaatggattacctttcctttcataacaaagaccatacttg

SEQ ID NO: 33330 - DNA, 485 bp, Oryza sativa
attcttattgcaatcatgaggcatatcaaatgcaaattacattacagtatgagaagagaggcaccggagaataccacgacgggatgaatcacctcagccagtgatcatagtgccagtgccctcatctgtgagaatctcgagcagcaacgagtgcgggacacgcccatcgatgatgcttgcagtgtgcacgccctgtgcgagggcacgcacgcagcattccaccttcggtatcatcccaccagctacctgcccgtcggccaccatctgccgcaccccagcaatgtcgatctctttcaccagactcccggggtcattacggtcggccagaattccagacacatctgtgagcagcaacagcttctccgcgccgaccgcggcggcgatctcgccggccgacgtgtcagcgttgatgttgtacgcctgcccggtctcgtcggcggccacagtggcgatgaccgggatgtgaccggaggcgatgattgggt

SEQ ID NO: 33331 - DNA, 6076 bp, Oryza sativa
cgccgcctccgccgacgaagcagccggcgccgcggcggatgtgacggcgagacggaggcagcgtctaggggcgggagaggcggcgatgggctttgcgtggttgggacccggagcggggctagacacccgcgtggatgggaagaaagaggaggaggagaggtggggcttcgcgaggagcatggcggcggcggcggcagtcggctcgggaaggtgttcgacgaaatggctatacgggagaggatcagaagaagggtagaagaggttggccagtgaacacgatttttttgtctgacactgtctccggattcaaagtctgacgattgtcacacatctcatactggactacttgattcaaacgaaagagtgaactatccagatcagctctccgaaacaaaagaaacacaaaaccggagaaagatcatacatgatctatccacaagaaccactacacaagcagaaatgtttttgacacaacacaagaagaaaaatataatagagttataccgaaaagataacaaaaatacttcaatgaaaacatgtttgagctcgaaaccaatttccgcataaattgttcggttaatcctcacaagaaaatgattataggagaatttgaggggaataacttcatatctcaatccctttagatgagggttagacgaacaaatccttaatcttgcctagagcatagtggtttccgtcagccatctagcatctctcactcgagtaacattattcatcaatcatcaataacaatagccatcgtagatgctttaaattcatcataataaggaaccaagtagctccatgttttttttaataagaagtaaatgaccgaagctataatgagtaagttacataaggaaaaattattgggaagtggactttaaaagacttatgtaactttctcattttggtcatctgttcataataaactagactatctccgtataagacgtaggagtagaaaggaataactatagtatttatttctttttactcctcttggcattgcaaaccattggaacgtattcattttaactaaagatggatgcattttccttttatctaacagattcaaaatttcatctgttgaatacacatgttaaatattatgctccatcgggtcatagtaaacaattttcctgctaagcgctgcacaaaatcctgccatccctcaaatcaatcctagtggaatcccaacatttgtttcgatggattagcatataaattctttactcctagattgacttcgcaatatagtccctttttgttgggtaaaagcggcttcgatgctaaaaacaatatagatattagcaaatccaaatttagtttgattaggacaagtcaataactttcattattttttaagagcatttgctggacataattaatttttttattacaatcgaaattctcaacctcttgatttactagataggagtaattggaaatccagatttccttgcatcatgccatgtcaatgtttgtaacaattttatacgaaaaattatgtgcatagagccttttccgcatgttaggccctctttgtttaggcttaggcttattggtctagacttttaagtcagcttattggcttatatgatttataagccggtggatttaatgtcctaagtttagtagttgagtcatatatctacctcacataagccaaaaaaacttctccaacctagcttttggcttaatagtgctagagtggcttatggcttcaaaaaagccaaacggaaaagctgtttgtttgtttaggcttagacttttcgacttataagttggtttataagcctaaacaaagagggccttaatatagctgacaaatgcggttaaggtatttcaaaatctaactagattatttgaactttttagcagctactgttagataacgtattgtttagattattcaattaccttgtgacatggaaaatgttttttttcgcgaacgcataaatagattgcacttcaatgacacggaaaatgggtcaagggctcaagacccatctaaatatctaatgcaattagtttggctaacctttgttttttttacatgtttgtcatgttttagatgcgagaaatcggtcattttgtgcactacatgataacatagtgtagtattatcttgcttgaatatgtactatgtattttttttattgaatccatgcatatgatctaatatatctaaacgttaacatcccttcatgcaatattagaagaacaaaaagatactctcaatgtatccatacaccatccgcctttacttgtaattgagtaaaaataagtagaaaatatggtactaacaagcattgtgcatttgaaccaactttatccccaatacgacaatcacatacatcatgtgtgtgcatagaggacatgttttttttttcataccatcatgtttcatcccctgttccccacgtggtatgcttctctaggactacttttcctcgaccaaatggttcatatatatgtatctttgtatttctgaacatcttagttttcatcttgcctctcgacagttatcatgctttaaccttccgttaccaacctaccacattaatgttatgatcgaccgatattatcacatgtagaaaccagagtattgctcatgtccgtcatgtggtaaacactgaaaccttaactaatagtattaagcaatagattattggctaacctctctatattcatgaccaattcaactatggtaaaacaaaatttaaaatgaaaaagaccaagactacttcaaaataaccatattaaccttttcttaaaaacaagctatctgagttaattaacaagagttgcaaccacatgaaccaacaacttactattgcttagtaatatgaccttgtatggcactgataatcaaagctttacattgaaaattgtaatacactggattcacaccgtataaaaagaacttcatatgaaagacttatcatgaagatcaaataatgcatgtcctaggttcaggtgccagtacttgcttatacgctactccctccgtcctataatataagagattttgactttttacttgcagtgtttaaccattcgtcttattcaaaaatttttggaatttatttattttgtttatgacttactttattatccaaagtactttaagcacaacttttcgttttctatatttgcacaaattttttgaataagacgagtggtcaaacagtacaagcaaaaaagtcaaaatcccttatattatgggacggagggagtacctgttaattttaaaaacaatattttatcatatatataacaaaataaataatttgggacagtaatctatattgaacattgtcggtctcaccattctgggctggctgttaaaaggccgactgacggaggtccaaccctatgcccgctggtgtccactgtccacagaagcacggagtccgtgcagcggggcgaacagcccccttcgcccgagataactcactccgcctccccacacgcatattctctctcctctctgcgccgttcgcctagctctcctcccccccttctcttctttctcctcacggttctcacctcctccccccttgacagtgcacacgccaaaaccaccgctaactcccacctctcgcccacacctccctgatccgatcccttcccccctacaaccctagccgaattccgcctccgccgcgatccgctcgtcccgcgctccaattccgtccttcatccgctctttgttttttttgcgattgtttttttgggtgcgattggtttggtgatccgcgtgttagggttcgggagtcgccggggcgggggtttgggtggtggattggaccggtaggtggccgggagggttggcccttgtggtttcggggtttggtttcacccgccgcatgtggagaatcggaggacctgggagaggttagggttagggttatggggagcacgggggagcccgaccggaagcggcggctcagtagctccgtcgcgcccggcggcggggcccctgtttcttctgccaagcggctggcggttgcacccacctccgaagataagaaggtatttgcgcatctcgagccagctctgtatcgttttgagttaatgtttatggtggtaccgggttagtactgtttgtttgagttcatgtttatggtggtagtactgtttgatatggtggtgtatgatagctagatggtggcatggggactgatttttagctggtttgttatgtcatggaatccatacatccgctaaaagatctattgtggactgtttgagtatagatcgatgagtttattcttgacaagtgtttgatgcttttgtacttatgctgagctctatgcaattgcaagtcttgctgtgttgtggtcgttagtggaagaagccctatgtatattgcctcctgtcagagtgaaaacaaaaatactagtaggaatgagctatgcattatccgtttcggattctgcaactattgcacgattgtttatggttctttagagcaattgatgtattctataattattactcggtgatagatgggaggctgacttgtgaaattgttacttgacttacattgcattcttgttttcccgtgttcatgatagcagaaagtggcaattccttggtaaaccttcgtattttgagttttttaaatgatcttagttttttgtggctacatttatggatattgaaatggttaactttggactagtagcggatctagaagttctcttgagcttgggcaaacctaaacgaatgggctagattataggattaataagtattatttttttgtcaaaagtagataatggctgttggagaactgtgtagctttggccttaggctgatggcagcaaacattggtgtgaggctgtgtcttgactcctttgttgcttgcatagctgatttagcctctattaaaagaagcagattaagcaggggcattaagtggtaatccactggctaatacggtggagcccgggcacctgcccgtggtggccgggccctagctccgctgctgctttggacaaatttaattttcttgctggcaatgataccataatgtgccaatgcttatttacaatcatagcgccttttatttttccatagcatatgctattgttttttgatatagataaaggtctaaattgggtcgttaaattaatattaatgaaatttgtcaccaagttactactggtgacaactgacaattaatcgctgttactaccggtgacaactggcaattattcgcctactttgttatttaattttacaagagggaaatatgggaaaagattggttaaattttgggagggataggtcaagggtataatggcatgttggatgataccttttatgcgtttactcatgtgttaccgtatttggtccaatatggaatatccatgcacaaaaccttttttttcttttgtcctgtagcatgaaatgaacctatttatcatgttggtgatatcatcagtacggctccttttgtgtttatgttctgttttggctctgctcttcttcaagttgtaaataaaagatacttgaatgttggttcagcttttctttttatgcttgaattagtgatttctctttgttgccaaacacatatctttagttttgatttcgcacactgcctacttatattgtcttgtttggcagctcgattttactgtactcaaatacaaaaaccaaaagctctcagagcaactagaagcccacaagtttgagtatcgtgctcttgaaaataaattcgctgggctaaaagagaagcagaggactcataatgagacactttccttggtcaacagttcttgggaacaagtaagctattattttgtgcatgttttaccaaaaaagacagactttataatgtttcttcctgaatccctttatttgatcagcttgtggcagacctgaagtcaagatctttttgcaaaagtggatctcctaattccagccctggttcagggcacaacaatgtacaaaagggtatgacttcctttattttctaaaaacatcccaactacattttcctagacaggttttgaaatatgggagtgccatctactccctctgtctcctcatataaggg

SEQ ID NO: 33332 - DNA, 17403 bp, Oryza sativa
atgacttacattgtgaaacggagggagtacctgtgatatgtatgatctgacccaattatcaaccaggaattgatttcaaagcggttggtggaaattaagagattacatgaagagagaattgaaattttgaacaaaatagcaacttttcaggtttgttgattggtcaagcacagaatgcatccttgcttagccttgaaggcccatgcttaatatttattgcatgggagaattttttagtatcagaacctgtatgactaactttgtgtgtgtgtttttaatctcctccagaatatcttgatggatttcaagagcattcgttcttcaaaagcttttcagcttgttaatgatcgacttcagaagtcacaagcagaattggatcactaccagacattattagagaaattacaggtggttactggtcagtggatttgttggattccagagttgtatagcaaaaatgtctcgctagagcatttgatcttttgttgaattcctatttgatatgtttcaggttgataaggataagtttgtgtggcaagaaaggcaatttaatttgaaagttgatctggctgagattcctgagagggtttctacatattgtgagtctagcattgctgatctcaagaaggatattcagaaactatgtgatgaaaaaaacatgcttattctcaaacttgaagaggcttcaagagaacctggtgcggtagttactattcactttaccaagagtaactttcaaacttgtcttgctaaagcaggtaataaggaattgtttgcacttgtcaggtcggaatcaagttattacaaaatttaaagctttagtgtcatcgataccaagggaaatgggcgcgatgcagagtgaaatgaccaaacacaaggaggcttccttggagttgaattctttgcgagcagaagtccattcactttctcgcattctgtccagaaaggtaaattgcttgttattggcttgcacatatgactcgcaagtgttatggcattgattcgccaatgtgtcaggctgtttattttgttttataggaacgtgataatgaagaagcatcatgcagatctgcccgtgcgggatctgatataacacaacttcaatcagtggtatcttgtttgtttagactcagcttattttttctcttcattaaggtgttttgtttagctattgcaggaatttgtcctcccatgataatttgacatattgaaaccaaaaccctgtagatttctgatctgaagcaaactaataaggagcttaagttgttcgcggatatgtataagcgtgaatccactgattccaggtatttcaattttatatcatatataattctcaacacaacttttttttttggctaagacttgtgatattttgtagagatagatgcatctcacttcttaggacagagtgcagtgtaatgccgtgtttaattgtttacctatcatgtatttaattcattgcacggtcactctactatggccatgacatttcatcactcatcaccagtaacttaagtttatttattttgtgatggaaataacctttttttgtgtgtgtggcagggaaataatggaatccagagatagggaattccttgaatgggctcatgttcatgccctgaaatcatctcttgatgaaagtaagctagagcagcgtgttaaggctgccaatgaagctgaagcaatcacacagcagaggctagcaactgcagaagctgagattgctgaatcagggcagaagcttgggacttctagaaagtacagaattatgcttctgaacattgtttctcttagaactgttgaagtaggggtcacttctcttttagggttactaaaggaaattgatgcttactgctgaatgttcactgtgttcagggatctagtcagtttatcccatatgctgaagtctaaacaggaagaatgtgaagcttacagagtggaggtcgaggtgtgtgccatcttttatgcatgcagttcaagtatggctttaaacatatattaaacattgtcatcctgagtttgaaacttttactaacctattccagtgtatcgggcaagcatatgaggacatacaggcacaaaaccaacaattgctacagcagattattgaaagagatgatgataataccaaggtagtgactcaatgatttctttaaagctattatctcagataatcctctcccaagcttatagttttataagagttcccatttaccactgtaccaaatctggttgcacaaatagctttcatgtttctgatatattcataggatgttagatttggttatattgttaatttgattgttccggagactcagtacttcattgaaaagctgtttacttgcgttaagttggtgatgcggaatttcataaaataggccaaagttccaaacccttgtggacagcaactactggttgccaaaaaaaaatccttgtggattcctggatgagtattgcctgccctttatttagatatctttttgaaaagaaagttagaacatttttctaaatgaccatcaacagttttttttttgggtaaatggtgttgtttcaaggtcaaagaaccagagaaaatcaggacgactgcgccttttaatagtagagataaattgaaaatttttagccgtgctatttgtaccatagctccttactctttggagtgcccttgataatccaggcagcctatccaagggtcctgaactcctgataaatctacagttccagtgattgtgtatgttttgatccaaaattttagtttgatgttttattgaaattttactgatagtaaagcttgtttacttcggatgtattgaataagaaatgtgctaactctgcatttggtatttcaatcccattgaggaatggaagctttaggatgaatcaatctggtagtaaactattttttcagtagtcgtaacatttttgtttggtgaaatctacactgcagatttttatggagggtgttaaagcaaaacagacacaagatgctttgcatttggaaacatattctttgcgcagaaacttgcagcaggaaagctctttgatggatctgtacaaccagaaaattgtttccttagaagatcaggtaggttgaacgcaaatattgtataatccaatacaatccttccaggaggtgctgaatattattttcccctgattcccagcttaaaatgtggtctgatcgggttgggaaacttcaagaggatggatggcaacaatctgtttcattgagtaattaccaaagaaagctggttgatgtgcacagagatgctcaaaagcttatgcaatcattggatggaatacaagcgaatgttggaagcagtcgtttggaagtcgctgatctgcttatagaacttgagaaagagaggtgctctataagaatattttacatttctatgggctaattttttccaatagctgatctaacgagatgagttacattccaggtttagtaagaagagaatagaggatgatttggaggttatgtcaaggaaagctagctctcttagagccaaggcacgtgaatcagcagtcctggaaaagcttcgtcatgaggtcaaggagtatagggggatattgaagtgtggtatctgccatgataggcagaaggaggtaaatgatcttgatttcgttctttgacactcttgacaatataacctgtccttttaacaatataacctgtcaaaagacactttaacagtgagcaatcaacattggatattcagatctaatatattccaattgcaggttgtgattaccaagtgctaccatctcttctgcaatcagtgcatacagaagtcccttgggaaccgacagaggagatgtccttcatgtagcttgagttttggggctaatgacgtgaaacctatctacatatgaggttgttaatttcaagatggtatcgcaggcatctagatcaagctactttgatggtcattacttggtcatatggttagatgaccatgcgagttgaagatatgacaagtactagcttgtacaaccaaacatataagcagaatgtagtagcctaatttggttggctacatggaattgcaggtgtctggcattcgtgatgctaatgtttattcctgctcccttgtatagttcgggattctcctggagtagttaagtcgctagattagtctgacttttgctatatccattctgttcttttggggaaaaaacatccaacaaaaggggtggtgcttcccgccatactgaaacattgtaccatatatagcttgtagttccattgttgtagcagacaataagaatgtaggtcttacgggttttccagattgtacatttcaggagattggcaatagcgaaatttcagttggatgcagtttgtttggtcttacctgaacggctgagtacctgaattttagtttttgttttggggctattaagctaaacctatgctgattgtttggttcgttgtacgcttaaaccttgatatgtcctctttttggcaggcgtgactgttaagcacaaagcgcacacccagaaatgaatcagctgtcagtgcgaaatcccatttgtgcactcaattttcaacctttcacttaaagtttgacatttgcgaaatcccatttgtctgggataggaacgctttacggtcccccaattccattggtgattgcattcaattgtagagctgcgtaatctccaccagctcttttccaacatctcctatcctctaacctttgcgacatgtgatgtgatacatccattttgtcttttgatgtatagtagcttctgacttttggcaacgtgacgctccgcatgtatgaaagctgacactgatcaccaagctcgcggacgatgcttagctttatccgtggagacaggttggtagagatggcagaagcatcctcttcttttccctacctatcgccgttctcttctttctttcatgggtgacgctctctccccatcgactctcatgtggcatgttgttgaatactagtaccccgtagttggttagcaatctgccttcgctgattcatctgataacaagctgaaacgagtagtcgttacggagaacggacgctcaagtgaagggtcacgtcgtgaaagttgcctcaatccggaagctaggcatcactcgcatttgacgctttgaggcctccacttctggaaatgcaagtgtccccctcctggttccctttttgggctccattccttgtggaaaagttgatgaatgtgtgtacctgtaacatgtgttcaggtcaatactgttctctgcgccttctacgacgtacagctagtcagcacctggagggttccactcagtcgcattgcattgtaatcatgtaaagccggggcgagtcctgactgcactcgatcaatcatcgcatcgtaacaacagagacatacccaaattgagcatttgactcgtggatagtgccatagtggcatacccccttcctgaagttgaacaaacaagggggcatcatccggcatgtggtttgtccttccagaacgttggagcagaggcagaggcgcagagcatttgctttgcagtttgcacagttccgtcgtccacgagacccacgcggtgatgagacgccctcgtcctcgtgcccgaaggctgtagtgcgggctggcaccttgcctcaccttcacctacccacctggtccttcaccggaacgaaatcacaaggagagggactgagggagtcccggaaaacggcgaagaagaacccagccgcgtgccgcgcgtgatgagccacgtctcgctcacgcccgcccgcggactcaaccgcgagctgattgcgtaaggtgacgcgcgccagcagttagccgggagcggatccgtggcaaattaggacgcgtgggttgttggtctgatgactctggcttcgtcggtaccccgcgggcgggcgatacggtgcacgcgcatgcgtgcaccaggccgctcgtggagaagggggatcgcacggcggatttcgcgtgcggcagcttgctcgggccgtggcaggaagccgagaaccgatcgtgcgctcgggctcgtacgcggcggcgcacatgtttctcccaccggcacactgggtccgacaacgaaggtacgcagtaggacatgggagggatcgttccggttccgggcgggcacatggctaggcgtaccgcgcgccacatatgcttcagcccgaccggatggaccgtctcgctcctctctagtgaactgcttgccttttacatctttcacaggctctctcattgccacggtataaattagtggggcgctttaacatggcggttaaggctctgtttctttcagtttgggattattataatctaaattattgagtaatctagattgttataatctgtagtaaaataagcggttagttgtttcttttctagattattagagcctagattattgggtttgcaagtctaaatagggagtggggtggtatggtgggtaatttttcatccaatattctggaaaaagctcacctaaatgaggttatcagattataataagttgggctacagattataataagctacttcaataagttgtctatttctttcagcttactcctaataatctggattataataatcccaaactaaaaaaacagggcctaattctcgatcatctgagttagtgagttacctcaggaattatatggctgcatagggaatttgcagtactactcagagagaaggcacattaaccggcatttccaattaagttccaacacatgagaaaaatgtggcagcgcgaatatgcggcagcagtgtccggtgtccgtacacgaacccagaccatagtaacgtcgttttgctgcttggaatgtggggttcaggaccacaaagctatagcacacgtagtaacgtctgtatggtccaggccctgaaccaagggatccgcccgagatccatcgcccttgcttgccccgggcatccgagacagcatcatacgggagtacatgacaacgtgttaatccattgtaccgccacatgacaacaccggtagccccagtttaaaccccacaccgatgggaatacgacagcttttaattacgcaccgcactctcactgcctgatatacttctgtggtgtatcgtgtgttctttatttgcttgctattgctgaaccgtcggttcctgtctaaggttttccaatttattttaatcttttgtggtgttatttgtgtcccctgcttttcatgttgtttatgcggatctagagattttttttcatatgtatacagtcatatgtctgaatgtccccacgtaaattgcttgtgctgatgtgcatgtatgaccacctctatatatgcgtgggtttatctatacacgttcaagtgaaaaggattgacaaagagtgaaaagagcaaaaaggcaggtaaaaagtagtactacatactattcgtacatagtagtaagatttttctttatcgtgagcaaggattcggattacccctctaatcttagcttagctgtctgtgatcatgcctacttggaatcgccagacgaaacccgcgggccgcggcaagtgtcgacagtcgaagcaggaatggacttcatatccctcacatcatctaccctagtacgtactactactggtactttcaaatcttttcacgcgaagtttcatatcgcctccctttctcttttgctcttttgcaagagcgtataatccagcgtacaacgtcatggatgaaccccgaccattggccgatcgggcaaatctcatggtgtctaatccctgcacgcgcctttgctccacgcccagttgtccactgtcccttttaattattcaccatgtcttctctaaatagtcgctgcccatcaaatcctccggtgggtaagacgttcctgtcagtctctggagctagctaacagcagctgcggctgtgttaggtcgatcgatcgatgcaacacgtgcacgggcgccacgcaaatctccttccaaacaagccagtcacgctgattagcggatggctaagctgtgtgtgttggtgccagatggtaataataacaagtggccactctgcagacgcatttccctgtctcttaaagctgggtgtcgatatgctcttgatcggtaaaaaggacaacgtatcttaccgtgatggagatagacggcctaactgtcccccatctccgtcgtttcttccattccggcgctgtacttttatcaaattaccattagctatcaccatttgtctacgtgcgtgcacagtatctcgcgtgacttctacgactcttatgttcggtctgatactctgatgagtgatgagaataaaccaactgctcatggtagcagttgccgccctcgcattgcatgcatgcacacatatgatccgtgcgtgcgtgcatggcatgacaaaaaagtatagcacaccgcgtctgcatgctaatggagacgttgatgagttgctcggtcgatcgatggcgacctgctgcatgcggacgtatgtatctggatcctagtaaaaaaatattctacgtgccgccgaacacctgtcctgctaatcacaacgatttcttaatttaatttcacttctttagcctggccacttgtaaacctatctgccctgtctcagttaaaaggatcaacgccctcggataacatacttatatggaggcctgcaaacctcaaccggtgtcgttttacatacttatacgtataattgtacgcgactaaacgggagtaggcatcatggatcagctggactccatgcgtagataagccggcaattagaatcgtcaatgttattaggactagtactagtgtcatttttttttaaagacgcactatccattaattgctatctgaaagacacagttttctttttaaaattttgaataagaatgtactagttcgtctataaacttgtggttgctaatgggaggtctcatgtggccaactttagtttggaaattctaaatcaattcatgatgacttgatttgtgcagactgaagcagattgggtgcagggtactgtagatatactgcaagtcccagtcctccaactgtacgtacacactgcatgtcaagatttcggcgatcgacgatcggttcatccccgacatgacgcgcatgaaatttgtgggaattgatttggacgtgatgcaaaatcaacgtcggggacaacgacggcatcggaaaggaggcccgcgatattcttctctacacgagcaccgctttcacgtagaatttcttggccaaaagctggtgtcgatcgaaggctcgatcgctgcatgctagctaagatctcgtcgcgtcgctctcagggtgccgatccgatattcaattccagtggttggttgccgatggccatcagcgtgacaggcacccccgtgaaacctcctccactggagacaaaattatattcaggtgatggcgaatttggcgtcgacatggcaacagcacaagggagaccagtgcgtttttcagttgcttctttttaaccagttgggctttctgcattgtttctgcgaacgagcacgtcatattgatcgactaatagtagtttatattgcacgaagttagataaaaagagaggccacgccattactgtggaattacagcgagaggtgtcctaattggcacgataatgatgccaccaaaaggtaccatatatctctgttagaaaaagtactaatactatatctttggcaggttaagcgttagtagtacgactttaggcaatgtgtatatgtggacagttcatattcagatacagaatactgttcgaaccaggcatgcaccagccgttaccaattacacaaacaggggcaggattggaaggagaatacttggagagaacgaacggttttaagaagataatgatttgtgttccagggattaaatacacaagtttaggtaggataaacagaaactaaacagaagtcaatggtttttttaagcttttgttaaattttcttctttattattcaattgctcaagctacttacccagggctggttgactcgatgcaaatgcttgtctagttgtcttgcaaaaaaatatcagggttagttggacaggaatcattcgatttgatttactcctccctttgattcctactacctctgtcttaaattagcagtcgctttaacttttttcttgtaatatttgatcattcatcttatttgaaaaattagtataactataaaaacagagaagatatacttaaaatacttttgataataaagcaaatcacaaacaaaataaataataattctataattttttatataagacgaaagattaaaagttataaacaaaaactcaatgacaagtattctggaacgtagtcagtagctgccttttcccaccatcaccaatctgatgaccaacgcaatctgatgaccaagagagcatcaggccattctagtgcatcacatttggcatcagaacagaaacacgagtcaaagaccaaacagcattatacgtatgcggcagcatatgttcttgttttcgaaatccaaccaaaccttactacagtactcttatcaaaaagagtgaattacgctttggaccacattttattacctaagttttactttgaaccacccttaaacatatcttttcattttagaccgaataaatttgctattgttacgatttggaccaccacgaacaatttttttaagtacaattaatgacgttaaacacattagctctagtatacggccgaacttctctatgtgtggttcatatgtttgccgaaagggaagttagacatgacgagaaaagttgttcataatagtccaaaccgtaacaatggtaaatttacccggtctaaatttaaaaaatatatttaagggtggtctaaattaaaacttgggtaataaaaggtgaaccaaaagtacaatttactctatcaaaattaaaaaccgcaccgtgatgtgcaaatggggggagggggggtcgaggaaacttgaaacgcgccaggaggagaacgcggcggggggcggtgcggattgaccaccggacacgcggcggggagcgcacaccgatgcgtggacgcgcgctagctgccgcctgcgcgatacaccgatgcgtggacgcgcgctagctgccgcctgcgtctgccgcctgcgccccccatcgcgcaggcgacagcagcctttcgcaccccccgcgtgtcgatgaaactccatcaattctccgtacactagcgatcgggcgacgtcgcggcctctctctggccatccgtgtcgctagccagccgcggccgggccgcccaacccagcttttcacaatccctgtggtgcgtcgggcgcatgcctgctgtacggaagaagagcacggcgacgcgctgctgctgttgctcatgctctttagcgccaggcagcgttgctcatgctctttagcgccaggcaattttcattttgaccgagcaacgccaaactcaaactactactcttttcgttccaaaatataaacatttttaacacagtgacaaattaaatatttttaactttgaccactaataacaaaaaaaaataaaaaatcaatcatataaaattgatgttactagatattatttaaaacatctaataacatcaattttatatttataaatattgttggttaaaatagtatctcggagatcatgtaagagtttaagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacattgtcaaattcatgacataattagactcaaaagattcgtctcgtgaattagtccaaggatatggaatgtgttttgtaattagtgtatgtttaatactctaaattactgtccaaacatccgatatgacatggacttggaataagtctctggaaaccaaacaggccctaaaaatatttatattttgtgacggacggagcagtagtactaccgtggagtacgagtactctacttctactgcctccgtatggtccaacgacctcgcttcagtacgggatgctactagcctagattacgagctactactaggcggcacataagtgtaacacaccctccaatctccgtgagtgctttgacttttcttttgttggtgaaactgcaatcaatcatatccatgcctatgccatggccataccaccaataatcaggcacaagcaagcacaaagatttggttcgtagtgtcccccgcgtatgccaactacacgctcatcctgatccgaaaccgaaacatagtcagtactagaagtatgaaaggggttgcatctagaagaagatgcactttatgcatgcattcctactacttctactgctacactgtttagttctttagctattgtagcatcacattatcaaattataacgtaattagacttaaaaaattcgtctcgtaatttacatgcaaattgcgtaattgatttttttttcatatttaataaatcatacatatgtctaaacatttaatgtctaaacatttaattttatatttttaaccaaaattttttggatccaaccaagacctgcctaatgtacaccagccaggcaacaaacgggctgctgctagtatgctccatcctccaattctactcgtaccgtcaaaagacccagctcccaagagctgagagacttgaaggggatgcccctagacagtgacaagatgaagccaacagctcctcctctctctctctctctctctctctctcttcagtcctcacagcagatgcgcagctgtgtcccatggcgagcaagagagagcgccgtactgccgtcagcgtgcgtgacagtgcctccagattggtggtacgactcgccagcctgtaccccaagcatctggtctcgccagttggacctcattaccacgaacttgccatgggatgggacacctggctcccccccggcctgaacggctgaacctggtcgccgcacgcagggatcgtaaacacccttctcgccgtattaacaaaccggttcgcgatctaacaacggagaggccgagaccgtatgcacgttggggaggagacgaaaaaagggacgggaaaagattagcccgtcgctgcacgtaacgtgtccgatactccaaggaaattggcagtggcagcacaacacacaccatatggccccgatcgatcagtctttttttttttttgagttgccccgatcgatcagtcattcagcgatggatggcatgcacgacgacggtctttattctccgcgaccttttttcatgtggttttctcatcactgttgcttgaggagcagagcagtagagaagcatcaatccatgttggtctgcgtctctgtgccttgtcgtcgtgccgccatgctcgacagaatcttccttttccatgccaatgcgagccaaatcaagagctcctgctaatgcacggacagttggatactcattgcaagtggttgcacggatcgatcgacgtaggtgtgccgccgtgattttagacgtattctccgagcacgtatctccagttctccactggctagttatggcgggaatgcatgtatgcagtactctgattgattctggaacgtactacgactagtatttctatagtactatactaatagtgatacaatccgtatacttaaccccaatatagattgaaattggacagcggagacttgtgcttaactcaagtgtcgtttccgacgaggatccgacacctgcctgaccgcggaatttataaaagcatagcaggagtattgatcaccacgaaaatcgacaggcttacgtgcacaacgtcgatttgggcaaaggatttggggatcgcagaaaccgcgattcccccatgaatgcgcccccactgcaaagctatgagtattcaatttgtgcctcagaccatcggcaacgacgagtcagccggacctaaaggaaaattgttcacgcaatccatccacaaggaccgagttaaaagcagggtgggtgcagtgggagtaggactaactggtatagtacgagagtaggagtactcgttaagatgttaaccccgggacaagttgttggtaggcaaactagcggccaggttaggctagttaacccagcggatcaagccaagccatccgtctaatccgagccagccttcccccacaaggatcaaatcgttcgcgcgccggcacatggtctcttgcacgaaagacaatcatcgggccggcagcgcggactggtcacgcaccgtctcgcaggcttctcgagcggccgcattggcgtcttccggagctcgcccatcacccacgcgcacgcacacgttcctccaggctgacgcggcgcggacaggcgagccgccgtggccgcgagcgacgacgtacgtacggcgggcgaagcgtggcccgggctgtgcgacgacgagacggcattaactttggcgtagccgggaagccgctgtctttacgcggaaaccgtcgctttcggggcctttatgcgctcccgctcactgccgcgccacacgtcgccatcgcggcgcagctctgaaggcagtgtgcagtgcagtcgtgcaggtccaggacgacgacgagcgggaggagtcaatcgattaatcgctagcgcgtctcttctcttttcttgtttttttgttgttgttgttgttgtgctgtggttaaggtggagctggaaggctgggacgattttgaatggcgtggacgaatcttaccgtggcttccaaggccggtgacgagctgctaaaacaccggaaaggtgcaaatcggatgcgtcatgcgtgaatatcacactgtccatttggcccaaatcttgctggatcactttttaccactaaacaaaacaagctagaaaagggatagtcgaagataagatgcttgttaattatacatattcttgtcccccaaatcaagcaaggcgaggaaaaggaactgactttatacaacctcgcatgctagatttggcaaagaaaagaagaaaaaatggaaggaaaaaaaacaaaatacaaagggagaaaagaagaaagagaacagagcagaagcagagtaaagaagaagaaaagaagcaccgccatgtacaagccactgatcgatctaatacacggaagcatgactggctcccatgagcagccacattgatcagtaatcccacagcatgggctcctcgaggcggaacacgacgccgccggccacgtcgtcatcgacggcccacgacgccccgcacgagaggctcgaggacgtctcgtatctcagtccaggagcaggtccgggaggtcgaacagcgtgctgtcagggtccgcttcggcgtccggcggtggcggctgcggcgagccggcgctggcgacggagcaggtgtcggggctcttggcattggcgtcgacggagacggaggggaagtcggctgcggcgccggcaagcagcgcccccgcctgcacgtccttgggcgccgcggtggccgggcgcgggagcaggtgcgcgaggtccgggaagttgaggtgcgcggtgcggcccttgatggcgagcgcggccacgtcgtgcgcgcgcgcggcccatctccgcggtggcgaacgtgcccagccagatgcgcgacttcttgcggggctccctgatctcggacacccacttcccccagctccgcatgcgcacgccgcggtacgtcgggtgccggccgtcgttgcgcggccgcttcttcggggcgacggtggcggaggacgatgatgtcgacgtagacgaagacgacgaggaccccgtgtcaggggaggtcggggaggccaggtcgtgggagtcgtccatggctgccccggtggtgcgggtgtggactggagtagttgaaggcttggaggggagcggagtggagagggcaatggggttttatggtgtggcgcagtgacgacgtggcacgggaagataaacaaagggccatacctggtttgtgggccaggcctctttttcctgttttttttttcaattttctgtttgagatgattagtagtagtatgacacggctggaattaattttcttctactccctccgttccacaatataagagattttgagttttttattacaacgtttgaccacttattttatttaatttttttttgccaacataaaaaacgaaaagttgtgtttaaaatactatagataataaagtaagtcacaaataaaataaataataatttcaaaaaattttaaataagacgagtgttcaaacgttgcaagcaaaatcttataatcccttatattatggaacggagggagtatataagttcaatgcaaccgatctacccgtgttaatcaggtttatggcatccaggtcagtgtggaatggattttttttcggccaaaaagtgtgaaatggatttattgcattgtgcacagcaatgtggtgcaaagatatttggaaacgtggaggcaagtgttatctctaaactgagatttactattttgtcatggttcaattacctggatatcacatatttaaattctaagctagacagaatatgctttcaccctgtcattttcctgagtaaggggacccaagttcaaatattctttcgtgggccatttatgtgtatatatgttgaggactcgagaaaatcgtcatgactatcatatttcttttgtagtttaatgcttcccaacaaattaaaacatgttcaagaaacgtttttttgttggtttccaccaaacaccaaatttgcaaaagagaacaaaaatactactactcattttcatcttataagtcattttaacatctttcttaatcaaacttaaccaagtttgattaagtttatagaaaaatagtaacatctaaaatatcaaattagtttcactcaatctagcattgtatatgtttttgtaatttgtttgttttgtgttaaaagtactactatagtttttttataaattgtgtgttaaatctagaccgtgctatgtctaaattcgtagttataaacgtcatgatttaaaactccagcagatacatgcatgtacgactctataatcacataaatgacaaatccacataactcagttttagcattataatgcagattttccgcagggacacgcgaaaatttcatttagttgagcaattctaggtgaggatccttggtggaaacaagccctatggtagttcgtgtttttttttttgtcaagatatcctataacctgtcccagatgggaaactaacaaaactggttgttggtagatcactgctatataaacaattttttttacgagaaccatacaatttgcaggcggatagtaagttagtaaccaatagcctctacaaaagttgacctgcattttcgcgtacggtttgttaagagacccgtataaaaaacagttttctcaagtgggtctcttaacagagccacatcgaaaataagcttattt

SEQ ID NO: 33333 - DNA, 9585 bp, Oryza sativa
ttttactaaggcctagttctatttctcaactacaatcttcaacttcctcattttccgttagcacgcttttcaaactactccatccgtcccaaaatataaacatttttagctatgaatctggacaactgtgtgtctagattcatagccaaaagtggctatattttgggacggaggtagtattaaataatgcatttttttaaaaaaaattatatatagaatatatttaaaaattcatataaattcattttaagtttataattattaatacttatggcatgtttagatcccaccccaaaattttacaccctattacatcgaacgtttaaccacctgcatgaagtattatatataggcttaaaaaaactaattgcacatattgcgactattttgcgagacgaatcttttaaacctaattgctccatgatttgacaatgtggtgctacattaagcatttgctaatgacggattaattaggcttaataaattcattctcgcggtatactgacggattctgtaattatttttttattagtgcccaaacatcccatgtgacaccctatataatatccgatgtgagacgccaaaactttacacccctgaatctaaacaccccttaattaatcacgtgctaatgggatttctcgttttgtgtgggtcaaaaatatctctcaaaacaaagagatcgaacgcagcctaagcctcaatccgtatctcctcaacttctctcccacctctcattcccctaatccctccccactcattttctctctccccacacattttctctccgtttcttctcctggccggcctctctaccaacctctcctcaacctcctcctcctcctctctctctctctctccccaacctcccctcggtggcatcggcagccccaagcggcagtgtgtcgatagcatgggtcgtagccatcccgtcgccacagctggatccggtggcgtgcggcagccgtcctgtcgccaccgctggatccggtggtggtggccctccccgcacagccccgtgcggatccggtggacaacataagcacccgtacatgaaaatcggattctcgcacgcaggtgagtcatccgcatgaaaaaatagtgatttttttagatattttcgaacagacgtgtggatcaaccgcacatataaataggttttacctgtttggaaacatacttttttaagtagtggatgttgataagctatgcgtatctacagagtcctgtattttatttattttttaaatatgggaagctaactatgagcaacttcattgaagaagtataagactgtttcacctactaataatagaaggaagctacagctggacgtttttcgtatactcttccaatatagcattgtgttctctctaaattgtaagaggttgagacgtggttttttcttatatttcgtgatggagatagtagtagattattacggatgacctcagttgtagtatggtgctaacaagaatacggtgggcttattatgattagattgagtcaaggactgctaaacaaggcccccgtctgcagtgccttactgccttgagccttcttaatttccaccatagaacctacgtatacgcacatcgaagcgtggcgatcgataccccaaggaagaacatatcgtcggacaaggcgaagtccatggcgccgccggatccccacccaagtttttacacgggcgccgccaatccgttcaggccatgccgtgcgttgatcgatcgatcatggatgcacgcgccggcggtcgaagccaccacgcttcgtcgaccgtggccggcccgctgctttggacttggacgcagagttgagttgccttgcctgggcatggcgcgggccgtgtcgtgtcgcaagccggccgcgactttccacgctcgtgggcctgtgaaagtggggacggtgtgggctcaaccacgcaccgctccgcgcatcacgcaaagtcgcaaaacacagcttcccgtaaaactacttcgggcgacttttggttgacctgctacaaaaaaaaaaaaatcctgctccttccaccgatggcctggttacagatttcagcctttcaggtgtagaatcgcatagaaacgaaagtgagatggaacgagatgctccgcgtagaacggacaagtcactcgacgatgagatggcacgcgacgcgagcgcccccgcggtctcacaggcagcaacgcaccaactctcggctctcgcacactctcctcctccgtaatccgtatctatgctgattgatgcagaaatagctaagctacaagttacaaccaccacatactgcaggttgcataatcgtcaaacagtacatatattcctacactgttgccgtaccatgattgggcgagtccgcattctgttggactgctgcgagcgcgagcacgcgacgagtatcacagtgacacgggaacgtcgaaacggccccgcccataacgctatcatttaagaacaaacgtacgcttccaatctccatgtctcctcattcccgcgtcctgtatatgaccatgtactactgtactattctcctctctgctcttcacacgctgtaattctaccggccatatgagacataagaggaggcgtaccactgatcaatcgaacactgcttccgtttggttatgataattaattagggtgagtttgaggaataggggattgagaagattaggaaaatatgaaaaatgaggtgagccattagcatgtgattaattgagtattaactattttaaattgtaaaaatggattaatatgattttttaaagcaattttcctatagaatttttttgcaaaaaacacaccgtttaatagtttaaaaagtgtgcgcgtggaaaacgatatgctatctcactcattgtctatggaactaacgcacccttagagcaagtataatagtgagctataagcttactgtaaacttatgtggaggagagaggtaacaaaaaatcaaaggggttggctctcatgcaagagctagcttaacacaatctccaagacaaatacattaaatgtataagtgagagataaagagaggagaagaaaattatagccaaccttatagctaatattattatatatgttggctttaagatgaggtgagctatactattatccttgctcggatgggggagatgggaacccaactcctgcgcacggaaaacagaatagtccattaacgcgtgattaattaagtattagctaatttattttaaaaaaaatggattaatttgatttttttaagcaactttcgtatacaaactttttttaaaaaatacaccgtttaatagtttgaaaagcgtgcgcgtggaaaaacgagagagaggggacgggaaaaaggtgcatgcgaacacagcattagttaacctgtcgccgatgatgatgtaacatgtgtgctacaggtagccgtgtgtcctctgcaaacgtactgactaccctcgctaggctccggcttgtgcattacacgctgtgatgactgatgagtaacccgtctgcaacgatcgtcgctttaccagctgtatctaaccgttcatcccatacgtctgtttctaggattcttgcaaggaacattgttgggtagcccagcaattaatgatggtaccatgtacttggagtagttttgatttaaccccgtgtctcaaagcttcaaaaggaatagcaaggccaccatcttctaactcgagtacatgtgtaaatagcttcctcttttggtttgtcgagagcaggattttctcagcatgtcgacggtaaacccagcattttcaatcacgaaaacttatagctgtgtttaagaagggacgaagggagtactttgtagcagatgatcatataacagtatagtatgaaaggaagagacatacaagaccatgaaaatgtttcggaaacacatcaaacaatagcgtaattatggcaacactgaggtcgaggagtggaagatggagattggaaagggaggtataaggttgtgggcatgtgtcgacataacataactcgacaaatacccgctaaagtctatgagctctcacttcatggtatgtggagacccacagcctcatcttttcgcttatgcttatcaactaaaaattgaattttcaactttaaatataaagttgatttcggtgttttttatcgaagtttatttttcaacatttacgtttatatagttaagaacatatatataaaaattttattcataaattattttttgtttgtaaatatatcgtttggcttattccccgaataagcgtaacgagggatccctagccaaaaattgaaaaacgaaaacgacgaagatcatctctcatctagaacttggacatgaagtaataaagggagagtagttttaggtcttaaagaaggtattggatgtatcttaattttaggaggaaactccaaattagacatccgattttctgtaaaaaaaaaacggacggtcaaatatttcagttgaccacccgtgaaacattaaagagagaatccattatatgccactgactttgttacacctctacgatttaccactggctttgtcacgttctataatatgccatcgactcttgcttaacttctacgatttaccatcaccgtctggttagcctccgttagcattgtacaattttgtccaaataaccaaaatacccctaggacaaagacttccaaaaattggataaaattatcaaaatatcatattataaatataagattgtaaacatccaaaatttggccaaaaatttaaaatttgatattttagaatttgtatccgaattttgaaagtttttgtctcaggggtattttggtcattttgacaaatttgtacagtactaacggagactaaccggacggcgatagtaaatcgtagaagttaaataaaagtcgatggcatattgtagaacgtgacaaagtcagtggcatataatggattctctcaacattaaattatacacgatgaaaaaaatagtcatttaaacatttttatttttttaaaacacaacaaagatatacattgaaagatgtcgcaattatgtattcaacttcgagcgttaacggattgaaacatacggttttttttcatcaaaatataataatgcaacatctatttataaatatttaattacaacaaataaatagtgtgagtagatcgtagattgaataagtagtttataagaaaaaaatatttaaagaaaggagaagagaataagagaagaagaagagaaactagctagctgcacatgcgtgtaggggagtgttagggggttcgatttgtttctcaatcgggcgcccgagggtgagaaatctccaaatttttaatgtttacttatggtacattttgtcacttgacatactcccttcgtcctaataaaaatgaatctagtactggatgtgacacattctagtacaacaaatctggatagaggtatgtctagatttatagtactaggatatgtcatatcatctaaaagttactatattttaaaatggaggaagtattttaagagctgaggtagattataaaaggatctatggactctggcccattaccacccttaccccgggtcccttgcctcttgagtattgatacccaagtctctgcaaaggtagagctactgtttttaaagatcaagaatcgtagaaaatctttttgcatgacgtgcgtgtgtaactagtttatactcccaatgaatctaggcgctacatcaactttattagaatattatagtactctgtaaaattacttgtaagaatcttaatgtacggaaattgtatatgcttagaaaaaaattatttaggggacaaggggcgaatatataatggcgtgttagagcataaaacttgttaaggatcattaattctggtagctccccacaggcccacacagaacatactccagcagggaaggacaagaggttggcagattaaactaacggaaaacagagaagctacacaaattggcttgtcttattttgtggcctttactgtccagcacttaattatagcttctattctcgttgtaaactaaacacccagttgatcttgatggttctcaaataaggaaatgggcacaaaatcttgagatctcttggaaagatatgctgtggtatttcttcccttccaatcaaaaaataggcacctaattaaactacttatacatattatactttacgttgtaccacttgtcatgcataaactacattttctttataattgcataaactacatactccctgcattcctttttacttatcatcttttctcaaaacaaattataaatattgaaaaagatgatgtattatcgaagtaatttgcatgctaaatatgattattatactatttgtgttcaccaaaacatcataatttaaaagtttttactggtcaaagataaatttacactggtcaatagtgtcaaataaaaagaatggagggagtatacaaaataaatacttgcatatccacatattattcatatataggccttcaaagaccgaaacgtgattattatctggcttcagcctgtaatgcagggatatttgctgaatccagatcgaagaagaagtttgtccagaatttaaaccaaatcgtactagtaatatgcccgtgctaaacgctacggtgcaattcgatttatctttaataattgttaaaatttcatgttagcggaaatttttttctatgatatgtgcatttgaactttaattcaattcatgtcgtacattaaatatatttattttacgtaaaatataataatatgatactgcatgggcacaataaatctttacaagaattaagtatatataatcacttcagtatatagtacgctattatgttacaaaagtgagttattttattatttgttgcggaaacaaaataaagcattatttgcgatctggaggaggtgcgggagagaggctgcagtggttggcgatttgacggaggggaaaggaaaccgagtggtgaccgcgtgcgcgattatttgtgatccctaatacattgcaggggaaatctgttatgtgctgcctactcaaaggcagaattttctaagccaatctcattgtcatccaaagtactactgtcaatgaactgacaaaagaattgatgaaccaaagcagtgacatacttctagacaaacaacttgggcgaactgagagagctcccatggttataacatatggaaactgatcctacaataaagaaaataatttacactgtaatataagaaaacaacttttctgctacttgaggtttagaaactgaacttgaggtgatgtgtttagaaactgaacttgaaaccatggttctggtttgatccacctgaacatctcatggttatccataagtacaaggcaaatatgagtagatggctaattcgctatggagcaaaataatactgaaagactggaggtggaggttaccttctgttgtttttatgtaatgaaatatgtgacacagaagatctcaagaaaagtttctatgtacggataagggctatggcttataaacatgttcatgttttttttccggtttgcaaattggtattctaacctggaccagaaacctaccatgagttttaatattaacataattgttttgcattggaataatgaatgttatgcaaacattatgcagtctcctgaaatgaatcatccgataataccaaagtaaatgaagcagcaccgcatttatagagaaaaaaaatgttttccctaagtagtcctacacttccagttgtaagaaggattcaaacttcagaaaaatcacccttccatttgtattcatgctttaaaattgtaaaattttatcttatattcttttctttttaccaatgctttcatacacttcggggacagacggcggagatgagacgaacatgggtagatgcatggcaacctacggagcggcgacagttagggttgggagatgccgcagcgatgtggtggtggcggtgcgtgtggcagtgccggttggtagtggccacggaggagatcggcgtggtgtcactggtgttgtcctcgactgtcggtggcggcatggagatgtcgagggtgggctttggcggcgccggtgtggccccccgaggtggaggttgccggatgttgtatcaataatccctaatcctatacagcaaaataagaaaatcaggaggaagattacggtggtgcaatgtttcatgaagcttattgcactttgcttaaaaatgaaccatcttggtacataattagccaaaagcttactgaagtcataagttcatcttgaccaaatctgtcaagaatcaagaaacagttggattgtcctaacatatgcatggtgatggtgatttcattaatcaaggaatgaatctctactatactgataattgacatagatggtgcatcatcttaaatattctgtcactgccagtgaaaatcgaattttaaggtttgatttctgaaatgtgtaaaatcttaaatacccagatactatatattgttctttggagatgtttagacatgtgcagacagttatgcgttgttcatagacatggatactttagttatcattatctaaaaacatgaattctttagataccaaaacgatgctttcggttttctttcttttgattgattctggattatattaagaaccgtatgatcaaatcagcggcgactgatggggagagaggaaatatatataatactggattgtggattaaaaaaaggagagaaggatgatttctgtaccttaatttcggcgaatcagatcgaggatggggcgacactgttctgaaagcagagatcggtggttgcacggagacggtcgacgagccggagattgggggcggcacgaaggagaccggcgacgcgagttcctggtggagatcgggggcggtgcggaggagaccggcgagaagggcgatgaacggcggagtggcgagtagaggagacaactggcggggtgggagggcgggtgcggtgtgcggcgcgcgacggcggagtgggcgatgccgtctggacggcgggtaggggcgcgagcgtcgggagacgacgggggcggcgacgtgcataggcgtgatgggcgagagaactggcggaggagatggatttcgcgatcggaaggaaagtgcgacgatttcgggggtgcaggggtgagggaaggcggatgctattctggacgtcaaatctcttagggataatctggaccgttgagtgacgaatgaaagaatgagtgaaagtatttgttgaactatagggtagatgaggaatgaattaggggagactcatttaattcggactttactcagtacagtaaacaatgtatggcgacaaggatcattaactagcgaagctattcgctgggttaccctttttgacgttgctctgaatctaccttgggtaacaaacgtgtgtgtgtttagttcacattaaaattaaaagtttggttgaaattgaaacaatgtgatgaaaagttgaaagtttgaagaaaaagtttggaactaaactcggcctgtattccattcacttatagcaacatggagagtacctactccctccgttccaaaatataacaattctagcattcaaaatttatctgaatatagcaactttttctacctac

SEQ ID NO: 33334 - DNA, 4467 bp, Oryza sativa
cctgcagcccaattagaacgtacttacatcagactaaccccatgcatgtgtttgtttattctcgcagtcaagttgaagcccaataattggcaaacaaatcgacttatgtgcgcatcaaatcaagcatgttaacccaataatatacccacatgcatgaaagcacagaaggtgccatttccatggcgtcccgcaagccagtacaaaacggcactctagatgccgcctaaacagtaaacaattaactcttaagtctctacagcgacaccgatgtactgatgtactcataataatatgcgtgaattcatggaaaaacttggattgtgcatgctgtcgtcctacgatcccgtatgctccaaactgtcgccaacacacttctggtccctaaagctaattaacctcccaagcacatgtcttttttaagactcacatgccgattctttaatcgacgtaatgaaatcgcgctagaaaccaatggaaaggccataggtaccaggaatattgacccgactcaactaacctcatcgcgagaaatttgtgtgccggccggcgtgtagatttttgtagtttaattaattaggtgatgaggcgggcgctaactattgcatgcatccacatgcatatgggttaccaaccatactaaaaacttttcagccactaactacaccttaccgtctccgatctttgtatgtcatgaccaatctcccggccgggatggtacaacttagtagtataaggctattcccaacctaataactaagatggtgtccatagcattaaataggctgccatctaggatgaaaaatgatgtggcaagtgaataaatgagaaaagagaagaaaaccatgtcttgcatgagacatagtttctacacaatatccaagacatcatgtgaaataagtagcattaaatttaagtatggatagtggtgtttgcattggaagagtagtgtctagtactaatttcttgatgatgtagagtttatgaaaattatgtatagtgttttgggttgggaatggtctaatactccgtattgatgtagggattgctcatgatggttcatataaggtcatacatgtggaaaggagccattgggcaaggaagaaactttaaaggtaaaacggctgaagacaagaagagacagaacggtagttagctcgttaattctagaatatttcttgtgcgttgcatgattgtgtccattgcttcgtttatttatttatttttggggacgtgtaacgtccatagccaaattggaataacaaacttgtgagtatagtgttctggcagtgtggggctcgctagctaagctagtttgtggagagcgagctggcttgattaattatcttaattaagaatagcacgttgttttatgaaattaaacaacacattgtcaaaacggggccaaatgatatgttacaacaaaaccttcaataatataagataattaaaaaacatttgataatatgtcatccttgaggtggtattttcagtttatgagataccaaacaaaatccaatctttcgatagtaaggatgtggtgggtatttcgaatcttccccggcgcaccccctatcaagagtaccacatcatacaacttgtcaccgctcttgtccgcctgcattaggatgccatcaccctttacattctccttagtttgcccgcatccgcaacactgttttggcgttggacggcaagggtgctacgtgctcagattcagtcggtgagcttgtggaaggacctttgcatgaggtggacatcgccaacaagctcaaatgtgcgagattggagggaagagcggagcaggaggtgaagattgtcggcaactccaggttgatctggctggctagcttggaggtacgagcttgtatctcgtaggcgagattgggaaagggtcaagcgggaggacataggttatcgacaaactcagactccagccgatccggtgccacctctccctctggcatggatgatcacgttgcctctccgccccccacgcgtgcgggtccactggccgaggcgatgtgaggggcggatcttgcacccttccctcttctacacagatcccgccacctctccacctcccagcccctccagtgcacaaggatccgtcaatggcggtgacaggaggggtggatcctgtgctcacttcccctttcacgcggatccgccagcctctctacccctaatcactccgccctccacatgcgcgggtccaccggctgcggcgatgtgagaggcggatcaggcacccttccacctcccgcgcggatcccacctcctctccacctcccaacccccttggtgtgcaaggatctgtcggtggtggtgacgggaggggtggatccagtgcccgttcccactctcaggcgaatccgccagcctctccgcccctactcgcgaggatccatgggcagcttcaagcgacttaagtacctgcatgcgaaaacacaatttccacatgcaattgctgtacccgcatacagaaatagtgattttcgcagatacctaggtgcaggtgagccatccatccgcctgcgaaaatcaattttgaccagattagaaattcgtttatgtagtagtatgccttactatggatgtcaatatttgagtgtgaagctatatggtgaactctagcagttgcatgacttattggagtttaagtgtaggccttgggtgggggatggggttgagcatgtggtgaccagtggggccaagaggcaaatagtttttaagagatgaaaggcaattaatggtgatgaatcttaccgttcaaaatagggagccataaattgctgatggtcaggaggttgcgagtcccatcagttagccatatacggaataagccgttttggtttattagggaataaaaattaatttattgataattttttatatacgtgtttttggtaatttaaaaaccaatactgaaaaagaactatatatgttgaatatattttaaagtcaatattaaaattaagcttgaaaattcaaattttagctttatctttagctaattagggcatcccaagggagtcctgcaaaacatgcacatagatggtggatataattgatggctgatgctagctgatgaagtgggttagggttgggtagtaattgattgaaactcttaaatggaaattaaaaagaaaatgtagccccaatttgtttggaagtaagaactttgacagaaaggaggatcaaccagagagatgatactcccttcatctacttttgatagtcatatttcatcttggcacacagtccaaggataggtaattctacttatcatccgtttaaacatgctactagtcattcctcgtaatcaaacaattcattaatatttacatttctcgatgcccatgtagccaatcttgtgtggaagaatggagagtcacgtattaaattcgagaaagtcattaagacgataggttgttggattgaaatatgcttatcaaaaataattttttttagatttagaaatatgactatcaaaagtagattgagggagtatatgatagacactgggtcatcggctaccgggccaaaaattgattggctattaggctgtgtggagaaaatgtaaggccgggcatatatagacaattccaactcaattattccctccatctatttttgatagtcatatttcatcttgatacacagaccaaggataattaattctacttatcatccatttaaacatgctactagtcattcctcgtaaacaaacgattcattaatatttacattttctcgatgctcatgtagccaatcttgtgtggaagaatggagagtcatgcattaaatccgagaaagtcattaagagaatatgttgttgaattgaaatatatctatcaaaaataaattaagaggataggttgttgaattgaaatatgcctatcaaaaatatgtctatcaaaagtagatggagggagtataatatttagtaaaacaatatatatgaattttattgacatgtgacaaaaatcaacatattggtccaatctttaactaatgatgctatcatcgcctcatcggagtggaagagactaagccaagtggtcagtaacactctcaagttgacctagatattgacagaaagcatctaaaataaacatagtccgtgcatgctttgacaaaaatggaaatattgtccatgcatgcatgcattcaccgtgccggcgttgtggtcagtgttcccagagcaccagtggctcaccaaagaagaaatcgtcagcatcgtcatcccacggcgaaccgcaataatacggcggcggcggcggcggcaacgtgaacccgaactctagaagagcatctggcatggtgaaatacgtgtagtctagtccagtgccgccgtcctgctgcagtgtcccgttctcaacgatgcaaaccggcgccgtcgcctgctcaggctccgccggctcgggctcgtcatcggcagcggcgtcgacgtcgtggcatggcgtg

SEQ ID NO: 33335 - DNA, 7720 bp, Oryza sativa
gcttgctagtgatcagtgatcactcgagctactggcgtttcttgctgtttcttgtcactgtaagttggagtgatcaacaagttggctgactagctagctgtcgtctgtggagatgaaagcaatgtgatgcaccatccatgtatatatattgtggctctaagtcaatgtgtggaagacacaacaattaaagtggcactatttcttttcttctcccaaagaaatgtgaatgacatgcaaacggagagagagaaaaaaggtgtaaaatcacgccatgatatgtagcttaaggacgcgtttcttctctgatctgaagatctcaatatactgaagttctgcacaaactatagatttcattattcattgttcccgagctcggcgcatcgattggcttcgtgcaaaatgtgtttctttggacgatcgagcaatgattaaagtagccagaaaatgccaagccacatggcaactccgtacttaggtgttagcctcgtgcaaaatattaaaatgcaaacatatgggaatcgtctatatttcacagatccaaatctttggatctgcgtgcttatattgtgtttcaataattaagtacaaatcaataatgcaaacgggcgaaactaatggaaagggtgtcaaccagcagatgggacagaaaaagcagtgtttgttgggataagaagatgagaagactaaagaacataatgcaaagcaaagctggcaataacccattatttttgtgaagaaaatgcagccatgcagcccatagtaccctttctttccccataattttcaacttaactattgatgaccccgtgtataatgttatctgacagaataatcaaatatatacgaccagagattccagcgcgggaacataaaaaaaacctacggggaggaactcgtggcgttgctttggagaattggggatacaggtgtttcctaagatcacacttaaaactttattaaggattgctaagttgcgaccaaacaccaaaattcgtctggagaaaaagctgggataaaactaatcttcgctatttgagctcacctttcatttggccccatgctagaatatagtgacaagcaatgagtgctttaatttctagtggttcgtaactactggaatggaccagaatgagagtattttatagacttgaggataacttttttttttttggctgagaaggcatgcatcaattcgagaaaacagaaaaattaaggtcaaagcagaacagataactaaacagagatgatgagtgaaaacagcgtgaggatcttcagacttcagtgaaacctgatgatatgaagaattcttctctctctttacctttacgttcaaagcaaatctctattcgttcaaaaaaaaaagcaaatctctgaatcttagttaaatataagtagctagcatcaaccgtagtaggaattcatcgtgttaatttggtcaattaaaagcagatgccacagacggcaactttgcacgaaagcccagatgatcggtttagatgttacctaatgcacaacgcgagtacgactgttgaacaaagaacgaaataagacgagaaagtgcattcaagacgattcatttctttggacggcaatttgaaaccgaaaacacgctatgtttttatacatctaaaaacgagtaaaagccttttcttatactccatatatctatcatcaaacactttagtgaacaagggcgatacgtagctaaatacgggccttgcttcagttctgacttgaccttcctgccctgtcccaaacatttttttcttaagctatgacgacgactagccgtacgtagccatggatgcagagacaataggagacatgacagaaattacataacaaatcaaggaattctagaacacgtatcacaaagtgccagagcaaatgagtatgatgtgcccatatgtagccaagtaaagagtggttagtacgtccatgagctccacggccgaaataaaagagtggttaaaacgtccatttgcttcataacttccatataagtggtctttttcctgaaagaacagcatgatgcttatgtagacggctggaagaaataatactagatggtgctcagttcacgaaagctacacttctactgatcgaagcgtcatattgttagacgaaataatgcgaataattaattagctgagaccacatgcgttagtttcagtgaaactaacacgctgatggggatctgcagggcattattgtcacatgaagaacggtacgtacgctggtcaatcgtattccctactgtataattagttacaaactacaaactttttgtgtgtttgattctaatagaaaaggacttttgaccaattatggtggtctcaatcgatcgttctcctcacatacggttcaattacatctctcttttaagtgtgatctggctagcttttgttttaagttttactaattcaaagccagagcttttctctttaaagtgttcaaagcaacagtcgattgattgctactattgtctggcaacaatattcagaatgaattcttcagataaagagaacgattgttatattgcccatcttttcttattccaaaagaaaatattgtccatcttttcaatatatttgtatgcaaggattatatactataactaaacattcacaaatacatatgaatgtgagctgttttgcttcagatatttctgcacagcctcttataactactggttaaaattaaacttgaccaaaacctccatttcatcgtactattgtgccctattgattttgaggtgttattcgatggtctctagactagtagaatagttatttctaagtagtaatggaactcataaatcaataatttagatcacttttactgatgataattatagtagaatatatattaccgtaaagtcctaattgattttagagttcttttatggtcttttatgacccttgtgggcacttaaaacacaaaagcccacaaattttttaactatagtccttgcgaaccaacctccagggtttaacttcactgtatcccccaaccacaaggacatcccgatcgtgtctgattccgttggcacttccacgacaaaatcaggtgacatctatcggaaaagtggtatatatatactcagcaaatctcaatcaagggcatgcttgattaaggcacgtacgcgtcataaaatcaatcattaaacagatcgatcgatcggctggtcgcaccaacattctgttgagtgcttgctaaccgattagctgcttagctcacactgtcacacgcattggcacgtccaaatccccgcaaaaaattgcgaaatccccagcgaatcgcccgctcccctctccgcgcccgcctgcaatctcaaccagcagcaaatagaggtacattgtgaatatgttcacgggttagccacttacacccttaaaataagaaaagcgaacgactgaagtcgtgcggcaccacagcctcacataccgtaacgttcccttctccgatcggcacgccggccggcccggccggcacggctcgcttccggtcgggccggcggcgacgacgacaagacccctttctgtcataggatcctctcctagaggcatcatttcacgcattatgtaaccgtacatgcgtgtggtttagccggttttgattattatcagcgctgcgtcgctaattcgacagctcgctcgcgtttgctgctgctgctgctgcagcttgcaaacgcatttgctcctctggccatgtgttgtgcatgtgacacggtcgcctctgctcgtcccgcgctcgacgcgagctcgcacttgggctagctagctaacgtgtactagtacctaagatcctcaatttgcgactaattggatgattaattagggaaaggtatagatggcgagccaggagaggttaactggttcgctgcgccactggcgttggacttggactcttgtgggaaccggtaactggcgtgcgagtgctctgtacctaaccttctagtcattggcttgtggttttatttatttttcataacttacattggcaagtcccttgttattttctaattaagatatagattttttatcttaatttttaaattgctaaacggcgtattttgtgtggaaacttcttatgtagaagttgctttgaaatatcatataaatctatttcttaaatttaaaataaataaaacttagttaattatatgttaatagttttcttattttgtatatctgtatttaaattttcattagtgaactcaaacggaccaacagagacaagtgaacattgtgtgcacactgtatggaaccttctttgctacttcctctccttttcttttcactcttctagtactgttgagatattgagttcagtaccactagtaccagcacagtacgtgtagtaaagaaaggctggaagtagaagagcttgaaggcacagttggcatttttatagtttattatttaactcccggtacttgttcgaaggagctgtactccctccgtcaaaaaaaaaagacaaatcctggtttccgtgtctaacgtttgaccgtccgtcttatttgaaaaaattataaaaaaaattaaaaagacaagtcacacataaaatattaattatattttatcatctaacaacaatgaaaatatgaattataaaaaaatttcatataaaatggacagtcaaagttggatacgaaaattcagggtttgacttttttttttttttgggacggagggattacgtaataatgacgtggcagcagcaagatccggacttgttatgagcaagggctaatctggtgagaatttgtgtgagaacgcactctggtggtgagtgatgtacacaagaatccatgcacttactgccaaactcattgtgaaatcattgaggcaagcaggcaacacatacatctcaattctgatttttgctgattgtccgctgtttcaccgcaccattaaaacgacctccaaacggccggccagcagcccaccacacccacatgtccataaaaaaaaataaattatgcacatcaataattcaatcagctgaaaaaaaatctgcttcgaattaattaacttctattagtagagagatctttttgattgttggtacacaaagcacacaggcttcatggcctaatcaagcacaacatagactaaactttgtcaatagcagtaactactaaatatagcggtaataacatttttcccttttttttctttctttcttgagagttgtcgttgtagcctattcatgagcccagaaaggtaaaatggctactcggcccacaagagtggctcattgagcacgacggcgtcgccgccgtcgtactcctcggccgccagtgccgccggccacaccggcgaccaccagagcccgtcccgtaggtcgagaagaaggtcgggtaggtcgaagagagcattgtcctggccgccgtcggcgtgcaccgtgtcagggcaggcggcttcctcctcgggttgctcggcggtgggcgacgacgacggcgacgactcctcctcgcaccgcacctcggcggcagccttggcggcgacggcctggatgtctgccggggaggtggactccgggcggggcagctcgtgggcgctgtccgggaagttgaggtgcgcgttccggcccttgatggcgagcgcggccacgtcgtgggcgcgcgccgccatctccgcggtggggaaggtacccagccagatgcgcgacttcttgcggggctcccggatctccgacacccacttcccccagctccggcggcgcacgccgcggtacgacgggtgcttgaagccgctcctcggcgccgaggcggcggtgcaggtgctgctgctgtcgacgccgccgccgccgccgcccgcctgcgccttgccgctcgccgccgcgttgtcgtcggtgctgcagctgctggtatcctcccctgcgccgtgggcggcattggcaggttcctccgcggccgctctcttgcgcttcttggcggcgtgtttgggcttggagctcttgggccggtcttgcgcgccattgtcgacgagggaggaggtggaggaggaagtggacagcgacgaggaggagaaggagacggagacggaggaggaggtggtgggtgtatggctcgcgtctgcttccatggctcccgttaggagaaggccgtggcccgtggcgaggagagagatcgatggaagtgcggtctgcggcgagtgagcgagtgagtgcctctggctataaatagtcgcgcggccttgctttcttgaggtggggcagggtatgttaaaaagccttttgtttccctttctacgcaaggtttttcattgattaatgtagatgattaattaatttcatagtttcattatagaactcaggaccattggatgataaaaaccaggaccatcggatgataaaaccatcattttccaaccatttgtacgtatagcacttcttggaaacataggattaaaaaaataataataaagaatatatgatttcagcgtaaaaaaatataggattttaacaataatacttgtgtaaaatagataattgaaaaacattaagaaaaaacatgtttgtttagttagatggtgggaaaataccgaaatttaagaagaaataaagactcaaataaaacttttcatgagattggatatcatgttaaatttcttatataatatgcacggaatgaggaatttgtaggattcaatattatccaatattttatttcaaatggctatttaaggaagaacattttttagaataaaattctataaattccttactatgttttttcttcaaatcgaaacggcctaaaatgctatttcctccgtttcatattataagtcgctaggattttttttctagtcaaaactttttaagtttaaacaagtttagagaaaaatttagcaatatctaaaacaccgaatcagtctcattgaatctaatattgaatatattttgataatatgtttcttttatgttgaaaattctactatatttttctataaattaatttaatcaaacccaatcaaaatttaactaaaaagtcaaaaggacataaatttaactagataaaagtcaaaaaattgttttgcctcttctgatctaaagctttagaacatagggaaccccaaacctaaactaagatttgttcaagaggtgggttcttttgcattttaaacaggtggagctagtgaaatcgatccctgaaacaacaacaaaaatatcatcccaataagtcaaattttgaccaaagatagtttgactctcatagtttgattcaaaaataatgtatggtcaaggtttgttacgagaataatcattatattacaattatatatgagttttcttaaatttgtatagaagagttgacattttattcacttgagcaaccggccggcatgaggcagttgaaactaaagcaacaaaagtttgtttgtttttaatctggacatttcagaaaagtttagaatgcaagaaaaaaaatacaaaatatattatgataaagcaaatacagcgactctcactgcttttactgtttcatcacatgagtcaaaatcaaacattcagattttttttaacgaaccaatataaggtgtaccaatttcattaactatagcaggggaaaaaattaactaaacaaggtaaaaggagaactatgttacgactacggaacagtcttcgaaaaacgttttgctcttgctaaggcttaagtcttgaactcttccttttttttttcaatcaacgaagacgccgatggctcaagtat

SEQ ID NO: 33336 - DNA, 2856 bp, Oryza sativa
  unsure (1)..(2856): unsure at all n locations
gctcttgctaaggcttaagtcttgaactcttccttttttttttcaatcaacgaagacgccgatggctcaaatattttgattttggtactatattgaactactaatttgctggagaaggttctgggctttggcatttacttttagcgttgaaacttaaaagggattaagcagagtatatatataactacaacctactaacagtactctagacctggtcccccaaaaaaaacccgtttctctgccgaactagtttaaagctaaatatacagtgaccgtacatactgaccacgttgatcgcaattctagctaattctggtcacgtttaacacttttaactattactacttgatgcaagtcaatcgatctgtacgtagcacagggcatatagattaactcatcccaaataaactatctcagagccggttacttaacaagatcttcagtagcattatttaggcctaatggtggagccgcggagagcaagtggtgtttgcttgggtacaaaatggttcggcgcaacgataagatatggcgcgtcgtgtcgctggagttcgacacgagcaaatcccaacgaacgtttggtcgtctcgatcgggtccgattcgatccagagccaaactttggcttcgttttctcatcagttttcctttttttttcccctccttttttgccgtttctgcgcttgacttccccgtgagtttttgctactactctcctcggtcggccgaaagaaagggatgcatgttaggccgtggcacaccaccctcgcgagatttcagctgtgattgatggggagcgtgtcgatcatggcgcgtatgcttgcacgtagcatccggattgaattgcgatccgttgtctgcatgcctcgctctctttctctcttccgaggatttgtcatttatcaacgtactgctccaagccagaaagttggattgtaagggtcaataactccgtggaacccctagtgtgcggatcgcaagagataccccaggaagtatgagaaacttattagtttacggactagctagctagaggccggccgtcttccgagtagaacggaggggaattgaatgccgttgtgaactgagaggatcagtggattgaagaacctgggcaccggagagggagcagattaatattccttccacgcatatctagccgtacgtgctggcatccaagtactagtacccaggtaacccaacacgatgatgcccctctgtactcgctcgtgcgcacgaacgacagcacgattaatatggggttcagaaagcttcagaaaacgagtatactttactctcagtaaaaacgcaatcacgattcgatcaggacgtacaccggagctgatcgagacaggcagaggtaaaactaagggagaaggcctggctgtcagctgattaatactagtagtaattcagaggatcaaggcacggaaatactaagctccccgagacgtgtagtgtggttaacgcgacgcgattaaatgcttgctgcagggcttgctctttcgggcaagctacagctacagctacagcacagccgcgcccttcgccgatcgtgcaacacgttctctctctctctctctcgcgcgcgcgcgcgcgggagatgcgagatttgaccctttgaccctgtgggggcacaagacagaagagaaaagaaaaggaaagaaaaaacaaacgatcgcgcggttcccgcgggtcgcgagccgcgcgaggagccacgtgatctgagctaccgctgcctgcggcgcccgcgccgaaaaatccaccgagtctctcatcaagcaaaatcgcggtggtttggcacgcaaaacctctcacgtcgtcgtcctcgacaccaaacgcgatcccatcttaccagtagtcccagtacacgagtactaagggggtgtttagatggggctaaaactttttagcccatgtcacattggatgtttggacgctaatttggagtattaaacatagactagtaaaaaaattaatttttataaatgagagctaatccgcgagacgaattttttaagcctaattaatccataattatcaaaagtttactgtagcatcacattgtcaaaatcatgacgtaattagactcaaaagattcgtctcgcgaattagtccaaggttatggaatgggttttgtaattagtgtatgtttaatactctaaattagtgtctaaacatccgatgtgacagggacttgaagtaagtccctagaaaccaaacaggccctaatcctgtactatgagctaaccttagccagtgaactaacgagacctccattgatcatcctagtagtactagacggtagccctggtacaaaagtcccggcaccaagggcattacttctaagttacagagcgtgtctacctgtccaacgcatttatatatactctctctacgacgaacccgggcggtgtacgtgcacgtacatatacgttgcatactgctgcccactaaggccagtagacggtcgactctctccaagcgtcgtcttatatatacaggcagcagtacacccctagctagctactgcttgcaagtaacaattcaccgtcaagcgtcaaagttgtatccaacctcttccgtatagcagcgaccggaggagtcctcctcgcagagagtcgcagtcttcaattcgtacgtgctttagcattgtaagatttgggtagtattagtagtaccagttcttaatgcacggcgacgaaactacactcgcattggttatcctagcgccgagacacagtacagcttaaatgcgatagcccaagaacagatgaatggtagtagtaccaagagcttgagttattgctcctcgttaagnnnnnnnnnnnnnnnnnnnnnnnnnnnnnnnnnnnnn

SEQ ID NO: 33337 - DNA, 18481 bp, Oryza sativa
  unsure (1)..(18481): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcatagcaagctggtagtaaatgatggtaaaacatgttaagcaatgtgggtttgcagctggaacattcgttttaaatctgaaattgtactgcagctgaattatgaagtgcaaaactcaccctgtagccactgataatagatgtcggatggattttgtttctcacaagatcattgccccgctggtaaaaagaaaaaaagagtgtcataaatgcatatttagaatggtaggcaaatacatagggaagaaaagactgacacgaaagctccatttcattacctttagcaattctgcggctattatcacaacagatgtcgttccatctcccacctctctgtcttgaagctcagccaactcaacaagaacctaacaataacaggaccaaaaaacaactaagcacaaaacaacaaccaggggaaaaaggagatggcacctttaagctgcctgacatcaccttggctgctggatgctcgacttccaacatcctcaaaatggttgctccatcatttgttatggtaacatcaccaatatcatccacaagcatctacaagaaggatatgctcaattagctcattccagccaaccttttggaattatcagggattggtgtggtgcagaactgatctaagtctaacttcattaatcctgattaggtttagtgatactgatgcacatactgttgtaatttcatgatttcataaaaagtttagtgatactgacagttatttcgagcacataacaacattagccgcacacatattacaccgttgaatcagtaagcgactgaactacatctggatcacaatgagcagctcataaaggagaaaatacgtcattctaagtagcggatcacacaattttgaaacctacaagttcgcatccttcacacacagtaacaatttatgcgcaaccaagtagatcaaatcgcaaggtacaaaccttgtcgagccccacgggcccaagcgaggacttaacgatgttggccaccgcctggcacgccaccactgcaatcagagaaggaaatcaaatccccgcgtccggacggcgagtcgtgccactagatcttacaaaaacccgccgcgactccacggaatctggcggcggggaagggcttgcaggagggggagagacgagttaccgttttgcgtgcggacgtcctggccggactggcgctcgccgaggatgtcgggggtctgggcggtgatcgccatggcgacgacgacggcggcggcggcgaggcgaaaactgtggaggcagcactggagagttcgaggcgggggtcggcgtctgcaatggggggttttgctggaggagccgcgggggttagggttcgatgcggttgtgaaatggaccttggacttgatgggccttgatgagcccagcccattataccggcccaaactcctcacgaaggcaacgcgagctcgcctccccttccccccgtcaccgccaccacccaaaccaaatcctcgcccatggcgccactagtctcccacgcgaaaattctcgcgccgattccgaggggcaaccgccgcctcgcccccgcgccccctgccgccggcggcttcctccgcgccctcttcccctcacggcgctcccgccctccgccagagaaggacgagctcctccgcctcatcgccgaccaacgccgcggcctcgacacccagtccgacccctcccgcctcgccgacatcgtctcctgcatcgacgccctcgccgccgctgctcccggatccgataccgtttccgatgccgacaagctttccggtacgtggcggctcctctggaccaccgagcatgagcagctcttcatcgtgcgcaacgcccccttcttccgcaccgccgccggtgatgtgttccaggtaatcgacgtccccggtggcgccctcaacaacgtgatcaccttcccgccctctggcgcgttcgtcgtgaacggctccatcgagatccagccgccccagcgagtcaattttaggcaggcttcctccagctttttgtttaggcttaacataatcatctgttctttccaaaaagaagacatcatcgtctgttgtttcatcagcttgtggtaattagagcaactgctgattgttttattttatgtttgcttgttgcaggtttacacgcgctatgttgagagggagcaattgggaggtcccgtttccgccctttgggaaaggatggtgagtggaagatattcttcaattggtagtatcatgcacttcactcgaataatcttacaagttgagttccaatgaaatagcaaaaacaaaggagacagaaaaaaatgtggaagcatagcacgagatattgtgcattgtttgcaacaattttcaaggaatgaaatcgtatctagcattcatggattgatattgtgttcacgtaatcgtaaaccatttcattaaatcaaatacattactctcgcagtcataattattttaggtaagataagaattggtcaaacttttaaaattttgaccataaattattggtcaaatgcttagtttaaaagccaaaaaaggggtatacttagatttgactcaaaaatatatatatcataaatttattctaatctaaaattaatcatccgagttttaaaagtttaaccgaatcttgtcctaagtgtcaaatatgtatgaccagaaatagtttttggaactgtgctgcataatcaacaatttataagtctaacaaacttttcatttttgttactagatgaccaaatcatcatctacaagggctttcctttcccacctccatttttagggatggtgtatatgttttcttcacctgatcagtagagagtgaatgtaaataaagctggactggaaacacatttttaccagttaggtctttgacatttgttcagtttatcagttctgtttcgttttatcagtttctggtttgacaccatctatttggaaatttggcttgtatgtgttaggtcttttgacatttacataatatatgcctctactttcaggtttgacactgtctatttggatgatgacatccgcgtagcaaaggacatacgaggggactatttagttgttgaacgcgctccatattcatggaatggatagttgttaaaattcaaagttgattgaatgcatagccagtcttgtgatgtgccttgtgaatataagaagcagattgtcagagccttgtgctttctcagcaaagtgttaaccatcgtgctatgacatttcttttcctagacaatactatgttctcccggaattagatggtaagtttgattagtaatgcatgtgcagcaaggttcttcttccaaggaattgtctaggttaaataatacctaggtatcccctatgtgagagaacacaaacttgccaagtatttgatgtgcttttggacatatgaaaaagatgctgcccattacggtgaactacgttagcgaacttgacagcatattgttatggcccacgatatcaagagccatgatggaattgttgactgtttcagtaccttttgttagtattgttttgcctgttgcttccagctttaagtagtagtttttcacattgaagcaagttctcagcaaatcaggtcaatgaatgccatcatctgattaagatagtaaactatgtatggtcttgctttatctggatcagggggccttttccttttatactcatgaggagtcaatgagatcaaatccaactttgctttgggaaaagtagcattgtagtgtcgcaagcttaatgatatgaaacattagattcagtttctgtaaccacttacccatgatttcttattctaggggtttcagatacagnggtatgtttcattccatctatcaattgaccactggagatcagatcaactttttgcagggatcggactctattcttctactgcccccttggaatgctggcaagatttgtagtgcaatgagaagagaattcaatttgccatgtctgaattttcctgggtatttttggttgctcggttctttatctaggaaaaattctgctcaatacctgggttaatttttgctgcatcggcaatgctccctgtcatttaaaaaaagtaagtggaaaggtatctatgtgatagattgattgaacatcactacttctccatgatattccaggcctgaacagaagcactgaagcaaaatacttttgaaatgctttcggtggtcctactgttgaactgaatagcaagttctcctttcaacagcttgtttcaagtgtctagtctgataattgcttccttgtactagactactgcaggttctagtcgcagtcgaacaacatatggtgaggctttaggaggacaggttggaccatggccctgggccagactacattgtgtgatgttgggcagtttgtgtacgctacgtgtgaactcatcagctcatcacgaaccagcatagaattatttttcttagtttgcttttgtttgtttggataccatttccttcaccttgagatatttggttaaggtggattgaacttagtaatgaagcaattcttttgtaatagcaggccctccctgaccaagtactggagccacttcaaaggatagaaggcaaaggctccccatgtgaaaaaggacgctccatgaccctgccatgtgtggtcatctgcgatttggtgtcccatggacagtgatgcactgattccacccttcgagtcttaaaagcaatccaaggttagtttacataccttttgcagcttagaaatactgaggataaaacgaagatagtatatcgtacacactgctggtctatagatgatctgctggtggccacaaacctttgcgtgacacttaatttggtggagtagtattttgatcttactggtatccttatatatatttctgaataaactagtatacaatggacaaagtcagttgatgtttccaaagaaaagcttgtgccgacatcaattaatcattttaaagttgcaaaaggagctataatgcttgagcatatctggaaaagtatgattaaagtatgcatccatacaaatcaaccacaatatattcaagattgaggatatttgaacaacatttgtagcttgtgcatgtttaacgggagcagaattattagtttctcttttttttaaaaaaaaccgaaggtagccatttgaatatattaaagagaaaagctaaaaaacaaagtgcatgcccaagcaccacacgctaaccacacaagcataaaccactgagagtttagagcctaacaccaaaacgatccccactaaacgtgaccaacaacaccaaaacaagaccggcttcactccacctcctcatgccgaggtggttttcgccgagctctttggcctcgcagccaccttcccatcttgccgctagcttaccatcggcatgctccagcggcggcgaggtggaagaggggtggagatgtggcggcacgggtggctagaatttcgccccgagccgcccacgcgaggacgacacaggggagggagtagtagattgctagcagcaaccattttttcttttttatattagttctttaggaatgtgagcaggattattagtttttctgtttttagatgaggatcattactcgtttttcaggaacgtgttcacagcttttctttcttttctttttctttattttttttgcatgcaatacggatatgttcgtcagagcgaatggtgtcatcctataatccgtgctgcaaattcaatgatccagttactctagagacggaaggcacgcgtcatagtatcatactccgtactttgtttacactgtctctatactctgatagacgaaaggcacacagcacactggcatatcgttatcctctgtcagtatagtacagtaaagcaacagccgttcggcactgcaaatctactactatcgtaggagtatactgtatgtggattggatagatgtacataatgagatggaacggctttgcgttttgcagccgcccggatggtagccagcagtccagcaccaagagctccaagacacggcggaccgagccagccggagggaggggatgattgagacagcggcctctgcggcgacgacagtggatcgtgagcagatttatcctgccacgagataagtacattgtactgctgactccgtttcaaaatatagctatttttagcataatactttgttctaaaataaagctatttcttcatctacgttctcaatcaatcacaaccattcttttgcatctaccttttcttttcaatcaatcgcacactttctctaatcattatcccctaattttttaatacccgtactaacttaaaaatatttatattttaggatagaggaaatagtagcagataggtgcggctgctgcatgctatgctgtgcacccctacgcaaatgcgtctctccaatgatccatctatccgcatccgtctccatccgcggcggcgactgggggagcatggcgtggcacggcaagggggccggccgaccggcgtggctgtcgtaccccccaagaaagggaaataaaatccaaactggcagcggcagcagcagcggcaggatcggatcggagcggccatccatctatcgtcgccacgctcgctgagtcaggtccgtgatgatatgatatgatcgggcccccggcccggggtctctccgccctttttctttccttccttttctctatgctgtttattgtgggaactggccagcggcagccgcagtggtggtcctggtacttgcgcacgtacagccactagctttccctgcagcagccacccactgcacctgctgctctctctctcttcccctctccctgcccatgtccatcccgctttgggctaccatctccccgcttttccatcgccacaatcatgaccgcacgtagccacctaattacgccttggatcacctccaaattaatcgcccttaatgtgctctctttttcaatgacttagggggtctgttcactttgatgttaaaaaaaaccttaccaaatattagcatagttgccacagaattttttatatagttattaaaatttggcagcaaactaaatgtagccacttttttagcaactttaccaaaacttgttaaggttgaaaatagcatcaaagtgaacaggacttttgatactctgatacgctacggctggtggctctcgtaagctggatggccccagctttaattagatcgagacgagtaaaccggttagagtatgttcttatcaggttatctgctaaacaggtttcaattctgaagtatcgtacgagaagttggagatctctaattagctagctactactccttccataaaaaaacaaatttgaagggatataacataacttaatagtgcaatgaacatctagattggttttttagataaaagagtagctaagaacctaattaatctgaaacaggagtagctccccgtttttaggcacacgggaccatgatatcctcccctgtctaggacgtcgacgtggttcaagacgaggatcgatcaatagtacacccgtcaataatgtcatgtacgtacggcttatgcctactccctctgtccaaaaaaagaaaaatcctaggtttccgtgcacaacgtttgaccatacgtcttatttgaaaaaattataaaaaaaattaaaaagacaagtcacgcataaagtattaatcatgttttatcatctaacaacaatggaaatactaattataaaaaagtttcatataagacgaacagtcaaacgtacggaaatcaagggtttgtcttttttttggatggagggagtacgttaagtaagcactcacgcaggccggcaagtacctactccctctatccttaaaaaaaaccaacctcgtacttggatgggactcgtctaaaaaatctagtacgatgttggcttttttggacgaagagagtacgtataacataacagtgactcgcccatacttgttttgtcatagtacatgagatatacctcgtttatttacacattatttaaatattttttaaaaagaaaatgtattgatatgtaacattaccatacatgttacaatttaacttctatatgtaaaaataaatagattgtagctaattaacgcatattcagtcaaatttgtttttttattacaacatgtagaaattaaatttaatcttacatatttgtggagtgatttatcacactaatttatcttattagaaaataaaataaatttgtaactgctccatccgtctcaaaataaatcaacttatggaatttaaactttatcccaaaataaattaacttctaccttcttatttactttggttcacaatgaaataagagaatttcttccatacccctgaaattttagccgatcccttctattttcctgaattttcttcactcccttgtatacctctgaattttgatttggatccctttcatacccttgttgtcagttgaccgtttaataagtatcaaaaagtcagttttacccttcaatacgtgaggaatatgtagaaatttgtaaactatattgttgcaagtatagaaatttgttgtgtgattataatatttgtaagtttgttgtacatagaaattttaataaatattaaaaaagtatgtgtaccattttctttaaatgataaacatagttttggaaaacattcctatatattatataggacatgaaaaaacacgttgaactaccataaaaaaaggatacatatactcttttaataagtaaataaatattaggtttttatgtcattatcttaaattaaactttgccattaataagttgcatattactccctctatccataaacttacacctatttcatatttgagtttttccaaataaggtgtttctatttgtagtctttatgcattcaagacttaaatgaagatataaataaaatgctttattagaacccaatgagtcatctaaatactcattagttgcatacttacattcacttcttgattttgtaacatccaaggtgatttaatttctccttggtcttggtgtcaaaagtaatatgtgtaacttttgtggatggagggagtatgatagtttgttcaatgataaacctactagtaacatcaattttatctgattgatctttttagggcccctttcaatcaaatgaattatgaaggaatttcatagaattgaaaccctatagaaaaatttcctatgtaacctttgattcaaaggattaaagttttctaaaacggacaaaatttctatggaatggcttatttcatatagtttttggagaaaacttagcaagaggtccaacctcttggtaagaatcctttgagtctatctcatccgattcttgtgttttttatatggtccaatcaaacgatgattcatgcatgtgtttttcctgtgttttgcaatcatctgttttatatttacattcatgttagaattctatatgttttctatttcttcgtttttttattctcatgattcgaagggacctttaatatttttgatattaaaagttaaaaatgtttgggactgagggagtaaagctaatggagtactcctaccttgtagcaaacggcgttgctgaggccatcaggccaatcgtctggctggccgaccacgatctacactgccctagaagttagccctgtcagtggagtagtactggtagttaggccgcgcgcgtgggtcgccaattcaccctctctatagctacaggtgcgttacaggtgcatcgccggccgtgcagtgcaggctgcatccatgcatcgtacacctcgtggcgttcgcgtggcgtgcatgtgatgagctcgagctgcgctaacgagctttccagagcaaagcgacgcgcgcggccggccggggctgcgcaggaaaaccccgaacctccatcagctgattctctgagcgtaaacctggagctacctggtagtagtagtattacgaatttaattacgatacaccgtcgcacgtcgctcacagccggcgcacacagctaaccagccagtacataccagcggatagatcaggcgaacggcatatactacgtgccttctgtatagtgttcacgctgtgtttagatttaggggtaaaaatttttatcgtgtaatattggatttgaagtattaaacgcactctaataacaaagaaattatagaatccacctataaactatgagatgaatttattaagcataattaatctgccattagtaagtgtttactatagtgctatattgttaaatcatggagtaattaggcttaaaagattcatattacaatttacacataatctgtataattagtttttttttctatatttaatattttatatatgtgtctaaacattcgatgtgatatgtgaaaaaacttatcaagagatctaaacatgcccataccttagtatatgcgcccacagaaaaaggcaaaggggaattaattagtacttgaatacttgatctctagatatatgtatgcatgattctgcgtcgaatcgtggttaccgaaaagatatgatcgagagctaggagttaactccatatagtagttaattatgttagctaagagctaggagtactcgtacctttctgatctccttggaatgtctttttctcgatgaccttacgtgaaagcgtaacgcgatcgagaaccgactcagccgagactcatcgttgcgcacgtacacgcgcgcgggggtggacggccggcgtgcacggttccgctgacacagacctgcacaggcgggcaaacataattagatcgagtagcccatgcatgttgattataccagtaagtttcacgcacgcacaccggtccattgatttctcgccgcgcttaatttgtcctccgatcctctcctggtctcgggtctccggaagttgaaattaaagcttcttcgatcgcgtgcgccgattgattcggattaccaaacttcccagagattttagcgatcgaatccctgctttgagatcgacgtgtactctccctccctggtcactggatttaaggttgtcgcgtgccccctccccctgcgacgactgcgagcctctccttcccttccaccttttttcttcctctcttcgcatgcacgcacgtacacactcacatccccccttttctctctccagatatctctctcatactatttaataaccggactcgtagtccctacctttccatgattccatctcctccattcccatccgcccgcatctccactcctcctctccccacctcctcatcaagctagctaagctagctctcccaaccatggctggcgccggcaccgtctgctccatgtgcggcgacgtcggcttcccgacaagctcttccagtgcgcgcgctgccgctaccgcttccagcactcgtacgtaacgcgcgacccggccggtgtactctctaccactgtaatctcttctctatctagagctagcagcgaacacggggtgtgtgtgcgtgtgtctgtgcggtgtctgtgtatccatgcatgtctgatagacttgtggcgcgcgtgcagatactgcacgaactactacggtgacgcggcgcccgccccggccggcgccgacatgtgcgactggtgcctgagcgacgtcgccgggaaggcgaggtactcgtcggcggccgggaagcagcagggcgccggaagccaggagtcatccacgacgacgtcgagctcctccgccggaaggggtggcggcggcaagcccggcgccggcgagcaggagagcgggcggcgggggaccaaggcggccggccgaaggtacaagctgctcaaggacgtcttgtgttagtttgtttgtttaggtcacccatgccgtcacccagtactagtcgtcatcgcttaggctatatagactcgttagctagccgctagtttgatgatcgatgtgcatatactacgtgcgtactccatattgtatctagttgtgtgtgttagggtcttttaagggggcctgttacctgaaatgttgcactcttggcttgtgtttctcttgcgttatgcttgcatgcttttctagtatcttggataatttactgcatatatatctcttgttatcttcccgggttctttctaacagcgatttgctagtagctcatatcacatgcatgcatgtaggtaatccctacatcttttgatcacaccttgtgtgtggtggaatatttcagatgagctattaatttctcctgaacttgttagaaacaacaggatgcatgcatgcattttctttatctttatacttcatgtagttttggggccggggaactgaggagcaactggccatcacgcacgttgcatgctgccaagccgagccatgtcgatgtaggggtcaacgaatcgtacccaaagacccaaagtggccgacaaagacatgctcctacacaaacctcaagctctgcacggcctcctctctacgagtagctagcttgtggccaagatccatttagcccctgcttttgcctcgattggatggcaatgcaaatccttctgctacctatagcaacaaactgcatgcgcacaacagcccagtatcagcaacattgctgctccagaatgccatcactgatcatgttctcccatttgtcctttcgttgatactcctaaatactctgaatctctgatcaatgagcctgttgatacagcactgtccgttattcaaatattttagtcagtcttgccgtacctgatcacttggcgattatttaattcctagctagtactctatatattgattcagatctctactgggatgaactgtagccataagacaaaactttaattatgaggggaagtttagttaagtggaattaatagtagatgacggcaggaccaaattagctgtgtgtggtagctagctctagctcgcccacagtaccagcggtgcagctgaccctactcttgtgcatatgtacaccatctggtcctttttaggtgtcatgtagctaaacagaccagacatcgcgggatcgtagctaggtttctttctccctcgtcttctacactgtatgtggagttatctttcttctccctagcctagctagctacctatcttgcacgtactactaccaaacaagcgttgttccttaatcataaccgaagtttaattatttcttttgacactgtttgctagctagctcatagcatctacttcctccgtcccaaaaatatgtccagatttatctctagagttctagaggagtactaaaaggactactcttttcattccaattgatcatcacatatgatttttgagttatccctaaaatgatcgtactcctatataataagtgcctcttcatttatttgtgaaaagagtaaatggacatcactgaatgtgttggtatgcatgtaactagttaagattaatttctattggttcaactccatgcaacatttatagtgtgatgcaagctgtgggacacaaagcgatggaacacattgattagtgataattaattttagagccatcgaggttttattgtctttggactcgatgctctttgctttggtgataatcaaattggaattgagagagtattatataagattgtagttgcaagtatagctttaaagattgtaaacatactgcaagcagctaaacactacaaataaaaggggtctattgtgccggttgtgaaccctcgtctattctgggttcccaaccagcacaacaatcgatgcaatgatggcctctcgacctcattgtcgatgtagagaataggcactaatgggattgacgagctaaaaaaaggttgagccagcttgaattgagatgacgcggtccaaatcacatatcatgtatcgatgcccagatcagcaattgaaaaaaaaatcaatttagacagattgatgcatgaatcaacaaaattgtgaaacacagatcctaacaaataagaaaattagaaaaaaaaatagaagattgtgcatccatctttttgttgatatttggatttcgttttcaaataaagtcatcttctagttttaaatcacctttagaatcattagcctctgtccctacactgactcacttatccgggatcgatcctcactacggtcctttatttcgaaacgaggatagggctctcgcggaacgaggtgtagattgagacgaaagatgagcgtatggtccatactcactcgggttcaaacttattcttcttttttttttccattcattcaaccttatatatttgatccccttctcccaggtgcgagtctattattgaggaactgtgagctccttttctagagcttccttcccatttaggcggggtgttcaaaggggttccaccgtcaacttaagttaaggaaccccaactaagaagaaaaataaaaaaaaagaaaaatatgtgaatcacagatcctaacatgcatcatccatgtcccaacaaaagaaattgctcgagttctcaaatggatagcatgccaaggtcggcgaagccgttgtttctcgctgaaggtcaaggacgccacagctctcactgcttgccgaggctaaggctgctgctcctatgattgtggagatcgagagagaatggagacaccaagagggaagagagtgtggttgtggggatgtatatgtagaagataaggtagagagagagagagagtggatgttcaagagataagggagatatcaactcgagtaaaaaaccattagctcgggtggctcaagtaccagttttacttaaagaccccacactaatgagtaatgactaatcatcagtgacgatttataatagaaaatgacactcataagtagactacttatctatgtcggttcttagctatattgggcacagattgggtgggtggatgcgaaactccttatcagtgccaggttttcttcatccaatagtaaaaggactgtacgaataagttgttctgtagtagtgtaagtagctaatcatatccatcttgtatacgttgtcatacaataaaactagacaaggactctagccagacattccactcgtaggtatcgcctacacgggtggcacatgggtgaaacctagctactaatcgttgtcaatctccaacccgaccctcatagtctcagctagccatgggcggcatcccttttgttgggggtgtgttgaaatcctcggtcgtgggagtttgtcaggcctcctttatcatccgtgggcggacatcgatggaaagatagtccagtgtacctaagtagcagtggatgcggagtgcgttttttggatcttgtagcccaaacctagatgtttgttgtcttctattactctctccattattgaataattgacattttgaccatagcatataaaacaagacaacaaaatttatggccaatttgcccttggcaattgttagaagatgacgctaaaaatgaataaagttgaggtagggaaaggaattgagggaaaagacaactatctagatgcttactctatggtggaagatttatttaggcccaaaagtgtagatataggatagtaggggcaaaattgggattttagtaataaaagtgtggtggtgacaactattttgaaacaaatggtttgatcaaaactatcaattattcaaaaatagaggtataggatagtaggggcaaaattgggattttagtaataaaagtgtggtggtgaaaacaattttgaaacaaatggtttgatcaaaactatcaattattcaaaaatagagggaatagctattcttcagcagcaaaccggtagcatcactggaattgactggaagctatgctaggtctacaacaagcaggcgcccaggcaacgaatccatcatcttgctgacgcgggtcgatggagttcaagtgcgcttagtaattggcgtcagtggggattgtattctggactcttaagaggatatccccttgtttctcctatgtcatctatatagttatgaaagaaaaactcaatcatgttttttttctttttgcatgttgatcttggatgctcaaaactagttggaaaacgactaaagtgtcgtacattaatacaaaagtagtatttatgggagggttggtgtgggatattaaaggaatcgaactcattgttttgtggacttggaataggtgagaagatggaaataaagttatttttttgtaaaaatgaaagaggctaaaagcatgcttattttggatggatggagtatgcttgtagtaaaaaatcctagtctaactgtccaaacaaactcaacctaaaaattgtttcccgtgttaatggtggtgcagtggatatcttagtatcttattactactagaaaacaactcgttgtggctgtcgcagctggtggatgcgcaattgctaatctctacgaacgcagtttctaaaggaaaataatcctaattaattaagagaccgtgtatttttatgcagttgggatagagacctatctaaagatgtaaatattagggaatgacctaatatcaaataattagaaaatgttaggcttcgagcctaggtcatctagcccactatcctgtggagctgcccaaacaccctagacgtttctcggatagagacctatcttacaatacatgtttgttttgtttctatagatttctccatccatccgtgatttcaattctactgggtggtgagtggccgggattacattaattattttagctagctgccatgacaatttacttatggctcattcaaaatacatgaatttcataggatttttatagggtacacttcattcttttaaaattccgataaaattgctccaaaccaaataagcccttagtactccgtacgtttgtttttttctcaaaatgtgttgttgattacttttgtaatggcgtttaaccatccatttcattaaaatttagtgcaaataaaatgtgaagtcatgcttaaaatacttcgtaaaaaaacaagttacaacaaaataaatagagctcatataataccttaataagatgaataattaaaagtcatatttaaaatgtgtgatcgtgtcaaataattttaatatattatgtgtgtatgtacgcaaacctagcaattaattagtttttttttataaaagagatcaggaatggatcccaagtgtacaatgtgtagtgaactagtgattactacatgtgtcggccggagagagccaaagacaatgagctttaattattaatttgtttctaagcagttaataggaaggatcgattttttgaagcacttgctagagctatcctagcttgctcccttatattagtttgagcagataagaatcgcagctacgccgggcccaacgacgtggacggaagatatttgcatttgtagatacttgaatctatcgtttggatagtgctcccctgcactatgccatgtaccatatctttcatagtgtcaaagcatggggaacgatgtgtccctgtccctgataacttcgatcgagtgccatgctcacattcatgtactacgtgttcattcattgcccgttggagattttttttaagcgttttggcaagctaattaatcaagtccatgttgtgcttgttcttgtggggtcgatgatatgccagtatgcacagcatgcatgatagaacaaatagcatgccaatacccatctctatgcatgcccgttcaccactttgaatgtgataggttgtggtggccaaatggcacatattggttgctttgtaaacagttggtaaggcaaacacaaatggctagtcatccattcaaataacgttgtggagtagcatgagaatgccattagtcacaataatatggtaggacattgtgtcagaaatgatactagatagcatcaaccttccatgacttcgtatcatacactgccggagaaatgctttgtactctcggattgtaatcctctattgttccggttatgcaaccgaaactagagatccgggaataaagatatccatctttagtcccggttaaaataaaccggactaaaaatcattgttagtcccggttggtaggactaagggattttttttctgtttccactgttgttttgtggttgcatctcgtgcacaatcgcacaaaaatcacacaaatcatacacaaaatcacacacataaatcatccacaaaaatcatttacaaatcatacacaatacatgcccatccacaatccacaaatcatcacaaaatcatccccaaatcaaaaaaaaatctacacatcaattcactgtccatccacaatccacaaatcatcacaaaatcatccccaaatcaacaaaaataaaaacctacacatcaattaaaaaaaataa

SEQ ID NO: 33338 - DNA, 9268 bp, Oryza sativa
tttttgaaccgggactaaagttattctttagtcctgtttcttacttagaccgggagtattgtgaattttggtcgaccgggcaaagatggtttctccagtaatgatatctacacatgaactctcgaaaaagcaccctaatttaagagatatcatattacaatgtcatttgtatttgggacttgcatacaaattaaacattgtcaaaataaacgtctgtacgtgctaattaatttttttcttatatgagggcaaaatgttgtatactcctaataaattgcgaatatatagcccagcatggatgcttggtttgagctacgggagcaaagttggaactagctaggttgcctcctatactaattattgatcagccggggggggagggtttgttttttgtttctggaaaagtcaggggggatttgttgcatgtttgccattataatgttattatagatgtatgcaggctcaaaaccatactttaatgccctttttcagttgcacttttaatgaatgaaaaaccgatggtgtgtgtgtgtgcgtacacatcatatggtggttatttaattgggtgttcaattataacatgcatgaataattcttatcttgcaatttaacatagttatgttaatatcacatcaatgcacatatctcaagctaattttagagagtatgtgcaaaacatgcaatagttggagcatctctatcacctctccaaatatccatctggccagcttgccaaatttatctttcattccaataaccttttcatttcactctcaatccaacaatgggtatcacatgtcaccctctctttacttcttcctcccttcttctatctttcccatcccaaccatcttccctctccacccgacgacagtagggggcgacaacgacgaggtggccaacaaggggaagcagggataagggcggggcaggtgaggggagataaggcgtcatggtgttactgctgccgccagcagtgggaatcgacacagggaagagcaagaaggggcggtgacgcacgcaccagcaatggagatgcagacaatggcaatgcggcggaggttggggaaaacggtggcaacgacgggctatggtgatcctctcatcctttgttggtcacctcccttccgagctcccggctcccgcttctgccactctgacacccttcaccgtcgcgtgcaggccaggccaagccaggccactgcctccacgcggcccttgtggtgggagttgtcggtggcgtggggaggtgattgccgagtgaggagtcaagcttagggatgaggaggttaaaggagacattgacgattggccttcttcctttacagcgatgcatcagcgcgagggtgggcgttggcagagaagagaggagacggagaaacggattgaaggtgggactgataatgcgacccttcgtttggtaaatagaggagcctggccacatttggccacccgaggaactcgtttggaagagagttttttcactgtgttggctaaaatttaatttgaagagccatctaatgtggtgacagttgacagaacatactgttgtattccggagggctgacgaacctgctgatctgtgccaagtgtagccggtcttagggtcactggtacaaatagctaggccaggagcatcgatctaagacaaagatgtgttggtcttaggttcctgaaaatatcagccggtgcgccgtgcgcgagctgttaatcatcaaagcaatggccgatgtgggtagcacaaattattcggaaccaactttgggcccgtttagttcctcaaaaatttttcccaaaaacatcacatcgaatctttagacacatgcatgaaacattaaatatagataaaaagaaacactaattgcacagttatggaggaaatcgcgagacgaatcttttaagcctaattagtccgtgattagccataagtgctacagtaacccacatgtgctaatgacggcttaattagtctcaaaagattcgtctcgcggtttccaggcgagttctgaaattagttttttcattcgtgtccgaaaaccccttccaacatccggttaaacgttcgatgtgacacccaaaaatttcctttttcccaactaaacacacccaaaatgttagggacaagagaacagtaaccaaacgtactgtcactgtttggttttactaatcagtgactttgtagtccgacatgacatccaacaaaccccgcctgacattgccgccgatcgagaggatctgggggattcgctctagtaggcactatcgcacagtgaccgcgtctctgtcttctagaacccaatgcgacgacctgataagatcgcattatcacatccatagttttagtatctgtcacaatacacgttttgtcactgaagaaaaccgaacaaatacgtgactatcacgggagaagcgccatgtagttttagtgtctggcgccggaggtagcatcggtcacaattcacacgtcgaactgtgatcatgcggagggctttggggtctgcagcttgggttggaattcccctcaagaggagaacagagaacgacagcatttcgtcgctccccccacgacatcatggcagaaacacgcccgtgaccaccaaataatgtccacccaattggcctctaatccatcagaaaagcagagcgaaaaaatagaacattgctagctagtggcaccaccaccaccactgcaccagtactgctacatcgggatagattgctacgagacgagacactattgtccaacgaactcaagttgattgcacggctgcgcgcggcgtcgggacagagctccagccgtgcgcgcgcgcccaccactgatcgatcgcttcccacgcccagctgacacgggagctagggaccgtggtgcacgcgcggcgacgtcgcggctggcaggtcggacactcagaccacgcgggcgccctccatgggcgacggcgtccacgcgtcgaaggtgcagccggcgtcgccgccctccttggggggcctcgctggcacgggccggaacggcgcgccgctgcctcctgccgcggtggtggcctgcatgaggtcgagcgtcacgtgccccgactgattctcgtgctgccctccggcgccggcggttgccggccgcgcctgcaggtgcgcgtgccagccaccggccgtttcggagcccgggctgcggcccgttggacggccagctggtggcggctgtcggtcggagaagaattgccacgagaggagggccgcgcggttctcggcgatgagctcgtcgagcgccgcgcttgagcgggcggagatgtcgggcgtcggcatcagccatgggccggtggctctagccgatgacagaagagagagagcaccagccgacgacgtcggcaggccgtacggcgggaaaccgtgtcccagcaccggcatacctgcaacaacaacgtcgacacgttattatgcatatcattgtgcctacagaaatgtggccatctgttatagtcatatcaagaaagcataatgcacaccatcagtcctaataacgaagtggttactcaaccgcaatcatttttgcatgcttgccctgatcatttgcaaccaaatttacaaagtttaaaaccaaccaaccatgcatgttcaccgggtacaactaattgatactatactatatatctttacacaaactgatcgctacctgatcttccacaacatcatgtctatgtgttgatcaaataacaggtttcaagtggtcaataatgctgatgggctttgggtcactagcatagtaaaaacgtgcactcgaccttgatgtcaagtttaggtccatggtaatacgtactaatgttattgttaaccaagataggcccattatgctgttgttgattatgttgacacgaaagtttgtggtggttacgattgttaatgtctttattgtttgaggcaactaacttaaatcttgcattccataatatttctctgtaagacagccagaaggacctactccaaatcaaagtccacataaatactggagtacataagttatcacagaatataaggcatgttcatctacaggatctatgtcagtgcagcaggagtaccatgtactgtattttctactgcaggagtaatagtttctcagaacaagagaaaggtagtggtagactaaaaggagtactccctccttcctataaaaataaatctatgaatctggacagatgtatatcaaaattcgtagtattagaataagtcatatctgacactatattgtttttttatgggacaaaaggagtatacatatatacaaggtttctgaactgcagagccgtgcttacctttgaaggtcagtagtacaactatactcatgaaagcatatcaatatcaatcaatacacgcttgaatatcctagaatgccgctatgaaattcgaccgccgtatgtccaagtctttcggccagtcccgctatagcactataccttcgtacagtaactattcgtaattaactgtacagttgtacgcgtatgtatgtacatgcgtactggagtagtagtactagtacgtagtagtatagatttccgtaagcatacaggctcttgataaggagtggaagatggatggatgaaaccactgtttgccgtgttgcgtgcgcagcgaccacccggcgcgcgggttcctgttgatgccatggtgatcatatgcacggtcggcctggccagtggccacgcagccactgccactccaagcaagcaggctggctgggccggccaggcaggcagcgcagtgcacataaagtcgtgcattaaaatctgtgctctcagcgtctcacacatcccgatgagctttttggtgcgcacctgcagctctccccttgtttcccggcatcaaaccaaccagtactcctactactgggagtggtacgctcctgtttgtgcagctaacctgcctctccattggtctccctaactattactgggagtagtacgtacgtactacacgtactagtagtatgatgattaatggaactgttacggccgggacgggaggagtttgttttgtgtataccgtgtgggtgcgcagagcccctggccatggcctcgctggcgttgctcctccgccgcctctcgttgtgcccggccagccgccgccggcagctcttcttggcgtcgtcaaactccgcgagcacgtggaacctgcgcgtacaagtgaaagaccgctatgagcacgcgtgtagcagagctagacatgtgacgtagatcgtggtgattgacgcaccggctgcattgctggcagaagcgctgctcggtgccgtgcacgacgaccctcggggccttggcgtgcacctcgcacaccttgtgccgccggtggtactccttgactccctggagcgtaatgtcgcacccctccacctggcaacggggcaccaccggcaccgccgtcgccgccttctccttcctcttcccctgatccgcggaaccaccaccgcctccgcctccgccgccgccgctcccctgcgccacctggccggcgccgtcgccaccccagaagcacggccgcttcccgagcttgaggcaggtcagcccgccttgctgttgcatctggacgtcgggcctgcatggcgccggcgggaggaacggcggctgcgggctaggcggcgaggtgacgacgggagcccagtgcatcccaacgacaccacgtggtgtcgccccgcttccgccgcagccgtttccttccatggtggcagccgcacacggacggacctatgtgtaaacgtaccgcagctaagctagctagcgtcgttacacagcagcagccacctggtcgcgcgggcttggcttcgctccggccgacggcggcggatcgaaaactagcgccgattgggaaaaaggctgcggcggcggttgtaagtacagcgagtaggtttgccgcactggcgttccatataaagcgaagcagccaggcagcgagggtttgtgaagcgaagcgcacccccggggaggagcagcctactggcgaggaagcacgcgccgtactgacatgtgggatctcccgtcaggattggggtgtgtggtggggtcacgagcgtggctcgtgacatgtggggccaccgccacatggagctgtgtcattgacaggttcaatcgaaggcgggccccccctcgcccgctgccgctgcctctgccgctgctgctgcgccgtgacatgactgccacggcattaaacgccgcgcgctgtgtgacaatacgctcatccgcgcaccgcgcgtcaaccaaccaaccaatagcgcgcgcctcccccgacactgacacgccgggccaacacctctggtgccaccggacgagccccacctgtcggcgagccgtgccccgcgtccgtacggatcacgggagccacttgcgcaaagatcccacccatatccggaaccggacggcacgatagattctcccagccaacgcaccagttgacaaccgcgcagcagcccacctgtcgacgggcccattctatccatggccccacatgtcatagaggcatccacagagctacgcggtggagtacatgggacatggggtacgtacctggtgggcagtgaaaaaaaaaagcctgcgaggcaggtcgtgggtgtgtacatgcatgcagcgcgacgggcgggggtggggcccagtacggcggtggtccagttgtcagtgtcagctacagggcggcccagtgcctattggctggggaatggggggtatgtctgtgctttgggggaaataacatccccgtgctgggcgttggggaggatacggtgcagcacgtacgggtacgcctattttggccgcttcctgcgccattccctgcgacggtgctgctgcctttggctgcctcacctcacgtccttggttactcgcgcccgcgcactgtactactgccgctgacaccagtgttctgtttcctttcttcattttacagtactgtactatacgttttactacccctagatgttctctttacttttacgcatgtgcagcaatgcaggctgcaagaactccgttgcaagttgggtggattcgttgcaagttgcaagcggctgctagctgcctccggtgcctgctgttagggtggcagatgtatgtgtgcccagacgatgatcggaacagctgtgctgtgcactgcatgcgtatgcatcgctttttcagatggcagatcagccttcgtgacgtgtagtaacacgttgtgcagttactagtgggagtaggacaagaggcgtggtgtagaagtgtccaacaggatgagatcgtagcgtataataaagtggatacctcctcccatgcaagcatatcgtacgatcgtagcgccctcctaaagacgctttacaccatctaatgcaaatcctctcacttttgcttggtttcctagcgtctaaatataggcttgtccgtattattgtcattttgaccgtatcaaattttgataagacaataaactaaacgcaacgcaagaatcttcaggaagattgcatggacccctcaaactctaatcacaaatataaaagaggaagcatgagcctagtaaagcaagggcagtaaaattgaaagacactacatagaaaagagttcgatggcttggaagacactatatagaaaagtcttttatgggcatggttccctttcccatgcgggcatgcccactacattgtttcattttaagcttttattcaccatctctattataatatataagacaaatattcttcctttccttaaaaaaaaactaaacatgatatcaccaacttcatcctaccaaaatttggtagttttggaattccctctcacaaaaaaactatcaaaaaattagaaaggtatcaaactaacgcacatcctacgctaccacaatttaataataccaaaacttgagaaatgttggtattgctaaaattcgataatgttgattttaacagcaaagtgaaccagagccctctgcatattctacctgtctgccgtgatgggccaatgctgcaacagcgactaagcgcggtttgccgtctgcggagtgctcaaagcgaacggcccagctcgcgttctagcctaacgttttcggtgtggattgaattaggcccatgtagaatacacttgggccgtcacacgaaacggaatggaaagggcccaaaaagcacatggaccttatcgctggtcctcccgtccccgttaacaccaccggccgcctcgtcctctcgccatggccgcaccatccgcgagctcccgtgcctccgcgatctagcgcggcgcggtggctctcgcacccccggcgtcgacggagcgcggaggaaggcgggcctccgtacagaggcagtcgaggggcacgggatttaggggagaggggttggggggatggggaggaagcctgatccgtcgaagccacactacggtggcggcgcctcgccgagggcagcgaggaggacgcagccgtcgccggttttcctgggaacggcgctgttcgtcctagggtttgtgtccctcttcacgggacacatcgttacggacgccgactggtcccggatccggagccggtggcgatccaagcaggtaattttctgacaacctagaaggtctgtactgtataatttgacgggatttatcggcaccacttagaattcacgtgatattcgagtgcaataggagtaaatggacgtagtttgtctgttttctggggtgggcacgcctataccacagcatcgttggaaactaactgaaagctactgaacggaaaaaagtttaatttttgggatatatatatagttgttgcatacggtttacctggaaatagtatgcaagttgtgggtagtcagaggttttacgagtcactacgtgagcacctgcctgataagtccttaaattattgtttactgttgtcctgtcattatcagcatgttatttgtctcagttcttggtcaatgcttccttacaacgttggcaatgtgcaggttagaaataacgagcccataaatatttggaaatcgaggtattccaacttgtactatggatgcagcaggaggagcgtaaatttcagatgttagtttgcttattaaatcatcctcccttttggacaattataactagatgagtggaagaatatttaacacagtgattccatatgttcatctttcagctgctgtgccggagaacagttctactggttacttgctgattggtactagcgggggactaaatcagcagcgcataggggtacaactgtatttcaactttttattgcgttgctttgtattatccattgtattaccattacgatcttcagtttccagataaca

SEQ ID NO: 33339 - DNA, 19457 bp, Oryza sativa
ctatatgcagcgacttctctgacatttttgacgtggactggttcatctcttacctatcaaaggatgtaactattgtcaaaagaatcccttatgaggtgatgatgtcaatggataaactcccatggaccatgcgtgcgctaggaaatccatgcctgatttttacattgatgaagttttgcctatccttatgcgaaggcgagtaagtaatacattgcttcatattgatcaatttatcatctgcttgtgattgtttcctcgacacattttaatcatattgtgcatcttggaagaacatttgaattttttttttacttgaacattggaagaatcaattgtttgtgaggtatggatagtttggtagcttcatatgtcaattatgaagttacctcctgattttctgttttcaacactccctccatcccaatataagtacaacctagtgcagatgtgaaatatcctaggactatgatgtctagattcgtagtcctaggatatgtcacatctatactaggttgcacttttattgggacagagggagtatgagtttaggagatgcaataattggaaacatctatatgaaatcattagacacgtatgtggaatgctcgtgatatgtaaaagcaaagaggtttgcctatgcacttaacagtttaattttgcaggctttgcagctaacaaagtttgattatcggctcactaacgagcttgatgaagaattgcagaagttacgctgccgagtaaatttccatgcattaagatttacaaattccatacaaactctaggtgagaaattggtgcgcaagctgaggagcatgagctcacgatacgttgccgttcacttgaggtatgcttttacttgtttcttttgatttagtttctttgaaaatggtactactgagtttttttcccctgaaagtactcatatggagtgttttgaataacctctttacttttgcttgactcctcaggtttgagcctgacatgcttgcattttctggttgttactatggtggtggtgataaagaacggagggagttaggtgaaattaggaaaagatgggatacactacctgtaagactctgaaacttggtgagcttaggatctggatatatttttgtcggtattgcacttcctttttgtggattatttcttttgcactgataaggatgtgttgggtcagatttcccttaaaaactattgagtgataatggctgctgttagttctgagtgtccatgtattcttttgatcaattagtaccgatggatcaatatttgaatgatgaaatgatttagactgattcctagcaggagttgagcgctgaggatgagcgcagtaggggcaaatgtccactgactcctcaagaaattggtttgatgctccgagctcttggttttagcaatgacacgtacctgtatgttgcttctggagaaatatatgggggagaagaaactctccagcctctgagggatctctttccaaactactacaccaaagaaatgcttgctgggaatgatttgaaaccgttccttccgttctcttcaagattggctgcaattgatttcatcgtatgtgacgggagtgatgtttttgttacaaacaataatggaaacatggccaaggttttagctggacgaaggtatgcatctatcttctaatggatttgctaaatgttctaaatgtaaagtatagttgaatgtaaacagataagccttcaggtatgatgcaatccacctgattatactatttttctccctagtgctacgtgtgaccctttttcatgtatttttcgtatgtgtctatcgttggtggttttgtttcatctaatggtcattcatctctgtctacttgtaggcgatacatgggccacaagagaaccattcgcccaaatgctaaaaaactcaacttactatttaagagacggaaacagatgggatgggatatattttcacagaaggtaaagaaagtgcagaggggactaatgggagaaccggatgatatcagaccaggaagagatgatttcaatgaatttccatcatcttgcatctgccaaagaataccagtcaatagatcagtcacagcgcgagctgaaaacttgtgagctctagtgtagtgaggcagacaacttgagaacggagaatgctgggtgattgagcacgtcccttgctgcactggggaaaatacatgtttgttaagcaaagaaaacagggatgtaaacccaatcagacagaagcagacgtggtggataaatactcttaccggctttaactcatggcactctggtagtctggtggttcagacccagcagaactggttagtgtgcagcgatgacagacaaactgctgatttgcagcttcagtttggttccactaattgttaaaactgtggtaaagaatctgccacgataattgtagtcattagctcgatatgctatccctgtaaattgtacggtatacacgatcaattatttggatgtgtgcttcaatcgtcccatcttctgtctggtagaacctcacagcaacgaacttatttgctgaagggaaatgccattgtaccagaaacttggaaattgaaaattgcggtgattacgtgtaatttatttccttttaacgagccagtctggttcttttgaagcaatatgaatgtaacgtctttgttgcatggctgtgcagtactaatcaatgactcagcaaatctaatcaaatcgtcatcaaacataaatttcatgggattgctattcaccagtcaattgatttttattttcttaaatatcagccactggggtagatgacaacaagtgcattccttgttggctgggtatacaacacagatgggggaaatttcgactcacagatgtaagtatgcaacatcgatacacaacataacaaatgctgatgaaatcatgagatgcaccgtgatagcatcaccagctaacaacaccacccatggatcatcgggatcatctactgcgtgacaatgagaaacatcactgacgaaacccttgcaacgatttctttttagtaaacattaaccgaagctctgcttcggacctcggttgcagttcagatcagagaaactcataagcaatggacttctcttccttgagctcggtcgccgaggtttccatcttggagcgtgcaaagtcgtcaatctcaagacctggagtgcgaacaaagcgaacattcttaggctgatctcatcctgcaatgtatctgaatcacaaggattccatgagctcaccctgcacgacagaccactcccccttctcgcaggtcaccggaaacgagaagaagacgccctcggggacgccatagctgccgtcagagtaaacgcccatggacacccacgtaccctgatgaggagaggacgagcaaatgctggaattattagatgtgatcgatcggaattcggaggaaggtatgcaggggaggggatatggacctttggggttccaaggatccagtctctcatgtggtcgcatgccgcgctggcggcggacagcgagctcgactgcttccgcgccttgatcaccgccgcgcctcgctgctgcacgtcggtgacgaactcctccctcagcctgtcgacacatggtggtggagccactatcagaactcgttaccacacatgcatttttacttgacgagttccgtaccatatctcgtcggcgatgagctccctgacgggcctctcgccgcggtcggtcgagacggtggcgtggctggcgtcggggaactgcgtggaggagtggttgccccatatgatggcgttcttgacgtcgccgacgtgcacgttcagcttctcggcgacctggccgagggcgcggttgtggtcgagcctggtgaggcaggtgatgttcttggccgggattgccggggcgaactccttcaggacgagcgcgttggtgttcgcgggattggccacgaccaagacctgcaaactccggcaagatcatgctggtttgactttataatagaaatcctaataggtacttcatacgtttcatacgtttcataatgtaagtcattctaacattttccacatttatattgatattaataaatttaaacatcattttctacattcatattgatgtatatatctagattcattaacatcaatatgaatgtgaaaaatgctagaatgacttatattgtgaaatggatggagtactagttaggaacccaacataaatatcaaaagttttaactggcatccgttaggcagcaccgataataatagtcatcagtaccgattacacaattgaaacctatatcaacatataggtgcctgtttttaagtgagggccatcaacaattacttcgtcgtgataaccagtggacccacaccaagatgctagttgggtgaaataaccggcacctataatttgcgtgaagtatagtttatttgttttttaccgtccaatggccggtacttgtaccgggcggtaccaaattcctagtcgttggatctggcccgatccaacggctggtagagtttgataccaattctgtccctggtacagtaccgacctaagaactaaggtggaagggcaaaaatataattatgtgcaatagatggatgtgagtcgggcagatagggtgatatggttcccaccaacaccactgccgccaagagtgtgtcaacctcgtccacgctgcgccgtgaagaactccgcttcgtccgcccctcaccgccgggaaggactcctcctcctcgccccctcggcgccgggaaagaatcctcttctccgcccgtcggcgccgggaaggactccttctcggcccctcggcgcagggaagaaatcctccttctccgcccaccagcgctgggaacgacgactttaactctgccgccctgattgagcgcatccctgctcattttctctcccgatcctacccatccgggattgaacggtcggatgagttttggtaccgaccaattccagtaccgggcagtacaacttggtggacggtaaacatgtaaacatgctgatagtttataggtgtcgttttctattaccaaccggcattatgtatgaatatgggtgctaatcgtctcaaacagtacctcgtgggtgcacacttgaacggcaaaatcactataaatattggttctagcccgtttcttttttactgttccgtagtagcagtagtgttttagcatagaaattgtgtacttgcgtatacgtgatgcgtcgtcattcaccttgcagtttggggcggcgtgctgatggagcgcagaggcctgggatttgtagattgtcacgttcttgctaatcaaatctttcctctccatcccgtctctcctcggccatccaccgatgacgatggcgacgttgacgcccttgaacgcctcagcctcgtcactcgtcgccaccactcctacacaattgaagcatcatgttttatactcgggcgaccagcgcaacgagggaaacttgaaggtacaaggtcacgcacctctgagcagcggcagcgcagcgtcgatcagttccatcctgacgccgttcagagcattggccgcgaccggcagatccagcaggtggagcaccaccggctggtcggctcctagcatgaggcccctcgcgatcatcgcgacaatggcataccctatttgccctgcaaaaaacagcacaaaatgtcgtcagtgaatttgttttctcgacttctggtcgtatttttggtttagctgcttaagtgtttgattagcttccgagttctgtattacctgcggcgccggtgacaagaaccttgacaggcttcttcggctcatctctcagtaaccacgggcaccattttgccagacgctggaagagggaattggatgacatcatggttttttctctgtgaaatttgtatgtggatgacaaattttaggagcctagctttgatatgggttcagctgaagcaactcatacaaatagcaccaagtaggccatacaccatgataccttactggcttaccttgatgaacttgatgctaaaggctcagattccatgctgatttctgcaagaaatggagcttcctggtgcaaactgcaaagcttggtataatgttgagaaggtgaacggaactaccaaccttggctgatgtgaattcataggaagccatttggcttattttaagcataagcgaaacggcatatttgcaaacaaaagataatttatgaataaaacttttatatatgtgttcttggcgatttaaaagcaaaagctgaaaaataaacttcaatgaaaaaactttaaaattaactttaaattttagctaataagtataagtataagcaaaaagatgagaccgatagtatgaacttgatggtctcaagtgattttgacaataataaattttacaaaattacagatactttgggggtctaattatcacaaaactacagatttaagaatgtttatcacaaaactacagatttaacgtcaaacttttcatggaactacagatttaatgcaccatatcagaaaactatagatttagtgatgaagttatcacagaactacatattctagacttggatcatagtattattatttattaaaagttataaaatctgtagttttatgataaatagtttttaaatgtgtagttttgtgataaaatagttgttaaatctatagttttgtgatataatatcttaaatctgtagttccgtgataaatttaacactaaacctgtaattttgtgaaacacgttcttaaatgtgtagttttgtgatagtttgatcaaattatatgtagtttcgtgaaatttactcttttggcaattaaggaagatgtgcgaaactgcatgcttttcttttctttggtaaacaaagtcttaaccctaatactgaactgatacaagtacacaaaagtttaatctgcactggtacgcgtagaccataacagcaagcaataggatgcctgattcaacaatcaactcagagagaaagacaagggtttaaaggctgtgtttagatccaaagtttggatctaaacttcagtccttttccatcacatcaatctgtcatacacacataacttttcagtcacatcatctccaatttcaaccaaaattcaaactttgcgctgaactaaacacagccaaagatttatggagaccgaagagcatggccttttgtagtattgtaagttcaagtgccttaattgattaatgacaaatctaactatatgagactaatcgtttcatttttatgagcctttctttgactagtctcatttggatacaaaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggagagcttattttatatttttgtttattataagatttctatcttgatttgaaatcatttttcatctcatctctctatattgtttatatcgaattattatctatcaccaaagagagaaaagattgaaagatcttggattaaacaatttgcgtaattgttactttggtgatacatgataaaccgatgtttatgggattaacctctcttttgcataagttgtctactaggttatttcccgataatgagatgcggaagacatgcattcttttgtgatgtaccttaatcatgacaaggatgaaatgcatggagataaaacgatatgtaccacttcttatctcctactttttgataggttcatatatatgatttccatgtaattgatatataagtgtgagactaatgtttactcgaatgttatcttatttagtctcatttacattgagaacatggagatcatgaaggtatatgttttatgttggtctacatcattacttcatatgccttctctatatgtataggataaatccccattggtcattctctaattatgcatacacttgcatctcttgtatatttatttgtatgcatatatttagggggagcaaatcctatacatttattgtgcatgttctagatctatgttgttcacctattatttatatcggatatttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcacaaggcaaaggtataatgtagctaagaatgttttcttagtcttttcccggtcttggtgtttggtgtagaccggatttgctagataggcgccgtactatcaataggggtctatgaagcgagcttgttgatgatcttgtgccatattagttcatatgcatgtaggtgcattttgtgggtttgtctaaacaagtgtgatgagttttctcaagtcctaaaccaagagagaagtaggcatgtccaataggagtgagtgacatcttgtgggtatgtccggtggatatcctttggagtgtgagccctttatccttgactttagttgtttttcttggatggatttttcatgggttggatggtcctttgaataagctttccatagagtccaagaacgccaaattccgagacccgagtcaagagatatcgccgttttactaacggtcggttgagctgaaaagtgacatgcggtctgaccgtgggccttaggccggtctgaccgggtctgttagccggtctgaccggtgtggtaaggccggtctgaccggccccactggtctgttgcactgatctggtttttggtggcgatacagagccgctagagccgcaaccggtcagaccgagccgacggcggtctgaccgagccatggacggtctgaccggccactacactgcggtcagaccggccaggttgagtgggcccaataatttccctgttctagccgttacaaagtggtccggtctgatcggcctcacaacggcggtctgaccggcagagcacaaagttggggatttcggttccaatggctagttttggtggttgggtatatatacctactccccagcagcaagggtaaggttttggcactccattgcattatcttgaaccattgcaagagctctcacacccttgtgcacttagtttatctagtgaggtgttagagagtgagttaagccaatccaagtgcattgcttcattgctagtgtggcacctgatcatcctcggcaagcatcctagatttgttactcttggaggttgccgcctcctagacggcttgtggaggtgttgcccggtgacctctccgaggagattgtggaggaggcccggcgccgtttgtgagtggtttggagttcaccaccttcggagtgaaggaagaactaccctagtgatcgaggcttgggtagtcctctccgtgggccggctcccaccttgcccaccccttgaccaagggggcgtgcggtggcttcgtggttgagcggtggagttgggctcgcctcaacggggattaggaaaccggcgagtttccgaacctcagtgaaaaattccttgtctcttgtctcatttatttgttgcatttacatttgtgcaatttactttcatagagacatatttgagcccatatcacctatgtttgcaaaacttaacttagttgcttagttaaccttgcacctcaccttgcctagcaacataggttagttttgtttaagtgccattaagttttaaaaccgcctattcacccccctctagtcggcctccttgatcctacaagtatatggcaccaaaatcttccgatggaagcaaatgttattgaattttttttcattccctaaaggtatgtccccacgtttgtttgtaagtatgaaatactaatcaaatagttatagaacactttaaaaataaaactattggtcaattagttatttatcatcctgcaaaaaactaatttcaaacttgatttacaaaatgtgaaaaacagaaatacacactgaatactactagtcagatttgtattccaagttgtctagttcgatttaaatttgcatgttggtgtaatgatatctcacacaattatttatgttataattgtttttagaatttttcatagccaggcagtgtatcaggtgaaaaccaagcatcctgtgcaaacttggaaactctcaatcaagtccacaggatgctcatccgatggctagggacagaggtgggctaattttgcacttaaccgcccgcaattagccatagtaatctcgttttttttgcaaatcaccccccgcccaatcccagcgtcgcttcgtgtggccggttggccgccgcgggcgtcatttcgtttggccgccgccctccgcccgcgaatcgctccctcgcgcctggccacgaatgcaggcccgcccagccggctcaactccgtcactagcccgctgaggtgcgccacgcgccatcgtttcgtgaggcccgccgaggtgcgcctcacgaaaccgtgatggagtccagcgtgtgcaacggcatggagtctggcacgcacgacatcctttctacgcacgcacgaacgcccacttcggcattggcagtggcagcccttcatgccgtcgttagtcgtttctcctataatgctttcatcttgactttgatagaaattattttgatccttgctaacgtgcctgcatgcagtggatggtgaacctgtagtcactgttgattctgcctctgttgaggctaccgccatggatcatgccgtcatcaccatcgacgccggagttggagtccaccttgaacatccaagcacaccacagccaaaatcttctctgagtataatagtaagttgcaaagaacatttgaacattaggaagagcaaggagaagaaggctggaagtggaagtaaggatacaaataaacggaagtgtcaaaatgtaagcaagcagtggatcatgatgcacgcaattgcccaaacaatgttgttggctgatatttcaagttcccgtaaccttttaagttcaattgagcaaagtactattataaacactttttttactagtggcatcattcagcttattgctgctaattttcagatcaattgtgctaaattttgagttaatcattcagcttttggattttcagttcactgcgatgttgaaaaagtttgacccaagaaggcaaattgaaaaagtttgtctttcaaaggacaatcttcactgtgactgtaatttgaacacttgaaaatattactgaatttagaccatgcccattcacaagaagttcacagataacaacattcatattcacagagctgctcacaggtaacaacacagatgacacaattcacagaattttgtatctcttgctaggacagataataacacagataacttgctaggacagcagcaacagattcctgtcaacatcttcaatctacagcaacagctcccaaatgccagaaaatgactatgcagtagcacggctggggccggggctgttgcggcggcggcgaatcgcggacgagggagcggtgactcgcgggcggagggtggcgaccagacgaaacgacgcccgcagcggccacacgaagcgacgatgggattggcggagggtgatttgcaaaaaaatgagattactatggctaattgtgggcggttaagtgcaaaattggcccacctctatccctagccatcagatgagcatcctgtggtcttgatcgagagtttccaagtttacacagaatgcctggttttcacctgatacactgcccacataaaaaggatgagtgcacatccccttaagggacaaaatgacattcccaatgtcatggaactggtttactgatgaaacaccaaaccaggtgaaatgttatgacctgtttaggtgcctatctccttctgtaatgttggagatatctaaccatttccaaaaagttatagagattatgtgagcacaaggttgtatggctcagtgcagcttgcattagaatatcagagggcttgattgtatctgcagaaacaggtcaggaaatgaacaaagaaaacatccaccagtctctgaaatgctgggtattctcaatgatatgcctaatgagataagctaaagaaccattaaggcattgtttaagcctaaacaccaaatgaagtttgcataatgaataggggcatgacaaagtatctactctttctctttcttgcaaggacctaatctatgccattattggcttgagctcgtatgaccaccgccagaagtgctaatgacattgattagtaatttggtatgaactaccagaaaccccattcccatttcagaggaaactcgtatgaattcctgattatctgtggtccataaattttttgtttcatatgcccgaagaacaagttttgtatgaaaaaattgtgataataaggagagacttggtatcaaatactactcttttttttagctttgagagagaagaaaatggtgagatagggactcgaacccaggccagggcttgctcctggtagctccctaccagtaccagatgagctatccaccgttctgttttgtatgaaaaagtgaattccaagaaactctgcacaaatgctgactgcacaaataatgagctgagcaactacagaggatagcataaagaagtttgcctggtttggtcgtctaatcatctccttcatgccatgaagtcattaccactcattctagcattatcatattgttgaaacctattatttcaattgccggaccagccacgaactcaattgatttaattgctagccttacctactccagagtgtccattggattcctgtcacaatcccttttccgaccgctctttgaactgaaccttcggtcataaattacatgaatgattggtaacaacaaaattcaggtttgggctaattaattttcgccaggctggcaaagataaccggccaagttttgcattaagaaggagagagttttacagcagcccctaaaccagaaaaggcttaggttacaaaaaaaacttcacaacaataaagacaataaacaagcacagctgctaaaacctcaggaaattaaccgccagcgattgcgctcagtagcccagcagccttccatgtttcccattcgtcgacaattgtggcacaaaggtgaaccgctgaagtagctcgtccatcaaacacacgtgcattcctttccttccagactatccatgttaccaagataaccccaacatcaaaggtcctccgatctcttgtgaactgatttgcgtgcttcacaccaccaatccaacatgtcgtccgtgggggaaacacaggagagtcccaggcaactcctgattctcgtccaaactgccctcgtgtactcgcaagcgtggaacatatgggcacatgattcagcatccttcccgcaaaggtgacagtatggagccaagtgccatcctcgccgctggaggttgtccgccgttaggcatgctccacgtatggcaaggaacatgaagaacttgcaacgggtcggcgcgcgagacttccaaatcagcttcccaaccgccgagcgtgtcttcccagtgcagaggagtgaataggctgattttactgagaaaccaccatctgtggcaggcttccaagaaaacaaatcaggctgagtagggttcaaggaaacggtggcaacaaggtcccagatttggaggtattcaaacatcgcttacagtgaaagacctcccctgatgtcgccggtccaggcatcatcctgcagcgccgaatgaaccgttctgcctctgtttttaacaaaggaacacaggattggggctcggttcaggatcgaccccccatctgggagccagtcatctgtccagaagaaggaactcttcccgtcacccagcacaatcctgcatccggccgctagacaatgttcggctttcctatcttgcggcaatgtgaaggacacccagtggcgctccggctagacacgccgcagccaaagccaccgcgtccgaagggcaatgcccattctgccaagattgatgatgcccaacccgccattttcgatcggcagacagagcttatcccaagcaactaggttgcatccacccagtgcatcctcatcccccttccacaagaaaccaagaaaccgtggtctcttgttcacatactcttcagtggttgtcttttgtaacttccattgcagggaaaacttctactactattcataatgcaatacctaagtaaagatcaacaaagtatatcacttccaatacaagattgcagaagttcctttacagccaagaaaaactgttgttcaagtaatattcagaaatttgatttctcctacatttaggagtcaaggaagagaagaagataagatattagataatacatcaagaacatgacccaacaacagtttagtcattacaatgctccataatgtttattagccaatagataagataatacatgacccgatagcttctttctaattgtcttgtggtgtatcctaacgtggttcatgtctaaacaatcacaataaacacaaagttcaggcgttcagcagaacagagtggttggtcggccaatataaaccacaaaacacgattagtttttagattatcaatcttgtggttatcatttcacgccacccataatattgtagtgaacatttaggactgtccatcaagtcattacagtcacctgttgtgtgtataaaagggggcctgaagaagggctttacctgcatcagtgtgatcaaccatctcctttgaagtcctagcctaaaagctcttctactcgcataaagaaagatggtgaagcttgcatttggaagctgcggcgactctttcagtgcctcgtccatcaaggcctatgtcgcggagttcattgccacactcctctttgtgttcgccggcgtcggctccgccattgcctacggtgagctccttatttatgtttcaaaaaacttccatcccaactctgcttgtaccacttagcacagtgatcattctatgtttctcatctaaatctttgttgtgcagggcaactgacaaagggcggcgcgctagacccagctggtctggtggcgatcgccatagcccatgccttcgcgctgttcgtcggagtttccatggccgccaacatctccggtggccacttgaaccccgttgtcaccttcggcctcgccgtcggtggccacatcaccatcctcaccggcatcttctactgggtcgctcagctgctcggcgcgtccgtcgcgtgtctgctctgcagttctccacccacggacaggttggtttccatcatgctgccacgttgttgtgctttgtacttcgcacttgagctaagtgaatcgggcttgctaattcgcaggctatcccgacgcacgccatcgccggaattagcgagatcgagggcatggtgatggagattgtgatcacgttcgcgctggtgtacacggtgtacgccacggcggccgacccgaagaagggttccctcggcaccgtcgcgcccatggccatcggcttcatcgtcggtgccaacatcctggcggcggggccctttagcggcagttccatgaaccctgcccgctccttcggcccggccgtcgcggccggcaacttcgccggcaactgggtgtactgggtcggcccactgatcggtggtggcctggccgggctcgtctacgacgacgtgttcatcgcctcctaccagccggtcggccagcaggaatacccatgaagatcatcgaatccgaaccgtcgctgctgttgattccaatttccatccatgtcacgtctcgcttccttttgtatatggtcttcccgtttccttcctttttcgtttttggttttgaacacaaattctcgtgaagaagatgtaagatcaatgtgtgttttaattcttattctgtgatgaacaattggcatctgtgattattggttttgatatttggagattatcgtcgaagttgttttggagataatcaattttcaggtgatgatcggattcactgttattttatgtgaccggtctgaccaggctgtgtatgccggtcagaccagcggtgatcgagcggtcagaccggccggcccgcggtctgaccggccgacgctgtgtcggtttcggtttcgggttgtttctttggatatccgtgattgtttcatggttatggcttctagatggatactatacgtatgtaatactgttgtttgctaacaatgagtcaagttggtgatagcttggtctcggaatatagtttctttatttgtttcatgtgtaggtgactcgatgcctagggagagtatttgcggtgatggaccgggagtcggcttggtggtaagacgatgtccgtggtggtcagatattatgcgggatactaaggctagagttgatgcacgtggttggtgaagattccatatggcatacgatggaggtattgtgtgcgtttgggatgcggagtcgaatttggaaggagtccaaatttggtacaattggttatgtaaagtttgtgtcttgtactagagagtttcctaaggtgtttaggactcttagtatgagtttggttcgtggctttaggctgcctacctcatgtataaatagagggggagcgtgaggcttcccggtatcgcttttgtattgcttttgagagcaattgagttgctagtttagttagggtttcgagtttggtcaaaatttttataaggagtgctgttggtgcactttgtaaacacagagagaatcaataaagttgtcatctattttaagagttcttcgatttgtgtttcaccgggtttcggcggtctaaccggcaactcaccggcggtcagatcgacggcattgcggtggtcagaccggcgggagtacggcagtcagaccggcagcagcgacagcgagcggcaggcgacttcggcggttcgaccaatcgttctacatcggtcagaccggtggcatccactcggtcagaccaacagattaatctcggtcagaccgatctccgtctatttcgagggtaacttttatttccgctaaaagtttttggtttttgggtataccaaccattaacccccctctggttggcttagttcttgtgattcgatcctacaagtggtatcagagctttttttgcttctttggattttaaccgatctagagtttttgccatggctgcttctaataagttttcaactaagcctcatgttttcgatggaacggatttttctcattggtgtagtaggatgcaatcttacattatggctgagaattatgatatttggagaaaagtttctcttccttatgtgattcctgaagttattaatactgctgctgaaaaaattgcttttgaactgaattgcaaagctcgcaatattcttttgagtgggatttcttgttcggattatgatcgtgttgctcatcttcaaactgctcatgagatttgggttgctttgaataattttcatcaaggtacaaataacattaaagaatttcgtcgtgatcttttcaaaaaggagtacattaaatttgagatgaaacctggagaagctttggatgactatctttctaggtttaataaaattttgagtgatcttagatctgttgattcttcttatgatgctaattatccacaatctgagatttctcgtcactttttgaatggtcttgacatgtctatttgggagatgaaagttacttctattcaggagtccgtgaacatgtctactttgactttggattcgctttacacaaaactgaaaactcatgagatgaatattctttctcgtaaaggtgattctaagtctagtgctttggtttcgtcttcaacttctttggatgttggtgcttcttcatcgaagtcttctgttcttgctttatttaatgccatgtccgatgatcaactcgaacagttcgaggaggaggacttggttttgctatctaacaaattttctcgagctatgaaaaatgttagaaacaggaaaagaggagaaccaaatcattgttttgagtgtggtgcacttgatcatcttcgctcgcattgtcctaagcttgggagaggcaagaaggaagatgatggtagagtcaaagaggatgacgtgaacaagaagaagaacatgaaggagaaggagaagaagaagcattgtatcaagtggttaatccaaaaactcataaaagtttttgatgaatcggaagatgaagatgagagcaaaggtaagcaagttgttgatttagtttttattgctcgtaatgcaagttctgatgttgatgaatctgatgatgataatgaagaaaagcttagttatgatcaactagaatatgctgcttacaaatttggtaagaaacttcaaacatgttctattgtgcttgatgagaaggatcatactattgagattcttaatgctgaaattgctagattaaaatttttgattcctaatgatgataattgtcaatcttgtgaagttttattttctgaaattagtgctttgcgatatgtcaattctgttaattgcaagaaattggaatttgaaattgaaaaatctaaaaagttggaatcttcttttgctcttggatttgctttacttgctcgtgttgttgatgagttgattttgacaaagaatgttttgaaaaaaatacaaagtggctttttgtgcaagttctttagtcaatgtttcatgtgcaaataaggcaaaacaaaacgatggtgttttgatttctcaagattgttcaaagatgacggagcgtggggctcctcaccgggagaccgcgcgggcccccctttgctggttcggccgggggcgctaggtgagattctaagccctcgatttgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagagaccctctcactctttctctcctctacgagctccgctctttcttttacgagctctccttcttttctttctcctttcttctctctttttcctcagtcccctctcttgtaggcatggtcctccttttatatttcaaggggataccacatacaccatttttacctacccttctttgggcggggacgccatcctactttgaccaaaacttgggtcgtaccttcgcctgacaccgggataaccctgtccttccttcattaatgggcggagatttgcaatggctgctgtccgaatgaccctcccatgggatgggtcataccaacctccactccgccggaagcaagtgca

SEQ ID NO: 33340 - DNA, 3180 bp, Oryza sativa
ctatgcccggctcctcgcttcccgcgcccactatctcgccccctcgtttctcgcgcccactcctccactaatcccgttcgcccgtttgcggcgcacgaggcggatgtgcggccgtggcagtcgagatgggacatatcgtgcgcgcgttaactacgctcgccgaccgatgcaccatcatcacatctctaggcgaaacgaaccggttcgtcccgattcgcgcgctactcaagtaatgtagcggtcttgaagaggccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctagcgtgacgccggcggctactgtcggtgacatggggccaggggtatcgtgactagaggcttgggtagccgcgatcactcacgtggcccgaccccctcgggggggtcgggcccaacggtgacatggccacccctccctctgtctccccgaggggtcggccgctcccgtttcggccccgagggctggggcgccccgaccccctgtggcgtcggcgccacgtgtgtgggttaggtgagcaaagcggccctcacctaaccacatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgctccgtcccgtcggaatgatgagagcctctaggcactcgtccctagacggagccggcgtgggaactcctggagttagcacatcggtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaacaaccgtgctcccacgttgcacctgcttccggcggagtggaggttggtatgacccatcccatcggagggtcattcggacagcagccattgcaaatctccgcccattaatgaaggaaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagaggggactggaggaaaaagagagaagaaagggagaagaaaagaaggagagctcgtaaaaggaagagcggagctcgtagaggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccagcaaaggggggcccgcgcggtctcccggtgaggagccccacgctccgtcatctggcgcgccaggtagggggcatgtgtgtttttctaagctctcgtcctctttcgtgtgcgccaagcttttcccgctcagcccaatggccgaacgggcagtggcgcacaacctctctccgagcgctagcggtgacgacggggagcagaacccacgccgtcgagctcgtactccaccgcccccctctcgccgaagtcttaggcgggaggaggcgctcgagggggtcgaaagatccgcgacttcgccgcccacgagcgatggagaaggacggcgagacggggagcgtcgcctcctcgtctacggcgatggtagcacgccccagggcgcgctccaagctgcgggcgtgctcttgtgtcacccgcccgtcgtccccgatccagagactccagcccaacgttggctggatgacgtggccgacttggtcatgacggcgtagcatcgcctaggcaccggtgggcggtcctccgccaccaaggcctctggcgctgctaccgccggctccgtgtcgtcaaggcggagggcgcggcgagcggcggccgttacccgccgttcgtcagccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagcctcctgtgcccccggttggtggtgtcggctgtcgagcctttgtggcgagccttcggaacgtccgttggcccccaaggttccggcccaccatcaccgagaaatatgacggaagcgtcaaccccgccgagtttctccaggtctacacgaccgggatcgaggccgctgggggtgacgacagggtcatggcgaacttcttccccatggccctgaagggacaggcgcggggttggctaatgaacttgccgcccgcgtcggtccactcttgggagaatttgtgccagcagttcaccatgaacttccaaggcacatatccgcgcccaggtgaataagcggacttgcatgcggtacaacgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgttctcgccgtcgagggcgcttcgcgggccaaccgaaaggggaagcctgcgagcgacaaaaagaagaggccggcgcttccagcagggagcgcccgaccggcaagtggtgcaccgtgcac

SEQ ID NO: 33341 - DNA, 7599 bp, Oryza sativa
tacattcagcggctctgtcaagtccgcaacaccataccatgcatccccgcacacgcggtaatctacgcgttcagggggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacaagggtcacgtcctcgccgtcgagggcgcttcgcgggccacccgaaaggggaggcctgcgagcgacaaaaagaaggaggccggcgcttccagcagggagcgcccgaccggcaagtggtgcaccgtgcacaacacctccctccacgacctcgcggactgccgcgcggtcaaaagtttgctgagcggatgaggaagtgggaggaggagaggaggcaggagcgccgtgagggcaaggccccggcggctccctccggcaaccggcgaagtgaggccaagcagaaggcccccgccgaggacatcgacgatggcgacgatgacctagggttccaggagcctggggccaccatcgccaccgtcgatgggggagcatgcgctcacgcttctcgtcggagcctcaaggccatgaagcgagagcttctggccgcggcccctacccataggcgacgcggcgggcgcggtggtcggaggttgccctcaccttcgaccagaccgaccacccgccgtgcattgcccggggaggacagatcgcgatggtggtttcccccaccgtttgcaacgtgaagttggggcgtgtcctcatagacgggggtgcagccctcaacatcctttcccccgcagcctttgacgccatcaaggccctggggatggtgcttcggtcgtcccagccgattataggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccaggccccggtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggaggttgccctgggcgacggcccgtctaagaccacacgaatcggtggtcttctggacggcaaataggaagacgcgctcgtctccttcctgcgggcaaacgccaacgttttcgcctggagaccggcggacatgcccggggtccccagggaggtgattgagcaccgtcttgccgtgcagccgggcgcaaggccggtccggcagaaagtgcggcggtaggccccggaacatcaagccttcatccgcgaggaggtggcgcgacttctggaggccggattcatccgtgaggtcatccatccggagtggctggcgaacccggtcatcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatacaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctggcggcaaccccgcaggtggtcagcgcggcgttggttgtggagcacgacgaggacaaccctcaccccgcgcatccccaccctgtgtcgactcgacccgggagagagcagggaggagaggcccccgagccgaacgcggcccgaggcccccgacggccggagctggccctccgcctgcttgtcagacggtgccaggcgcccccgacccccaggatggccccggggccactgcgggaaggccgcgcctgtcgccctccgaccccgaggtcgtcggcacagaagccgagtgcgccccgcacgacctctcggacgaagagcgccctggagatgcggcccctagcgaacaggatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttatcccctcggccaaatcttgcataaccgagagggtactggacgggtggtgaaatgggcaatcgaactctctgagtttgatttgcactttgaaccacgccacgcgatcaagagccaggccctcgccaactttgtggcagagtggaccccggcccctgagcccatctccgtccccgagaccagctcgggcccctcgcagctgcctcccaccgcctactgggtgatgcagttcgacggctccctatctcttcagggcgccggtgcgggggtcacgttaacctcgccaaacggagacgtcctcagatacctggttcgcctcgacttccgggcgaccaataatatggcggagtacgagggactccttgcgggactcagggtggcagctggactggggatccgccgcctcctggtgttaggcgactcccagctggtcgttaaccaggtctgtaaggagtaccggtgctctgacccgcagatagacgcttacgtgcgccaagtgcggcgtatggagcgccaatttgacggaatagagcttcggcacgtgcccagacgggataacgcggtcgccgacgaactctcgaggctcgcttcctcgcgagcccagaccccaccgggcgcctttgaagaaaggcttgcccagccatcggcgcggcccgaccccctagaggagacggacgcgcctgaacggcccccgaggcccgtcggagtccaggcctcgggacccgaggggagcgctcccagctcccttagattgattgcttggatcactgagatctaggcgtacctcacagataagactctacccgaggaccgcgaagggagtgaacgcgtccagcgcatctccaagcgctacgtgctggtggaagggaccctctatcggcgcgcggctaacggagtcctcctgaagtgcattcctcaggaacaaggcgtcgagcttcttgccgatatccatgaaggcgagtgcggagcccactccgcctcacgcaccttggctggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcacaccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaagaagcacggcgactcgtggatcgaggagttaccagcggtgctctgggcgaaccgaaccacgccaagccgagcaaccggggaaacgcctttcttcctcgtctacggcgcggaggcagttctcccattcgagctcaccctgaggtcccctcgggccaccatgtactgcgaggccgatcaagatcagctttgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtactacgccgcgtccaaacgcgtgctggactgagcaaactctcaccaatgtgggagggtccgtatcgagtgatcggcgtcccccggccgggctccgttcggctggccacggccgacggcacagagctgcctaatccgtggaacatcgaacaccttcgtcgcttctacccctagtaggggtcaggtgtcaggtctcgggctcgggccaaccccgcgccctcccaggcgtgcagagttggccgggggctaccacatgcatatccttatcttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataatcctcggtcaccacgttcccggcctggccagtctcgacacacggatctccccaggcactagccccgacccgcgccatttgaggctgggacctgggcacgagccctcgttcaagccaagacacagaaggaccgcggcacagaccatcctcatctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcatcgctgtcgtccgcaccaccgtcaccgccctcctcgtcggagtctggcctcttcccaagcggcttcctcagcctggcgagcccggacagcctcctgggcagcttcctcggcttcccggaggcggtttgcggcttctcgccggtcagcttcccgcctccgggcctccgtggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggatgaacctgcgaggaggtcggctaaacgaccaccttggggggagatgagctttccccggcatggttcggtcccccctatcttgcggagccgcttcttttttcgctccccctcgggctacgacgtcggcacagcaccctccgggcgcctgctgctggcacgcaccaccccgccccctcggggaggagatggggagggggtatcctcctgtttcctcttcccccgggcgtcggcagggcggctgccccccgggcccccgtcacggggcccagaagcacgactccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcgggagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaaaaaagaagagaatggggggaccagccctgccattgcgaaggaaaggaagaatacggaccgccccgggtagtgtggcgccgggcgtccctcacccagcgcaaccacctcctggccggtggcagattccggcatgaatcggcgcggcagcccggcttgcctctcgctcacgatgcgagaaggcggcagcacgctaccgtcgagcggtgcggagccccgtgccatgacaccggcggaggaggggtttgagagcgagtgagtgcggcgagggtagggcacaggaaacgagaagttagagcgcaagcggcgaaggcaaggggaataatggcgaagaggaaggaaacgaatctcttcctcggcgtctttatacccttgccaacgctatgcccggctcctcgcttcccgcgcccactatctcgccccctcgtttctcgcgcccactcctccactaatcccgttcgcccgtttgcggcgcacgaggcggatgtgcggccgtggcagtcgagatgggacatatcgtgcgcgcgttaactacgctcgccgaccgatgcaccatcatcacatctctaggcgaaacgaaccggttcgtcccgattcgcgcgctactcaagtaatgtagcgg

SEQ ID NO: 33342 - DNA, 647 bp, Oryza sativa
atatatgtctagattcattgacatatatgtgaatgtgggcaatgctagaaagtcttataatatgaaatggaggaagtataattttaaggtctcaacttacctatcatccttccagaatgagtggtgatctaactcaggtacaacaagtgtggcattcaatattcgggcgacaacaacagcatctgttatctggaaactgaagatcgtaatggtaatacaatggataatacaaagcaacgcaataaaaagttgaaatacagttgtacccctatgcgctgctgatttagtcccccgctagtaccaatcagcaagtaaccagtagaactgttctccggcacagcagctgaaagatgaacatatggaatcactgtgttaaatattcttccactcatctagttataattgtccaaaagggaggatgatttaataagcaaactaacatctgaaatttacgctcctcctgctgcagcgttatgggcggggccgtttcgacgttcccgtgtcactgtgatactcgtcgcgtgctcgcgctcgcagcagtccaacagaatgcggactcgcccaatcatggtacggcaacagtgtaggaatatatgtactgtttgacgattatgcaacctgcagtatgtggtggttgtaacttgtag

SEQ ID NO: 33343 - DNA, 13262 bp, Oryza sativa
ccatgcctctactgccctttatcatcttatcccattgttgagatatctgctacatctatcatggaatttttgtgagtcatacagcacttctgatcttagtcaagaaagctccaatgatgaaagaagcaaatgaaaattctttagttttgttcagcctcatcatgtttgtatttaaaatgcacctagtatgcagtgcactatcttaaaaaaataacagattcaaacattcactttcatttgacactatgccagtacttcctctgtctcacaaaaaacaaattagtataggatgtgacacatcctacctgttcctattcgtagtactagaatgtgtcacatcccatactagttttttttatggggtggagggagtataacttccctgtcccgtcgcttcgtctttagatttgaatgtcagcagctcgttaacggtatgacaatcgattgacatttatattttcacttattgttctatttattgtattttgcattattttttattattcatgacttctatgaaatcaacctgcatatgtatatctattgtagcttacatatattttttaagtattgaatattgacatcaaggtcttagtttcctctttttgtcttgatctgttttaatcatatcataaatgcaaaggtaccagcatggtgtggtcaagagtattatagtttgcaaacaagctgtctatttcttatggccaacatagcacactggctatttatatacaatacaatttgctttggtattgcttggagttcggatcattgttcaatcccagtgtccagtcggttactgatggtacacataaaactttgtccaaaacatgcatcgcaatggacaaaatagattctgagttactgtggcattccgcctatggttatttatgtctgaacttggaataatatatcacattcactgttccaaatactttacatgttcatacgtctaaaaattttcgtatcttgattggaatcatggatgctgcatccatactgcttgaacatctttatgtgaagttccaggttcacactcaacttattttgttccaggtttttgtcattctttttggagttggcctggtgtgatatgatagattgaactgtgaaccacaagtgaatggagaaaatgacttgatttggcaccactataccaaggttctagctgtgactcatgaggtttggagaaactgatggcattgagggctggactggtagagctctgggtccttgcagacatcattcctctgttctttccaccaccatggcatggtcagagcaaattccacttgcatctaatggaacggtgccttcttttccgtatttaagtactgtattagtggaaactttcagtctttcattgtgccattcgtcatttctgatctgttgtgtgagagaaattttgagaaaagggaggaaaagctctaccccttcacttggcgttacagaatctattcctcattatgttgtctatttactttttgtgcgatactgatacggtaagcatatcgtagtgctgtttagtgtctgttgagcacttcagccccttagaactgttgtgcttagcactacaatgcttgcggctatataataataagacataccttcagatttaaggggccatttctgtttagcttgatttttttccccaacatgttgttctgttcattcctttcggtcagtgtttgtggtagccatttgtcgttgcaatcagtgtttgtagtaaccattccattagcgaaacactttgctgtcccttaggtgctacagtgtcgagacttgccagtgttcagcatgtatcacgtttttaggactttcagagttcatttagaaatcatactacaaaacgaaaggacgtcctatctgctgcggatgagttgattccgttgtcgaatttgtctgaatcattggctagggatgggctaatattgtctgaatcattcgacaacagccgatggctcttggggactggattgtgacttgggagaagtttcaaactttccatccttttccaagattattatagctacaggttctcagataaaaaaaaaggattactgttactgcaactagccttgtattgttctaacaggcccgtttatatatcttttaaattacgtagagacactgcctcactattattattgtttgtcactgttcgatataaacagtgtagacgcattaccgattattccaatactgcaaacagtccttggattccattccttaaatgccaacgattcctggtccaaaacactccaaaacgaaaccgaaagaaattcagatttaagcaggtcatctccactgcacatactactcaaagagatgcttaattatcaaaagagagtaaccatttccttcttgttaaatagattaatctgatattttagaacaactttcatattgaaaattttcgcacaaaacacaccgtttagcagtttgaaaaatgtgccatcaaaatccaaaacgaacggggcctataactgcatattctccggggaaaaatattgaactggaattagccattgttcaaacaggcccatttatacatctctttcaaattacgtgggcacactgtctcactttgttttgtcattgttcgatataaacagtgacgtattaacgattattccaacactgcacacgatccttggattccactcctaaaatgccaatgattccatttccaaaaccatccaaaacgaaaccaaaagaaacacacacaaccaaatctgtaccactaggcaggtcatctccactgcacatactactcaaataaatgcttaattatcaaaagagaggaccattttttttcttgttaaacaccaatagtactagtaggtttatatttgtagagtactaggtaactcccttcaactatatacttgatttaaagcacgagaaacgagccaacgaccgaaggaggccaagtccaaagatggcaacacaagcgattgcaccgatgcacgccgccgtcgtgcaccgccaccacgttctaccaccccgccgctgcgtgcgccgccgtggcgtcttcgtccgcgcctcggccgccgccgccgccgccgccgccgagacggacacgctgtccgcggccttctgggactacaacctcctcttccggtcgcagcgcgacgagtgcctcgactccatcccgctccgcgtcaccgagggcgcgatcccgcccgacttcccggccggcacctactacctcgccgggccgggcatcttctccgacgaccacggctccaccgtccaccccctcgacggccacggctacctccgctccttccgcttccggcccggcgaccgcaccatccactactccgcgcggtaagtcgcgccgcgcgcatgcagcagcagcaggtttgtcagtgagagcgacagactgacagtgcacgcgtgagtgacgcatgcaggttcgtggagacggcggcgaagagggaggagagccgggacggcgcgtcgtggcggttcacgcaccgggggcccttctccgtgctgcagggcgggaagaaggtgggcaatgtgaaggtgatgaagaacgtggccaacaccagcgtgctgcggtggggcggccggctgctctgcctctgggagggcggccagccgtacgaggttgacccccggacgctcgagaccgtcggcccgttcgacctgctcggcctcgccgccgccgacgacaacaaggcaacgaacgcgtctgcagcacgacggccgtggctgcaggaggccggcctcgacgccgccgcgcgcctgctgcgccctgttcttagcggtgcgtgacactgtaccggagcagcggcctccacttcgatcgattcggaccgaactgatatgacgctggtgcgcgcgtgcgtgcgtgcggtgcaggggtgttcgacatgccgggcaagaggctgctggcgcactacaagatcgacccgcggcgggggcgtctgctgatggtcgcctgcaacgccgaggacatgctcctcccgcgatcccacttcactttctacggtcagctcgccatcgcctcgaccaaccacgcattttccattcgctcctccaaaaaaaaaaatcacattgaacggcgtttccatggcagagttcgacgcccacttcgacctcgtccagaagcgtgagttcgtcgtgccggaccacctcatgatccacgactgggccttcaccgacacccactacatcctcctcggcaacaggatcaagctcgacatccccggtaaggaagagaaaacaaaagaaaacttgtccatggaatgatggaatcgtgcgcgcactggcgtctgatgctgacgtttggtatgcttggttggtgccgtgttcgggcgtaggatcgctgctggcattgacgggcactcacccgatgatcgcggcgctggccgtggacccgagaaggcagtcgacgccggtgtacctgcttccgcgctccccggagaccgaggcgggcggccgcgactggagcgtgccgatcgaggcgccgtcgcagatgtggtccgtgcacgtcggcaacgcgttcgaggaggcgaaccgccggggcggcctcgacgtccggctgcacatgtcaagctgctcctaccagtggttccatttccacaggatgtttggtaaatttcaacgccacaaaaaaaaaaacagtaatccatatttgctcgttcttgcatttgcacattgctggaacacaacgatcatcgagtgatctgcatcacaggttacaattggcaccacaagaagctggacccgtcgttcatgaacgcggcgaagggaaaggagtggctgcctcgcctcgttcaggtggccatcgagctcgacaggacgggagagtgccggaggtgctcagtcaggaggctgtccgatcagcacgccaggccggcggacttcccggcgataaacccaagctacgccaaccagaggaaccggttcgtctacgccggcgccgcgtccggctcccgcagattcctcccgtacttcccgttcgacagcgtggtgaaggtcgacgtctccgatggatcggcgcggtggtggtctaccgacgggcgcaagttcgtcggcgagccggtcttcgtcccgaccggcggcggagaggatggtggctatgttcttcttgtagaggtaagacggagtgcccgttccatcaacatgaagtacgagtgttttgttttttcttaagatttagtacaaatgtttactactgaattaacatcaagacatgtgatgtctctttgcttcttgacagtatgcagtctccaagcacagatgccatctagtggtgctggatgcaaagaagatagggacagagaatgcacttgtggcaaaactagaggtgccaaagaacctcacttttccaatgggattccatggtttctggggagatgaatgagcatagagcaagcatcagatccagtctaactctggagagaaattgtcttgaaaaggcaagaattttgcctcgtgtattgataaaagagagttttgtgataatctgtacatggtggagaggaattatcaggggaaccaaataactactgtacatccagtctcggaatgaaaattcgtctcaccaattcattaaaatcctgaaatactaatgttttaaggcaataattcatagtattcccatagggtaaacatataagacctccactgagaatcttgatgtcttggcaattttaaaatgaaagttcttgaactgacaactaagaatgataccatccatgatcttaacccattcgacaagaatttaaaaggctagaacatatcctgtacacagctaacagaccaccaaatgtgaagtcgacgaatttttggcatcacttaatgcgagccacagtcaccacaatgaagacgaacactgcgagcatgaaggacattctcactgtatcgtcatacaaatcatagtcctcactctgagcttgaaagagcatgttcacaagcttaagtatgctctcaaggaattccttgatctttgcttgggtggtttccatgacccacttcatcactccaggagaagcagaagaacttccattgggatcagcctccttagctgaacgaaagtaccaaccagattaatatcgcttatccaggcccaaattgatcttttattttattattaaaagatgtacttaaaatgctaaagctaaaagccacataccatcctgaaaggacttcctgaattcttgcaccacctcatttttcatcacggcatcccatacagacttatcagttgacaaggccataaccattttctgcatgttgggagatgaatgttaggcaaagaccgaaagaataataggtcatctctggaaaataatatttggtgctaccaaacaaacaagttcatcattgctatacataaataggaactgaatcaaacccacattcacctggacagaagaatctacttgcaataggtggaatgcatccagcacattccgatgttcccttgtcaaaagagcagttgagttaaggacaagcatagcaggttcaatacattcctctgatgcagtgtctggtgtagagtgttctaagctggctaattggtcaatcttaacatcagatggagtagaatcctcaatcttaatatcagatggtgtagaaccttcagaaaaataattaacaaacattccagatggaggaagtcctgagatgggggacaatgcaagtgcttgggcaggtgcatcagaatccaatccaggatggttttcaaataccctgcatgcaacagaaaacagtgtgtgtttttttatataaaatatgtaaaaccagattgcataaaattaatcaactgaagagctgataaggtctatcaataacagaggggataacaaagcaatgacgagcatgtgtatgcagttggagaagtactacaaaaattgcttcttttagcaggataagttgaaaattggagatccaaccgcattgtacggcattccacatctagacggtgcatacacaacgatttcaggaacatacaaacatagcttgaccgtggctataggcataataacttccacgcaacaaatttgtaattaaaggacgattatcaccgataacaaaacatggaaaacctccccccccccctttttatattattatagaagaaaatcaattagcaagtaattaaacaaggcagttccgatcttttctagataatcaaagatcaaaacttgtaaacctaagagcatcaagtagaatcttactcttggatgctagcaacggcggcgcggacttcctggtcggtgggcggggccccgaacgcctccgcgtgctcatccgccgcctcctggacagcgtcgaacgccccagaatccgccccgacggcgtcatcgccctgggcgacgaccacctcccagtcctcatcgccatcaaggcggagcgcgcgggactcccagcacccgacggaggcgatggagcaagccgggggaggcgaggcggcgcgcaaggcacgggccccggctcgcgtggcagggcggctcccgctggagatggagacggcgggagacagggcggcgccaccgcggagcgaggaggagccggcgaggcggacgaggtgcttgccgccggccgggttgctcatggcggcggcgccctggtggagcctcgcggacgtctcgccccctctccaagagctctccctcctcctgtacaccacgtggacaaccatggcaggggcctcgccgtcgccggctcgcagctgatgctcctctgcctcccccgccgcggtttgttcctcttcgccttccggcgaggcggcgtacgaagtgggaggaaccggcagatttgtttgggttccggaaccaaatcagtattcggtttattattaagatgggtggggtggtttgttaactgatgatatatttccgcaggggaagtgtttgaaagtacaactagtaagttattatctctatctctttctaaatgtaacttgtagcatatagataaataaaagaattaatttttatagggtgtagctatatttatagcgccatatttttcatcaaaaaatagtcggcatgtatttacattgtaagtccctaaattacatatgtaattttagtgtatttacaatgtaagtctcaaaattacatatgtaagtactaaaattacatatgtaaattcaaaaattacatgctaattgcatatgtaagtggggtgtaaatgaggtgtaactactgtgtaagtggctaaaaaaaatcgactgtagcatatggcgccatatttctagcaactccatttttatatctatctttgtgaatgtttaactattaaatgaaataatggacttttcatatctactttgttaattgtacatacgctagtttttattttttttagcaacatatgtagtgacatactaatttttaatatatcacattgtgtttatttttttagcaatatatgtagtgacatagtaatttttaattgtaaatgtgcttttaatatatcacatttgttgattttttgtgtaatatttgaagttctacatttgacacatgcacttgtatttaggctaattattctttaaatggtgacaacgtactcgtagacaagggggtgcccgcgatgtctatgtcaatatcaagatttactagccaaatatttatgagttgcttttatggtaaggtgtgcgtgtgaatgttcacgagggtgaatatgcgcgcattataagtgtctgtgtttatattatattttttaaaaaatatattatttaaatattagttcttatttattttatcattaaatatacttaacattgacttatattttttatattagcaccaaatttttaatgacaccaatgagcaaatgaaaaatcaacggtatcatatatgagagtatatgaataattttatggcttgcctctccacataatatattatcagtaattttttatcttaatgtattgtagaaaaaagtttatatatttctgcaagaattcaactagagaaacttccgcccatcataattgccaaaatattttaaaatataaaaaacgaatctaaagctttttaaaaatgaagggatgtcctctttatttttccttctctcacaaggcatcgtgcaatacagttcgttgtttagatgtctattcggtcttatttactactagtagcgagtatctacgtcattttcgcttttagattagagaatgaagcttatccacgttgcgtttagcattaggttctgcaacaacgcatttacaatgcgtctatgcgctcgtatatattagtctcgatgctttctcactgacacgtggacacaaagaatatagggacgaatatatcatccccgacgtacctgtctaactgatcgtaagaaattaactcatttttgataaataaaaacaactgcgtgccgcccaaggctttggtgttgcttactctaatacttctactttattcgatttaggagtagaaaattttatcctttggtttgacacggttggcatgactgtaatgtatgccgcatttgctacacagcatattgctgcgacttcaggatgtcgagatcgaacatcatatgttaaaggggatttggtcgtatacatctctgtagtccctaaaaaaaaattgaacatctctgttacagaaaacgggttgggttccacgatcactgcgggcggggtgcgtacgcgattttgtggtataccatcacatcattgcaagaagcagtatggataaatagttttgctctgctccactaggattaacgagcctccactcttgatcatcgtattgattttgcgtgtaaccagcagcgtccgccatgagcagtgcttcgccctagatcgtccaagctgtatgctactacctgttggtgctcccagcgtaacgagagctcggagttgacgaattcagagaccaaaaaaagagacgtggggatcacagtatatcagacggcctcacgtcgctttccagatggccgggtctccgaaccgtaacgcgagaggagacatggtgcgcagcgccagatgagagagacggcgaagcaaaccaacccaaaggatgagattatgttgagcacgagaccatcaagcaacaagcatacgccgatacgcggattgtgcggcgagatctcctaaccaatatgcgcatcgattcgacgggagctcacttgggttttcgttttgttctccccgcgacgtttagttagtttttcaccgtttagtgtcgtggattacgtggtgagaaataccagcgcgtttaaaaacgtgtgcgtcgatataaaagattacatgcgaagtttatgaaaacacttgtttttctttttcttttttcccttttattatgggcttccatcagcagcgtatcgcaagttgcaatttgcaaccggatacttatccatgacgctcgggctggtgaagaccgcggtttttgcgctgcttgtgcttattgttacagaaaaaaaatccaacattgattagattatcaaatggttcgtgagacacacagtagctacgagaaaacagaagaacggtaagacgtcgtttctccaaacaatttgacgatttgataatatgtttcaattatgcgtagcattctcccttgatcaaattccggtgttgctctgctgccagttttttttttcgccggtctgctgctaaattttgcagttctacagtatgcacttctccggttctgcactagtactatcaggtactagtactatctacaaggccattgttgacttctggaccgtctatatgattagcaggagcccatttgacacaaaagtattcggccgattttgttgggcccttctatattttagatcaaaggaagcccattaacaaaagtactacccaaaccatccattagtccatcacaattcactaggatcaaactgcctactatactagattacattgctttctttccttcaaacatccacaaatccacaacctaataaagacacagatcttacacacatactacatgtaactacacgaaaccaaatgcaacaaagattctaacacgacaaacaaagatttttcgtcagggtgacagactgccagaatgatttcatcacacgaccaccgtttgcacgctcccatggcgcgccgactcgttcgtcgccggcgccggcgccggctccggcacggtcgggaagaccagggcttgatgcaccagcgccgccaccgccgcgccgaccatcgggccggcccagtacacggcctggttgctgtagtgcccgctgacaaccgccggcccgaacgagcgcgccgggttcatcgacgcgcccgtgagcgaccccgccgccagcacgcacgcgcccgtcacggccccgaccaccagcgcgcccagcgccgtcgccgcgggccccttcctgccgccgaagcctccaccccgcgggtcgccggcgacgtgcaccgtgtacaccaccatgaacgtgagcaccccctccaggatccccgccccgaacccggtcatctccaccgcgatcctcgtcgtcggcacggcctgtgtgtgcaaacgcgcgttagtctacgcaaagttaaggacatttcgatcggaagtgatcttgcctggccggcggagatgtagtgaaggacgaggcaggcgaacgtgaacccgagcatctgagacgcccagtagaagatggcgctcgggacggtgatgtggccgccgatggcgtaggcgaacgtcacggcggggttgacgtgtcctccggagacgtcggcggcgatgaacaccgcggcgaagagcccgaacgcctgcgcaacggcggtcgccatcagggacgaggcatcggatgtttcatccggcgtgagcatccctggcaacagcgcgcggcaagttcacagagcgaaatcacgtatgagaccaacaaagcagagcaattcgcacgacatgcggaacgtaggttgcagtgaaacgcatgacttacgggcggagatggtggagccgacggcgatgaacacaaagaggaaggtggagaagaactcggcgaagtacgcccggagcgccggcggcgagaagcagcgcttcatgttggcacagatgttcgccattgcaagtttaccctgtgtgtgtgtgtgacactgtgtttacagagcagtgaagaacacgattacaggaattcgcacagttcttcactactcggggtgtcacagactttatatagaagggccatgggtcgcgaccgtagggtgaaacgttgctatacttcgcagcggttgccgccgcgcccgctcccaaactgaaccgtctccacgcgggcacgcccgttgcgcgcgttcgcacaccgcatgttagagaacgtgtacgtgcaaacttcacaacttacaatgaaccgtgcatatatggtacagatcaatcgagcagttttgctacatattcttttgtaggattgaatcacaataactaagccaaccagggaggtgaatgtttggtatacccaaaaaccaaaaacttttagtggaaataaaagttaccctcgaaatcgacggagatcggtttgaccgagattgatctatcggtctgactgagtggatgccgccggtctgaccgatgtagaacgatcggtcaaaccgccgaagtcgcctgccgctcgctgtcgccgccgccggtctgactgccgtgctcccgtcggtctgaccgccgcaatgccgtcggtctgaccaccggtgagttgccggttagaccgccgaaacccggtgaaacacaaatcgaagaactattaaagtagatgacaactttattgcttctctctgtgtttacaaagtgcaccaacagcactccttacaaaaatttcgactaaactcgaaaccctaactaaactatcaactcaattgctctcaaaagcgataccggaaagcctcacgctccccctctatttatacatgaggtaggcagcctaaagccacgaaccaaactcatactaagagtcctaaacaccttaggaaaccatacagtacaagacacaaactttacataaccaattgtaccaaatttggactccttccaaattcgactccgcatcccatacgtacacaatacctccatcgtatgccatatggaatcttcaccaaccacgtgcatcaactctagccttagtatcccgcatgatatctgaccaccacggacatcgtcttaccaccaagccgactcccggtccatcaccgcaaatattctcccgaggcatcgagtcacctacacatgaaacaaataaagaaaccatattctgagaccaagttatcaccaacttgactcattgttagcaaacaacagtattacatacgtatagtatccatctagaagcca

SEQ ID NO: 33344 - DNA, 1493 bp, Oryza sativa
ccttatattatgggacggagggagtatttaagtagcaaatgattatcactatggaaaaaccttttgatctggtcatctttgtggtccattgctcttgtggcaattgtttaagataatgctgcttggttgcaaaaactgcacttttcagattatgtaataagttataagttatttatgttaatgagcttgatatgcattttaacgatggccgctcctattcttttccatagttgcctatcaggttaactataaaccttctcttttcagatggtacttgtgcacccatagagagggacactcttagaagtcttgtggaatctggtgcaactgaaagttcaggttgtttgcctggttgccacttgggaagtgatgcccctccattacatctatccacagctaatgctcttggggatatcttttttccatcaagtgatcttttgcaagcaaatgaggagtgtgctttggctgctctcactaaattaccagaaaatggttcgtcttctagttcatatattctgttaactagtactcccttcgacccataaaaaaccaacctagttttggatgtgacatatcctagtacaacgaatttggacatatctctgtctagatttgttgtactagaatgtgtcacatccagtctagattcgttttttgttggacggagagagtatagctttcagttgtactaatacaaaagaagtactaatttcatccatgttctgtagaccgcagtaagcaactacagagtactagtagcaacctgttgtccagcctcaataatgtcgtacaagcattaagtaatcttcagttgaagcacaagcagttagcagaggattatcaaaatcaaagagattccagtgcccgaaaaagagctgaacatagacgtctaaaaggtatcttgtttagagattgtgctgatgtttctttacagttgttttaactttcaaataagcatccatgccatttaaaggaacatgtttcgcaacatttgagacctgctatacatcttgaattatcaaacatgttgccatcaactcctatctatcctccctacgcattaaccagcaatcttctggagagcattcttgcgataataggctgtactgttgcagtactcttatatttactgcgccagcgcttcagacttgtaccatattttccctatacatttttttacctagatacgttgtcctaatacattgggtaaaactaaccagatgttttggtttactttgtcaagaggagttggccagtgctgcttctgagttggaagaaactaactacaaactggcagcacttaaagctcaaagagataatacacaaggagctcgaatcccatatcctacattaggaaacaaaaatatgcctgaagataaggtcagagataaacaaagagagatgcaggatcttgaagctactcacaaggaattatcggtaactgccatcgttcatttttaaagttccaaattactacttcctccgtttcacaa

SEQ ID NO: 33345 - DNA, 631 bp, Oryza sativa
gaaaaagccctagcgccgtgtgccctagctttgcagtcgccgccgccgctccagccgtgagccgccgtcgtttcagccgtcgccgtcgctcgggaaagaccaccgtcgtgctcgccaagtagtcgccgtcctcgtccgccctttcgccgtcgccggagatcaccggagcagcatcgccgtcgtcgacccgaaggttcccgccgcttcctcctcgtcgccgtcgccgtccgttggtcttccgccgccgtttaggtcaccggtgagttcgccgtgttgtcctctacgtcttggtgccctccgtttgcgtcctagtgccgccgttcgccggcgagcgtgcgccgttcgagccgtctcctccgccgagccgccgccgctgtcggtgacgtcaccgctgacgtcattggggtcgtccgccgtgagccgccatggacccgattgatctcggccgtccgttttggattggttcgatctcggccgtccgttcgtgtgaaccgccgcccgtgcgcccggtccaccaaaccctagccgctgacgcaataatccttcttttccttttcaaaaataattcattattgcgtcataattcaatttaaaccgatataagtgttttaatccgatttaatctttaaaa

SEQ ID NO: 33346 - DNA, 677 bp, Oryza sativa
gatgattcagaccgaactggcaacccgaccctggtcccagcccgtccaaagccaacccaggccaaccattccacattttagttgttaagcaggtttgaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacaggcggaagacgtgacatagttcccaacccatcctagccatagacaagagtaccgacccaatcccacctacggccggaacccccgggacaggcaggcaggactgagccccctagcagcaggacatgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaattaaataaacggcgcagacggcttcacttcacaggcagcttgaccaaggctacacctaatccttcacaccatcagcctcattgtagaactctttctctgatgaatg

SEQ ID NO: 33347 - DNA, 9124 bp, Oryza sativa
aatttttaaagattaaatcggattaaaacacttaaatcggtttaaattgaattatgacgcaataatgaattatttttaaaaaggaaaaggggatttattgcgtcaccgggctagggtttgggtggaccggcgcacggcgcgcggttcacacgaacggacggccaagattgatccgatccaaatcggacggccgagatcgatcggtctacgaccggctcacagcgaacggccccgatgacgtcagcgatgacgtcaccaccggcggcggcggctcggcggctcgggcttgcatgctcgccggcgaacgacggcacggcgacgcggacggaaggcaccaacgggtagcggacggcacggcgaactcaccgacgaccaaagcgacggcggaggaccaacggacggcgacagcgacgaggttgaaacggcggcgctcttcggcttgacgacggcgacgatgctccggcggtctccgacggcagcgaaggggcggacgaggacggcggcgacttgacgagcacgacggcggtcttcccgagtggcggcgacggctggaacgacggcggcgcacggctggagcggcggcggcgacggcaaagctagggcacacggcgctagagctcttccgacgacgagaggcgaaggcgagggctgcgacgggtagaggagacaccgggggtccttttaaacgggctcggaggcggcggcgaaggcccacggcgacggcaacggcgaaggaaaccttcggcttggagagagggaaaaccgatccgaatcgaactcgattccaaagctttccaaagcgattgagccaaagattccaaaggagaaaaggtagaggagatcccggagatcatttcccctctattgattcggccggagaaggaaaggaacggccggatttggaaagggaacggcggcggcgctcggcggcggcgcgctagggttccggcccgaggaagacgacgactccgacaggcgggacccacctgtcagcgacagcgagggcgcgcgcgcgcggcggactgggccggctgggccgaggagagagaagagaggttttgggccgactttcggcccaaagccaaaagaagactttttaaaacctttttcaatttaaattattccttaaatgcaattccattattaaaaatactttcttagctcaaataaatcccagaaaaaatctaggaattatagaattaagcaaagtatttaatgaaattttatctggcccaattttatattggaatttattaattaaacttagattttcttttcaagacttttaaaataaattctagaaattccaattaaacaacaatttatatattttgaattttcagggtgtgacaggacaccggccctgtgccatgacatctcgactaccgggccacagctcgtgtagccttcatttgccctggagatgtccatcgaacccccgacttcgtccatctccatccgtgtacttttgtttataaccagactgagccacaaactaagccttacccactagacatgtggaagtacggtagtgctttgcaacagaggcccgaagaccggtccttatatggccgaggtgcagcggccgagagaggggagggaaagggggaaacgaaacggcggtccacggctcaccccgagtcgacggcgatgacgaaaacggcagccggagcgaaggaaggtggcggcgcggctcgggtcgacggggtcgacggcgttccggcggtcggcgagcgaagcggaggggtggacgaggtcggcgaggatgcggcgaagccgaaggaggcggcgccggggcgggagatggtccggggcgacgacggcggcggaccggagctcggcggcgacggcggagagagagtgcgatggcgcgggctcgattccgacggggaggaagggcggcgagtggcggaaacggtggaggggagcacggggatggtttatatagggttgggagtgagggagggcggccggaggagaaggaaaccggcgcggaagatccggccgccattgatggcgccggcgaggtttgcgggagtgaatccaagcgaatccgagggagagagagagggaaaaacggggggaaagggagagggaatcgcggggaatatttccccccactttaatgcgcgcggggatggtgggaggcggcgggattcgcggcggcggcggcgctagggcacgggcgaacggcgggagtgtcgggaggaaggggatgacgggtgggccccacccgtcagcgagggtggtgggcgggcccgcccgtcagcggcgcgcgcgcggggagaagtccgagtgggccgcggggagaggagagggaggggagggagctgggccgagccggcccaaaagggggaggggagggaaagggaactttttagggtttttctttttataaaacctttttaactttgtttatttcttcttaattattatttgtgctctgaaaattccactaaaatttatttacgcattttaggcttttaggaaatatacaaaaatcctccaagccttatttgacttttatctttgcacattttaatttttgaaggctttcacatggattttaattattctaatcataatttagaggatgtattttagagtcgatttgggacgcgacaattattgatcaaataattactgaactgttctttgtatcatttaggaattgagctctgaaaaaatccgagaaaatttcagagagttgacttaatcatggagaatttaataaaaattaaatccatccatgctttagatttaagaaattttatttcccacatttaacttcacttgtaaaattaaagaacacttaatataaattctattattaatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataatcattctaaagctttaaagaaaactactgctgctttgaaactggtggctgagctgtaacacttgaaaacgcaactcttgaagacgcaactggcactgcattggctcctgtgacaacaatgttgttgacctgaccttgcgactgctcactagtagactgtgataacttaacagtggttgggttcgatcctgtcatgacaggcagcctcagtgaattggtgatttataataagccagatatagacgataataatcatcgctgctccgtagcagcacatttgttcgcagcggtgtcaacgacgaaggcaatacctgttggttcattccaacagcttaagaagcttgaggtggacagcatctcagcggtgtttgttgcccccatttgcagcctcctcgcttccaccctctacaggttgaggttcacttatgatttgtggatgaaaaatttcacaaaagagcaggagcaggcacttcagctcctcacctccctccgaaatctagaattctatgagtgccaccgtctgcagtcccttcccgaagggttgcatctcctttcttctatctgcacattaggcatcgtcggatgtcctgaaatcagatcgttgcccgaggagggcatcccagcttcactgaaaaaactactagcaatgcgttgcagcgtcgacctgaaggatcaactcaagagattagaagaatcaaaccaagatttacaagtattctacatctgatcacccaaggtaagacgtgatgtcccaactcctttgttttttactctttcatctgcagttgttcatatttaaactcttttttacctgttcgttgttactgttgatcatctagcgagccaccactactctcttttgaacaatgaagtgcagatacacattctaaagtcatttgaacaatgataaaaaatcaaatccgatgggaaaaaacaagaaattgctagaacatgttggacaatcgccatcttttcttactgtgcgcaacaagcctaaccttggcattatggaaactttgcagtaactttgcagtaattagatcgtggatgttctgtacgttgctttattgggagtgatgaccaaaccatttgccacacatagcttgtttttttcaagagaattacagttttgattaaggagcaacacccaaatgattgtggagctaacctcgtttgtctctatttcatcatatgttatgttacagttttgattaagcagtattagatttagatgagagcaactgtaattgtttatggttctggtaacacagtttcatggtcattagtaggagaattctttgaccttattaacttgttccctttcagcaaagcattgtggaatggtgttttttttagcctattcagaaccagttttttacataatggaagctttattaatctcagtaaatttcatcaagtgatacaattattctgagagcacattcggcttctgcaccaaagagtacacacagccaacaagaaagaaacaaaagataaactcatcatccaaaatagcagaaacaaaaagaactttaggagcccgctaaccgtagcctagaacgtcacccatgtgctggggtagaaaactactatatggccactaactctaattgttgacaaaccgcaatgatagtaccctgcaaattgaccttctgaaggatagcctatgagcggagccaatgtgtaatcaaaaagataacctgcaaaggagaagatatgttttttcctttcaaaaaccacattatttctgaaaagccaaatagaccaaatagtggtagttgcacctaataagaccaaagatctcaaattgcgtgattgtcttcttatccaatgcccaaacatatgagttgtactattagataaaactaatattcgaagcaaactgaattaaagaccaaaccgcgcgggcaaaataacaatcaaagaacaaatgattaatagtttcatctttgtggcagaaagaactagacttgtttcctctccaattccttttaatcagattatcttttgttaagattactccatggcgtaagttgtcacgcccgaaaattcactagtaatttccgaacttatttgtgcataaaatcctcgtccaggaatcagccgaggtacacaaactaacaatttaatatacagattcatcaaaatatctaaaacgataaatacttactaaagaggcacttagtcctcaccatgaagaaaactgcagcggaaaaaaaaaaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcgcaaagataccaaaggttggcataatataggctcatttgcaaaagcagcatttagcaaaacatttaagagaagtaaaacagtggagtaattaatcagaaattttaatcaacactgaacaacacgcccatgctgctcaggcccaaccattctgaaacaaccatacccggctgtacagatctaatctccaatccaggagctaagcaaattattaccagatataacatccataattattgtgagaagtgtgggactaatcacgaaaaacattgctcaacccgcccataaccgtgggcacggctattcgaatagttttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggcatggactccccagcgacccccgtgggcttatctccgccacttctcagtctggtgccccgcaatgaaccatgctatacgaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaacttgtcaagttataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcacgaaccttcgcaacgacggaaacgacaagctaacacgcaaaacgaagaaaaagactaataaaaaccaaataaacagtacatataaagtaaacaaacatgtagatcataattttagatgaattatgagacttgaacggcctcattctgacttcataagaatttattatgaaatttacaagattaaatctaattaaagcccatttaaaaagaattaaataaatttaattctatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcggctagggtttcgcggtggaccgggtgcacggcaacggttcatgggaacgaacggccgagatcaaccctatccaaaacggacggtcgagatcgatcggtccacgaccggctcacggcggacggtcccgatgacgtcagcgacaacgtcagcgatgacgtcagcaccggcggcgactcgggcggctcgggcgcgtatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggtggcggagaagatcgggtcgacggcggcgacggtgctccgacggtcttcggcggcggtgaagcggtggacgaggacggcgacgcgacggcgaccacgatggcgatcttcccgagcgacggcgacgtctggaacggcggcggcgcacggctggagcgacggcggcgacggcggcgctagggcacacggagctagggcgctacggacgacgagaggcaaaggcgagggtggcggcgggtagaggagacaccggggatccttataaaggggctaagaggcaacggtgaaggcccacggctgccggcgacgagaaggaaagatcggggtttgaaggaaagagaccgatccgattcgaactcgaatcaaacacattccaaaccgatttagccgatgtttccaaaggggaaaaggtggaggagatcccggagatcgtttcccctcaatcaatttcaccggaaacggaaaggaacggccggatttggaaggagacggcggcgcttgcgctagggtttcgggcggcggcggcggcgcgaggaggaagacaggcctgacagacgggccccacctgtcagcggctgagagagaagagcggcggctcggcggactgggccggactgggccgaggagggagagagaaagagagagggagggttttgggccggctttcggcccaaagccaaaaaaaaaacctttttcaatttaaattattcatgaaatgcaattccatttattaaaaacacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgatcaaataattactgaactgttctttgtatcatttaggaattgagctctgtaaaaatccgagaaaatttcaaagagttgacttaatcatggagaatttaataaaaattaaatccatccatgctttagatttaagaaattttatttcccacatttaacttcacttgtaaaattaaagaacacttaatataaattctattattaatttattaaataatttataaatcctgaaacgaaaatcaggatgtgacataagtaccataagaagatcttaatctctagggaggactttgatcttccagattcttttgtttatattgggaacatcggtctgcaccaacgcaagataaagagatttaaccgagaatctaccatcagtggttagattccatttaaactcatctgggtcgtgagataatataatattagcgatgcgtgagagaaggtgattccacgctactaacttagagccagtaaggtccctgcaccaagaaaagcttagaggactggtctggaaaatttctgaaatagttgcatgtttatgcctaacaacgttatagagatagggatattgttctctttaacaggcattcccccaaccatttatcttcccaaaaccgtacttgagagccatctttgatgttgaaagagccaaacctaataaaatcaggcttggccttcattagactagcccaaaagtgtagcgcccgttccgtcgtggcgcctagcgggaaaattaactcttaaaaaccctaattgcgaaatttgtttccttgcttgttgtctagtgtccgtgccatctcaagacctcaatccccgatctatcgtcaagtgcaattcccaatccaatcctttcaatcaaattccaccgcaaaaagtctattttgcctcccccgaggtcgatgggcctaatctcgctcggcccatctctctct

SEQ ID NO: 33348 - DNA, 8531 bp, Oryza sativa
agggagggttttgggccggctttcggcccaaagccaaaaaaaaaacctttttcaatttaaattattcatgaaatgcaattccatttattaaaaacacttccttagctcaaataaatcccagaaaaatctagtaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgaacaagactgagtacaaccaccgtactcaacaagacacacccacaagtgcagcataattgcaaaggagtacaatggagttataatataggggttaggttttgcaataaacagcatttaaaagacccttagttgctcaaagctaaatttaaaacacgatcctagaactatttaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtatgaatccaattccacaacaatccaacaaatccaatgtgtccaagtgatatgaatattaccacaatctagagttttaaaaccacctaatgttacctaattaatcagcgaagcatctacctaaaatcatactagtgataccacgagtagagtgtccactagttgggggttttgtttatcctagggtgaacaaggtaataataacaataacaataataataaggtcataacaaaggtaaataggcatggctaaataaaacagtgataacgcgggaatttaaataaagcgatgatgcaataatttaaatcaaaataatttcataaattgggattcaatatgttcaaggatgatgtgtcttgccttgctcgctttcccaaatgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattccgagttcaaatggccaagttatagccatttgaagtttatatgctctttaaatgaatatttgcgaatttcttcatttaaattttaatttaaaatcggatttattgcgtcagccgacgggaggggcgcgcggaccgggtccacgggagtggggcccacgcggcagcctcacggtccacggtggaccgggtgcacgcggctggcgccggccggcgccgtgggtcccacgcgtcagccgcacccgcgggcgcgggcggctgacggccgggccccacttggcagccgcgagggcgcgcccgaaggcagcctcgccggcacggccgacgggaggcgacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaaacggaggaaggcggcggcgcggttcgggacgacgaggacgacggcgctccgacggtcggcgagcgaaacggaggagcggacggggtcgacgacgacgcggcgaagccgaaggaggcgacgccgagaggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccgccattgattgcgccggcgaggatcgcgggcacaaaatcggacgaatccgagggagagagagaggggaaagtgggggaatcgggagagggaatcgcggggaatgattcccccctcattatggtgcgcggggacggcgggatgcggcggaatccgcggcggcggcggcgctagggcacgggcgagcggcgggagcggcgggaggaaggcgatgacaggtgggccccacccgtcagcgagggtggcgggcgggcccgcctgtcagcggcgcgcgcgcgggaggagccgatgggccgcgggggagaggagagagagggagggagagaattgggccgagccggcccaagaagggaagggggggaaagaagacttcttttagggtttttctttttataaaacctttttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagaaaatgaattttaatttcgggatgaatttatcaggacgtgacaaatccaccccccttacaagaatctcgtccccgagattcgaggaggctagcaagaagataggttgggcggtcttctcttcttgtctgacttcttccgtcgcgtcttttataacaacttgcctagcaaaacttctctactctggactgcttggctcaatctcctgttgcagatggaatcttctcttcacctgacttgtccctggttgaacctttagctgacttcgactgggttgcggcacttgaagatggtgcttcagttccagaacttcgcatagttcatatttttggcgtcaacctcatagaagttacccatttcacgttatgcgtcgagatcagctcgtcattactaggataccatgcttgtcatcatgagcatatcatgcttgtcatttacttctaacctgccaccaactgcctcatattagctttcctagtctccgggtgataactacttctgctatttgatgcaagggtcgataactttgcctttgaattatgtttcccaagagaaccaacttatcccacttgacatactttgacgtcttcccaaatggctttactgctggatttgttgttgtctaatcattatcctgccaaatctgaggcttcgttgttagatgcgattttaatctgacctctgtagattatcttcgaacatatcacttggttcataactgggaatagctctcacgaacaagcaactcggattcactttctttacatttggttcacttcccactattctcttcatgttgtcatcatttagcattcaacatattcctttgcaccttccgccttgatgtgttctttctcgatggatcgattggtaggaaagtgcgttgagcgatactagtgcaagtgctttcattctagtagcatctgatacaaagcccaaggttgaaccgagctttagattccactgttcaggttttacttattgacttcttggtcatgtcacaaaagtttccatccttgtccccatagaagtacttctacctgtggtcatctctcttactcgtgaattcacctattttaatgacagggcaactgttgtagggttgtttgctatcgggagtcttccttgagtgacacaaatcatggttctcgttatcctttatcaatcacctttcgacctacttcttttcccagtaaccaaacatcttttccgatctcttccattaatcacctttcgacctttctcaaccaggtactcttcactccgggtgttgaggatgcttctggggcaatgaggtgcttgggcgtgctgtctttcagagaaaccttgaagtagttcgtcaaaagctagactgacgattgttgcctttgatccgaagagacacatctgaaactcttagtccaaacaaatgcctctttggttgatcacttgattttcttcgccatcaatcgctaggctatttgattcctaacagattatgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattggcatgtctgcttccttaacaggtactacagtttgtaacagacaataactttcttacgctcgggttcttcatcttgtacttgatttctttggctgctgtgcacgggcgggagggcggctcggcctggaggggggggtgcggcttgggccgggcaggccgggagggggggggagagacagcccgggagagagagggaggagggtgctgggccgaggggaagggggcccaagaggagggagagaaggagagggagagaaagagagggaggaatgggagacttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttcttttcgaattttaattaattctattattccttttagcgaatgatttttaattcgggatgaatttatcaggacgtgacaggagggtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagtttgctgctgacgaagaagatggccaaccaacccgccagttccaacggagagaagcatcaagatggatgaagtcgggggtcgatggacattctccagggcaaatgaaggctacacgagctgcggcccggtagtcgagatgtcatggcagagggttggtgccctgctgctagggtgctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttacttcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacaccatcacctgggacgagttttcatctgtattcaagagatcccatgttcccgcaggaatgatcacactgagaaaacgagagttccgctacctgaagcaagaagatttgaccgtcacagagtacctgcacgagttccatcgtttggctcactatgcaccagaagatgtggaaaatgatgaagacaaacaagagaagtatctccaggggttaaaagatgagatcacagtgcaactactcctagaggaatatgaagattttgagaaacttgtggacaaagccatacaactcgaaagtgagcataatcggatgaagaactgtaagagaaggattgtcagcatcccagtattcccatgtggtaaccaaagacagcgcacggagccacttcagatcaccggatcttctgttgcgcatcaagagtttcgccccaagaagatggacacaatgcagacaacaacattagcaatactaatgatgatgataccaccaacaaccatgcttcttgccccattagtgaccactcaaatcaagcgtgcaatgtcaacatcattcaccaaggtgtcgacgatagtatcaatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaaggaccagggcattactcgagggactgcctgcaaccaaggcaaagtcgatctccacattaccgccaatttacacgaagcagacatcccaatcgtattgtggtcactggagcaaacgccgtacccgtgaggcctcgtgttaatcagaacccatagcagaaacaatgtgccgatgctaagcacctttccttttaggcagtgcttagtattcatgtaatgagggagaaatgtgtaatacagacaagttctatgagggttcttttggaagatgtggatatgtgattatgtgtataattgcttactgataaaggagacctagggtctcatttcagaggaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatg

SEQ ID NO: 33349 - DNA, 11826 bp, Oryza sativa
aattcgggatgaatttatcaggacgtgacaggagggtcctcagcagaaaagaaaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcactgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgtagtcctgtcacatcatcacagaaccaatcaaggatgcagtcactagaacaatgccagctatatctctccagaatcaaaatgagcagccatgtttgtggttttcagttcgctacttatcatggtgtaatcgaaagtttgcagcaaccatgtaatacataaatatattcatgtctataaacagtgagcttgctatgcttgtggatgattcacgttgagaatacaatgtaccgatgttaagcaccgtccctttttgtttaaggcagtgcctcgtattcatgtaatgagggagaaatgtgtaatacagacaagttccaggaggattcgtttgaaagatgcggatatatgatcatgtgtataattgtttactgacaaaggagacctagggtctcgtgtcagaggaactatattctaacctcgagttaataaccaacctgttgatggaaaagaaaaacaattaaactgtgttgggttaaaaagccaatgagacagtagttggggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattaatctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaaggatctcatcgtccccagaagcgtccgcaatccacattaaagaataccacctgttagaggtaagccgaaagatgattgataaaagagattggcaaagatgttctctagcatgaaagaagtaggccgaaaggtgattgataaacagaaacatgctctgcatcgctcaaggaagacccctgattgtaattgccacgcaacagtcaccttgtcattaagtaagcaagatgacctaggtaaaagtgtttctaggaaggcaaagagtgaaatcttcaactcggtatcagatgctacacggagtgaaaagtgcaagcaccggttaccaggcaatgccatttcttgggagatgatccaatgggaaagaacacatcaaggttaaaggtgtaaaggaatacgttgaatactaactgaggacaacctgaagatgataatgggaagtaaactgaatgtaaagaaagtgaatccgagttgcttgttcgtgagagctattcccagttatgaatcaagtgatatgttcgaagataatctacagaggtcagattaaaatcacatctaacaacgaagcctcagatttgacaggataatgattagacaataacaaatccagcagtaaagccatttgggaagacgtcaaagcatatcaagtgggataagttggttctcttgggaagcataattcaaaggcaaagttatcgacccttgcatcaaatagcagaagtagctatcacccggagaccaggaaagctaatatgaggcagttggtggcaagttagaagtaaatgacaagcatggtattctcatgatgacaagcatggtatcttagtaatgacgagctgatctcgacgcatgacatgaagcgggtaacttgtatgaggttgacgccaaagatatgaatgataagaagttctagaaccgaagccccatcctcaaccaccgcagcctagtctgggtcagttagaagttcaaccagggacaagtcgggtgaagagaagattccatctgcaacaggagatcgagccaagcgttccagagtggagaagttttgttaggcaagttggttatagaagacggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattctctaaaaggaataatagaattaattaaaatttgaaaagaaattggcaaacattaaaatacgtacaagaaaaattcaaatgtgacccggagaatttttgttaaattctccttggtctaaaaggagccctcaaattttagtggaattctcagagcacaaataataattattaagaaataaacaaagttaaaatgattttataaaaagaaaaaccctaaaaagtctttcccccccttttcccctcttgggccggctcggcccatccctttatctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgccgtccacgcgcacaataaagtggggggaaatattccccgtgattccctctctctttccccccatttctccctctctctcccgcgttcaaacgggcggatttgcccccgcaaatctcgccggcgccattgatggcggccgacctcccgcgccggtttcctcccttccccggccaccctctctcgcccccggctctatataaacactccccgtgcctctctccaccgtttccgccactcgccgctctctttccccgtcggaatcgagctcgcgccgtcgtcctctctctccgccgtcaccgccgagctccggttcgccgccgtcgttgccccggaccatctcccgcttcggcaccgcctccttcggcttcgccgcatcctcgccgacctcgtccacctctccgtttcggtcgccgaccgccggaacgccgccgtccccgtcgacccgagccgcgccgccgcctctctccgctccggtcgccgttcccgtcgtcgccatcgatccggggtgagccatggaccgcccatttcgtttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccgattttttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttccttcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactagtatgaatttaggtagatgcctcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgtgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaatggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagctttggagaagatgtcttagggggagtcctggcttataccccagttgagcgcttgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacaggcgtgttccacgtcgtccccgtctccgtgcagccactgctggctgtccctcgtcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccgcgtgatttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtattgttattgcttctttataggcttgtagctttgcttgtgtgcttcgcgtagctttcgtcgttccggaggttcccgaagcgtggttcgtggttgtcgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggctgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattattacactagcgttcgggaaaaggcaattttctcggtcgcgacaactcccttgcatagtgcccttgctcatcacacataaaacaaatgatacttgcttcttttgagtcaacatgtggcacgtcaccatgggtccttcgggatgctggcggcatgctgactcgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaaatggtgtctggtgcttcattcactcgggagcttgaggtaccgatgtcctgacttctgaccttattgcctttctcattgtcagccatctgttgcaaaggtttggagagggagagagggaaaacaaaggggagagacagattagaaactaagaataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgactaacaactctaccctagagggtggcttaggttctgtgacgggttctcaagatcttcactcctgcttcacagctggcttcagtgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttagaaaatatgtccttaggttttatccacttggcttatcctacagtcgagatggctctgataccagcttgtcgcgaccgagaaaattaccttttcccgaacgctagtgtattaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctacatcttcacaggcgctcaactggggtataagccaggactccacctaagacttcttctccaaagcttctcttactgaagagggaaaagattgagcaagaatgagtacatccacagtactcagcgagccacaccggcagatgcatgattaatgcaaagggggtacaaggggtaataatataggggttaagctttgcagaaaacagcatttaaaagtcacttagttgcccaaagccattttataagacgatcctagagctacacaatattattaatcaaggccgtgaaccctcacgaacctgccttaacccaaggcctacgatgattcagaccgaactggcaacccgaccctgagtcccagctcgtcccaagccaacccaggccaaccattccacattttagttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggattcaatatgttcaaggatgatgtgacttgccttgctcgctttcccaaacgccggcttcaacttccacgaagagcggatcttccgagctgcagcgtctacacgaccaacggaaaagaaacggcttttactctactaaactccatataacaagcagaaacaaagcacaaaaatgggttcttgacttcttaaggaaaaattaga

SEQ ID NO: 33350 - DNA, 1567 bp, Oryza sativa
  unsure (1)..(1567): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcagaccgaactggcaacccgaccctgagtcccagctcgtcccaagccaacccaggccaaccattccacattttagttgttgagcaaattttaagaattcaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccgcctacggccagaacctccgggacaggcaggcaggactgaggtgctactatcaaaaccatgcaccccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataacaatagcaataataataaggtcataacaaaggtaaataggcatggctaaataaaacagtgataacgcgggaatttaaat

SEQ ID NO: 33351 - DNA, 979 bp, Oryza sativa
tttttgaaggctttcacatggattttaattattctaatcataatttagaggatgtattttagagtcgatttgggacgcgacaaaccttccccccttaaacggaatctcgaccccgagattcggaagaactggcgaagagatcgggatgggctgccttcagctcgtcttcacgctcccaagtagcttcttcctcggcatggttgctccattggaccttgcaaaaacggattacccgattcctggtcctgcgctccatggtgtctaggattttcactggtctctccacgtaggtcaagtcttcgcgaacttcaatctgctctgagtcagcctgctcggacggcactcgaagacatttcttgagttgcgacacatggaacacatcatgcacgttgcccaaggaagcaggcaactccaattggtacgctacttctccgcgtcgagcagtgatgcggaaaggacccacgaaccgaggtgcgagcttccctttcgtctgaaacctgtgtacccctcgcaatggcgttacccggagatacacaaagtcatccactgcgaattccaggtcacggcgtcggttgtctgcataactcttctgccgagactgtgccacctttaggttttcccaaatggttctgaccttagcttcggcttctctcaggatatcggtcccgaacacttggctttccccaacttggtcccacaatagcggtgtccgacatttgcgtccatacaacgctttataaggtgccatttgtatgctggcttggtagctgttattgtagaagaactcggcatagggagactattatcccatgttttcccgaaatctaggacacatgcgcgaagcatatcctcgaggatctggtttagacgctcggtttgaccatctgtctgcgggtgatacgcggtgctgaaatttaatcgggtacccaactcttcttggagcttcttccaaaagtgagagatgaactgacttccccga

SEQ ID NO: 33352 - DNA, 3546 bp, Oryza sativa
catatagaatcatatccaccttgggtttttggaagtccagtgataaaatccatcccaatttcatcccatttccattctggtacttggagaggttggagaagtccggccggtcgttggtgctctgccttgacacgctggcacacatcacaaagggctacgaactccgcaatctcccgcttcatactaacccaccagtatttctctttcaagtccaggtacatcttcgtactgccagggtggatggaataaggactttcgtgagcttcctgaagtatcaactgtttaagttccctgacgtctggaacgcatacccggtttccattccatagagttccgtgttcatcctctgtgaaaccagcggctttaccctgtttcatattcttgaggatcccatgcatatctagatcattcttctgagcctcgcggatttgatcgagtaaggtaggcttggcttccagtgtagctaagaatccatggctaacgatgcttaggttcagggcttccaactgttgattaagctccagtggaatgccacggacgccaagagtgttgcaacggctttttcgactcagcgcgtctgcgaccacgttggccttaccagggtgatagtggattcccacatcataatccttgatgagttctaaccatctcctctgccgaagattcagatccgactgggtgaagatgtatttcaaactcttatgatcggtatatatttcgcagcgattcccaatgagatagtgccgccagatttttagagcatgaaccaccgcggctaactccaaatcatgggtagggtagttgccttcatgaggccgtagctggcgtgaggcataggccaccacatgaccttcctgcatgagcacgcaccccaatccttggcgcgaagcgtcacaatacaccaggaagtctttgcgagtatccggcaagattaacactgcgaggaaaccagcttttctttgagtgttttgaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcggggacggcggtcactgtttcggggtccacagcaactcctttagcagatatcacgtgccctaagaatttgacttcggacaaccagaactcacacttgctaagcttggcatacaattgatgttcccgcaactttcccaacaccagacggagatgttgctgatggtcttcctctgattgcgagtacaccagaatgtcgtcgatgaagaccacaacaaacttatccaagtattccatgaacactttgttcatcaagttcatgaagaaagcaggagcattagtcagaccgaacgacatcaccgtgaattcatacagtccatatcgcgtggtgaatgcagtcttcgggatatcttcttcacggatgcgcaactggtgatatccggaacgaagatcaatcttggagaataccgtggcacctttaagctgatcgaacagatcatcgattcggggaagagggtacttatttttgatagtaacttcattgagagctctgtagtcgacacacatcctctttgtcttgtctttcttctccacaaaaattacgggagcaccccagggggaagtgctcggacgtatataccccttttctttcaactcttccaactgtttcttaatttcggccagttcatttgctgccatacggtagggccgtttgtacaaaggagttgttcctggagcaagatctatccggaactcaatctctcgcttgggcggcataccgggtagttcttccggaaacacgtctccgaactctctgacgatggggatttctaacagtcctatctgatgaagttctgaactactgacagaggttgggggtgcaaataaaacaaccggttgttccggccctcggtgcagagtgacagtgcgtcttgcacaatccactactccttggaattgagccaaccaattcatcccaaggatcacatccaagttcttggtgtctagaagaatcagatccgagggaaacggaattccctgaatttctatgggaacggcagggctatagtacttcgctgtcataacccctccaggggtggtgatgagcatagggttcctaagcctttctacccccaactgatttctccccacgaatggcacagatataaacgagtgggaagctccagagtcgaacaaaatggtagcaggggtggaatggatgaggaacgtaccaacgatgacgtctggagttgtcagcacatcctcggcagtcacgtggttcacacgaccccgaatgacgtccttaccaccgttgttggagcggggcggcgcttggccttgctggcgcctcggctttgggcatttatccgcaaagtgcccaggctcgaagcagttgaagcacagactctgctgaccttgaacgtctctgtggccttgaccaggatgcacagctggcgcagggggacggggtgcacgggtcccttgctgaccctgcggttgctgcggctgtgggacgcgcaccacaaattgaggtcggggcgcggagggaggttgctgctgttgctgctgcgaggaggatccccctggatagggattggtgtagcggaccctttggttagccccctgttggttgcggaaattcgccaagcgacgcttgtgcgactccaattctttgtgcttggcttccaagcggatgctcttgtccaccagacgttggaaatccggataatccccggagatcagacgtacggacagctcagggtccattcccgccaagaacttctcttgcttttcctcatcttcccgaacgtcctccggggcgtaccgggccaggttgttaaactcatgcaaatactccatcacagagcggttgccttgcttcaactcccggaatgcccttttcttaagggccatgactccggcaggcacatgggttctccggaaagcggcggtgaaacgggcccaggtgataggctgcccctcgggctgcgtagcctagaagtggtcccaccatagagatgcgggcccctgcagctggtgggtggcaaagatgactttctcctcatcgttgcactgcacagtgtctaacttcttccccactgcatgcaaccaatccaaggcatccacggggttattggagctggagaaggtaggcgggcgaatgcgaaggaactcggcgagcttagagtgttgcgggggtggtggtgaaggtggagcattatgctgtggtggattttggatgtggtggaggaaagcagccatcatgttggcttgctgggcgaggatttgggtgaggatggcgttggtgtctggtggtggtggtggacgctgaggagaaggtggaggtgggctgccatggttgttgaggttgctgccttcgggttggtggccatcaccggtattagcacttctcctggtcgtcatcattctgaaaaccccacacggaaccagcaaacagagagagctgacaatta

SEQ ID NO: 33353 - DNA, 500 bp, Oryza sativa
  unsure (1)..(500): unsure at all n locations
nnnnnnnnnnnnnnnnnnnnnnnnnnnnnnnnnnnnatttagaaaaatgaaaaaaaagacataaaaacaaatgtggccatcagataagtaaaaaagacacctcaattctctgcacatcatcaggacaagaattttaatcattcttttaacttagcatgattaattttcttgcctgatgacgtacagaaaattgatttgcttaatcaaaaaaaatatttatcatcatctggccaaaaaaaaaaattcatgaagaggaatgcttctatcttcaggaacagaagagaagattttgaaaatatcaaatgatctaaagaaggctgatgaaaagcaattacaagaagtaaagacatcgagaggtaagtgtattgctatgtaaatttcatattaagtacttttttttcactaatcttgatcaaaaaataaaaaattttggtttcgaaaggttttgaaacagataccgacaaaaaagcacagagatttaagacaatgaagcaattacc

SEQ ID NO: 33354 - DNA, 624 bp, Oryza sativa
agttgaaaaaattcaatcatatttctttcatattcaatcatatttgtatgaatatgcaagaaattaattcaggtaacaagaattgtagaatagcactatttctttcatataatttcttttatgattagaattttcaaaatttctgcagaaaatggagctaacaatgcaaaggttgattatgaaaacaatgttctatctctgttggaccaagactacattgcagtaagtatttttactttgacaaccttaagtttgatataatttcttttattttctttgacaatcaagactacattgattttttgttttttttatcaaataggattcatttatatcatacactagtctaatggaacatattatttcatcacaaccaaaacgttgcaatgaattgaaggtaaatttttttttgaaaacaaaagtactgatttgttgttcatttatgaatttatgtgttcaattaagtatattttttgaaaatctttcaaaaactgtttaattaaggttgaaggaacaaaaaaatgatacaatagagactggaattggacaagattatcaaaaggttgacgaaagtttgaattcacacgttgaatatcaatcagaacaaagatgcttgatggatat

SEQ ID NO: 33355 - DNA, 1700 bp, Oryza sativa
  unsure (1)..(1700): unsure at all n locations
ccgtaggcccgctagtccgctgctgtttatttttgattgtcaggccttaagtgcctttgtaataatgtaaatattatcgatataataaagatgtgccttttgtatcatgtttgttcggtgtaccccggcttttcctgggacggagattaatacactagcgttcgggaaaaggtaaatttctcggtcgcgacaatgtggataccccaagacaacgcacatgccccgcagctccaaaacgaagccagtcaagtccagtccacgacgggtgatgctgccggccatctacaaacaaaacaaaatagaaaagcaacattttaaagattagattttgacaataaatgaagcagcaggacagagaaagactagaggattttcacaaataagaaaggatttttatttcgaaaatatcgctaaggcttgggatctacggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttatttattacatgggcagcgacggcccagcacactcaaagacaacgaaaaacagcagaagactaaggcgacgaccacaggcgcttgacggcaggcacgagctagacaccaaagccttcatcctccaggggctcctctgctgggtttgggaaaaattaaacaagactgagtacaactaccgtactcaacaagacacacccacaagtgcagcataattgcaaaggagtacaatggagttataatataggggttaggttttgcaataaacagcatttaaaagacccatagttgctcaaagctaaatttaaaacacgatcctagaactatttaatattattaatcaaggccgtgaacccacacgaacctgccttaacccaaggcctacgatgattcagaccgaactggcaacccgaccttgggtcccagctcgtcncaagccaacccaggccaaccattccacattttagttgttgagcaaattttaagaattagaacactgacttgggtacattgctcggcttgcccataaccgagggcgcggctattcgaatagattatactctgatcagaggtgttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagcgcaccaaccctctgccacgacatctcgactaccgggccgcagctcgtgtagccttcatttgccctggagaatgtccatcgacccccgacttcatccatctccaatccgtgtacttttgtttaaaaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttat

SEQ ID NO: 33356 - DNA, 658 bp, Oryza sativa
tcttttaaagatcatttatctcttcagatcaaatgcatgatttacttatactgtgcatgcgctgtatgcctgcttttacttcctgggagaagttgaaaagtgagaattggttaattgtgccgtgacataccttgttttacttgtgcagtcaagttggattatagtgaagttatctgctgtgaaccaggctgcatgaaggcatttaccaacttggaatgcctcaaggcccataacaaatcttgtcatcgacatgttgtctgtgatgtctgtggaaccaaacagctgaagaagaacttcaaacgtcatcagagaatgcatgaaggttcctgtgttactgagagggttcgatgccacctcaaggactgcaagttgtcattttcaaaggtaggatttcaatctttcagggttgattctgtttcacagaatttttttatttctttccaataaattgcaaatcgttccatccttttcaattttttttttttgggggggggggggggactttgaactgcagaaatccaatctggacaagcatgtgaaagcagtccatgagcagaagcgaccctttgtatgtggattctctgggtgtggcaagagtttttcgtacaagcatgtaagggacaaccatgagaaatctagtgctcatgtgtacgttcag

SEQ ID NO: 33357 - DNA, 502 bp, Oryza sativa
actaggtccaacccatccaaaaaatagaatggatcatctaacctatcccaccacatctccaaaccaaacacatgcttagtgactattatatggagtaactaactaataatactaataagtagtactactttcatttggtgcctcatcatcatcagaagaggacttgtcatcgtcttcaaggtcgtcctcctcctccgtagtatcgtcgttggacacctcctcctcgtcggacacctcctccgtagtatcgtcgttggacacctcctcctcgtcgtctccattgtcatcgtcgtcctcctcagactccttctcgccctcgctgaaatcgtcctcatcatccccatcattgtcactctcctcttcctctgtcacaagtgttagatggatctccctccccttgagcccttgggctcaagggggcctggacccgcgccctgatcgggggcgcccagcccaatggctggtgggcccccgtcacactgtgccatataaagaggggtgg

SEQ ID NO: 33358 - DNA, 4846 bp, Oryza sativa
gacaacccctctccctccctccgccggcgacgaggccgccggaatcgaggaggaagaggggtcgggagaggggaaaaaactgtagcaagcgagggttcgagagatataaccaatatgtctaaacactattaggcatcacactttcaagtaggacgtgttcttcttggcccacttgttggctgatgcaatttccttattccagacgctaggtgtactcatgtgggtgtccctagcaatatactctgctttgcttttccttgactttccccaaagctttcatggattccatgggaacactcctctgtccccagaaaaagtcagaggagatagaaacaaaaccaaggaaaaaaatactaacaccaaaaaatatttttaaaaaagatttgaccctttcaatcatcctcctccagcagagcaagcagccaaaccaccaagctccattcacacacagcaacagcaaccacacacacaaatctagaatgaggaaaaaagaacatcatatcaacaaccaaaaaaggcactaaccatcaatagttggggatgcaagaagagtgatgagtgatgagaattgagatcccaatcctgaaaaacaaaaagtttggatttttttttgccattagagggagcttctttctctcttcttcaagcttacaaacatcccaagggagctacatgcagaaaggttaggttgttgaacagagaaaggaagagccaagaagagcaaagcacccctgctgcatccatgcagagagatagtactacatgatacacaccatcatctttttttccccttttgtttcatctccttttgttggttcatcatctaccactttctatttacaaatgtaaaaaaaaaaaaccagacacctaaggtgaagaaaagaaaaaaaaaagaaagaaaagaagagatgcaaagtctctctcaagcttgcctaggaaatataaaaagagagagaaaaaaagggttgttttgatcagccaagaactggaaggatttgatgctctcctactgctaccattgctaaacaactaatttttagtatgctgctgctgatggtgatgatgacgatgattaatggcggattaattggatgctctaatctcttcctccctcttcctttccctttcctttttcttgcgagctgatgagctaaaaaaagctaagaacggcgcggcgatctgtgcgagctagctgccggcggcggtgggctccgtccatggcgagggcaagaagggctcgtcggcgatgtcgaagagggaggacatgggggtgccatccaatgcggcgttgtcgtcgccgccgttgaggaagaggagctcgtcctcgccggccatctccatgtcctccacgagcagctcttcctcctcctcctcctcctcgtcctcctccatggacggcgtccgcagcggtgtggtcggggagagccccgccgcctcggctccaccacccccggcgccgaccaccaccaccgacggcggcggcggctggggctgcgcggaggcggcggaggcggcggaggaggaagggagcttgttgcgggtggtgccggcgagcgagttgcggtgggtgggcgccgagtggttgtgctcgccggtgtaggtgaggatgaaggtgttggggtcggagcggctcctctccacctgcttcctcgccgggcaccccttcgagctactgcaccggtagtaccccctgttgcaacaaaaccatagctccggtgagcttttccttccatttcacggcggcgccggcgagagagagaaagaggggactgaccttgggtagggtgagcccttgatgggcttctgtccgtacttccgccacgcccacacgtcggccgacacgccgtccgccggcacgtgccgcaccaccttcttctgctggttcttcctggagcaacgagagcagagtttagcaactcggaattaatagaattaatcttttttgtcggattgattaggaaggagatgaggagttcagctgctgccatttctggcgaggtgaaaaagagaagctcgctcacctcctcttggatctaggcacgccgccagctggcacctgcctcgccgccgccggctgcgacgccctcgccggagccgtcgtcggagccggtagattctcctgcaccgtcaccggtttctgctgctctggctgcggctgcgtcggaggaggaggaggaggcgtcggcagaggcgacgacttcgacgaggaagaagaaggaaaggcggcgcagaacgccttgaggagctcgtcggcgtcgcggccgagcccgccgccgccgccgtccctgaccgtcagctccgggaagctccacgcagcctccaccccgacctccttctccgccgcaacctccatcgccaccccctgctgcaagaacgacgcgaacggatccacctgctgcgccaccgccgccggagagatcctccgtcggcagcagccgaggcggacgacggcgtcgaggtcccagttgttgccgcagagctcctcctccatggccgtcgagaagaaatcaagaaaatcctcaagaggaggaggtggtggtggtggtttcttgggctctagagaggagataagagggaggcgctgacttttgctagtttattgattgatttggaagagagaaggagactatgggaaagggtaaaaggagagagagagagagaggaggaatggtggtgatggcattggatcctgccctaaaaaggagtgagggctactggtctattttcttgggtttttttttctttttcttcttggagggaggctggttttataggggtgtgggggcagcacaccccccacttgactctgcagcatgtcaaaggggtgagaaaggggatactccatgggtgggaggggtataatgggaaaagctcactgtgattttttttggacttttcttggagaaaatgtatacctcctgtattggatttaagaaaatgggaggtgatcagtatatttgggaatgtgttttgttctgaggtacaaataggcacataaagaaaagcacacttgtatggtattttttgtcgcttttcacatatgcaaaactggattttatatgcacactagaattaaagctcaaatgattcctggcttctaaagcatgggagtagttgcttcttcttttttttttgttgaaggtgcatttctatgtacctatggcttattttggattttgttccgatacaccgtgagagcgtgtggagtcaatattaggaataaactcgagctgccttgctagttattgccagctgagtaaattctgattctccaaatctgttttgttttgctctattaattagctaggctggattttttatacgagctacctaggctgaataaaaaatgtgttctactaactaaatacaatctatgtgagatatatgtagatttacatctatgcgcaaatgaacccgcactagaattttataaggcccgactcgaatgggttggacttgactctaaaggtaacccatctcgaaggatgtccccggaaaaagaattacatattagtatcaggactaataataatgtaagttaacaaaaatggtactatttgattgaaaaggaggggtgcgcttgtttgctgacgagaacacattgatgtcggtcagttttttgcaactaatttttatttggttcatgtcgtattgtatatacaaaaatagactgtctatacacaccttacctaaaaattgttataatacatgcaaatgctggatatattggctatttgattggctagctattttttctccttagttatgatctgatcaataataactactgtttggttcacaaaacatgcccatgatattctcaatttctggtaaaatgcattggcaaatggaatgagctagacaagaggggtctaacaggacactacaccttccatgctacattaattagaaaatttgatttgggtgtacacaccttcacagtcggcgaatgtactagaagcacgttatctaaaaatgggacatgccacatgagattgttttgcaaatcagtgctccagttcataatattaattaaccaatatacatacaccatcaacacattaacatagttaaactagtcatgtcccatttattatagagtttaattaaaactaggaaggtagcccgcgcatacgcgcaggcgtgttgtttaatcttgtttgcacttttattacgaatgtttacgtgtggatcatatttttgaaatatttttttgactctattttaaacgtatgttcaataactggtttgggcgtattacttgaaaatgtatatcctcaaatttattaaaaaaatgtcacaataatggagttagttcatatctatttgtattatgtgtgattcttccttttaaatttttggagtttcccaactttatataacattttttattgtgtatgttatagatgactttaagtaacattttaattttactatatattaatgaaagatattttctattaaaaatatagctaataatactacttcatctaatcaaacataaacttatattacttatattaccaccgtcacgtaaatcgaaggagttaacttttatcccaaaataatagaagaatttatatgtaactaagagaaagtgattttttttaaatactatcacgataatccaaagtacggtatcatactttgacaaatatctatagggtagtgcatgttagttcagtgtctgttttgtttataacacctattgttctaatcacatgagacacctttagtaatttggttaatacatatatatacttaaattagcgtatatattcgtcaagtggtttcttacactaaaatgtgatgtgaaattattatcataacattaattattacatgt

SEQ ID NO: 33359 - DNA, 9070 bp, Oryza sativa
ttaggtattatccttaaattgtagaaaaatctttttttaaagacttccgattgttttactttatcataagtacttttttttgtccttccgtcagatgatatgtaagcattattgtttttttttcaattatctgtacgtacggagtacttttctggtcaacagttatataattttcatgtatccgtatataggagaattgtattatttgtcaataataaatctaatctaattgtgaaaaatgaaacaactaaattgtgttgttttcatttttacaaatatagatttaaattagtgttgtatattcgtcaagtgatatttgacaccctaaaatatgatatgaaataaaaaaataccatagcattaattattatatatattagtcttgtatgttaagatagaatgaataaagatcattgatgggatatttcatatttataatataaatttagtttaaccacgtatatttacataaatttgtagagcaatatatttatcttcaaatagtagataatactatttcaaaagaccatcgatcttttttccaatgatacacatttttttccgtgattttgaaaatactatttcagaaaaccactgtaaataatatttttcttggttcccagtaggtaaacttcatttcttttcccaggtcatatgcacgtactgactactccctccgtttcacaatgtaagactttctagcattgctcatatattaataaatctaaacgcatatatatgtctacattcattaacatctaaatgaatatggacaatgctagaaagtcttatattgtgaaacgtaggaagtacttatatttcccgtatacgtatatagagtaatagggtgtttttaaaataaaatacatctaatctagtggtctaaaatattgggttcaccaatttaagtgaaaatcgacggtgatatttgcttaaatttatagagtaatagattttatatttaaatagtagaaaactccatttttaaagataattgattttttaatggtactatgtatgtatatttttttagctttattgttttctatagtaagtctgtgcatagttttttatttataaacagtaggtaagattgattgtttttagtattacgtatgtacgtacctatatggagtatatacttttgttttttttctttttctggtgaacagtaaggtattagtttttaaaataaaatacatctaatctaatggtttaaaatattagattcaccaatttaagtcaaaatcgacagtgatatttgcttaaatttatagagtaataggttttatctttaagtagaaaaatatctattttaaaaataatcgattttttcatggtagtacgtacgtactttttttggctttattgttttttttatagtaagtctctgtgtgtagttttttttaaagtaaatttcacaaaactacatatactttgaccacaatatcggaaaactacagatttaacactaattttatcacaaaactatagatttaaggtaaaatatcgcaaaactacagatttagtaatactgttatcacaaacatacaggtttaatgtcaatttaatcaccaaacttagatatttataactcaaacataacattagtgcaaaggatttaaatcctaaaatatgtagttttgtgataattttattctaaaatatgtagttttgtgatacttcgtcttaaacctatagttttgtgataaaattgttactaaatctgtagttctatgatatacggccttaaatatgtagttttgtgataatttggtcaaagtatctgtagttttgtgaaatttactctttttttttcttacgatgaacagtaggtaagattattgattgttttttagtctttaggtactacgtacgtacctatatatggatatatggagtacatgtgcttttgttttcttttttggtgaacagtaaggtatttgtttctttttaaatatataataatacatttaatctaatggtccaaattattgggtcaccgatttaagtgaaaatcgacggtgtgattatacattgccacgtggtggcttaaaaacgtttgtagaagtgacacgtgacgatttaaaagcgttatataaagtttaatggacttttagtatataatagataatgcaaacggcgaaaccacacgaaacagggcaatcggtgcacgtttaatttaatcacacaccccatgcacgtcgtcaatgtttttctaaacacaatgggccatggggggcaggccatgtgtccaataatttcgaatcataaattcgtaattccatcagcaagcttaaatttaaattcgtgatggcatgtcggcgatcgatgggcttcattaattaggaccccaaagatcgataataaataaacgcatagaaaaaaaatactactaaatgaacctgacacgttatcagttatcacaagttgaacggaatttcaacagccagacacggactcgacactgttcttcacctcctgcaaggtcaaacccgttgcacgttgtgctcccccaatccgtatttgacgttgaccggtcagctttaacggaggtcggaacggcttaccgggggagcccgcacgaatctcaaagccgcgtggaaatcgggccgccgataccgataccggtggcgtttttgcgtacggaggcagacacgtggggtctgtacccttgggcccacgtgtcagtgggtggtgtggctgactctgggtgtggtaggtgagcggacgtggacctgcggaaagtcgcaccctttgactcgttcaattccgctgggttgtgtggggcccacctgccaggctggcacgccggtgtagcgggagaaaattgacattttgccattgtcaaaacggagtttcgctaaaatgacactctcaaaagtggtttcgttaaaatgccatccttagtcaggggcaacatgctgcaatgccatttcatccatttcttcttagtttaatgatttttttcttactgagatgaccaaaatacccttggatcctatctcatctctcttcttctacctcatctcttcgttgcatatggtggggcggcgccggcgcagctcggcaccgtcgctgaaccgctacgggatgagaaagctggccacaccggggatggcgccgacgccacctttcgccgccctcactagctcgacggcgaagctcaccgggttcacgcacaggttgccgccggtggcgatggcgaccaggaacgggaaaggcggcgcgcctggggatggggaaagcgccggcacggacggggacgatggttcggctcggcggcgcggcgcaccaagcgctcgacttgaacgcgtgccacggcgtcacccccttctccgatgtgctcctcgacatgggcagcgacctgctcgcagcggagctccttgtcgaggcgacctggttacgcgcgcaggcgcaaccaaattaaccccggggggttcagcaacttgagtgggcccttcaaacttggccgggagagagatccacccccgccattggggggcttggtattggagaaggacttcaaaaatcaccaacggagtaaacccgtttgggtgggaattggtggggggaattaatgaggaggacgagaggaaccaatttttgcattcaattttgggcgagagcaaccaaggagtgagatcaatttgggacatgagttcatcggagagagaatgatggtggcggacggaggtgaaagacgctcctggcaagccccacggctgaggcaagggcatttgggtcaaaccaaataagcaaaacagtagaaaacatttgcaaataataaaaattggttgaaatggcagtgtggcaagatggggtcgtttgaagatggcattataacgaagccacatttggcgatggcattctgacgaaaccccaacccgagaatggctaaatgtcaattttctcgtgtagcggtggctgcatgtggggtccacacgcgtccgtggtctggctggacacttcgctgacatgtggggacatcgtgctggggagggtgcgcgtcatgctgacgttggggggtgtgcaccacgtgtacggctttttctcctcctggcttccattattggcagctgttgttgttgttggtagtttttgttagagcaagtttaatagtatagccaactgatttatagccaatttaatagcttattcatataatagttacatactatactattaatacctagccccacctgtcatagacacactgcgtcttggagtccgtgctatagctggctacgaatatgtagtccgctgctcttctctctcctgatttatctttttaaaatatgtttgcagctggcttatagcctgctattgtacctgcttttagggatattgttcgctagggatggtcctcagctcctgatgaaaggattgttagttctattaattaatagatcattgttgattcatcataatttcctttattcaatagcaattcatggctgtagtcgatcaatctttgctgcaaacagcgtaatcttgttactatactgattaatctcagtctggtgaaacttcgatctttcaacaaaaaagaaaaaaaaaatctttggtgaaacttgaattatcagattgaccattcgcccttttggaaacaagaccttgaaatgcgaagcctggttagtcgtatttctcaaatcaataagcttgaccagtctttgcttaatttgcaatgaatttctgtcctggggattctcatgtacatcttgaattgagcccggtagtttgtcaatgcaagacattaagaagtcgtaaatttatgtgcaagtggtgaggtcaacgctttcatctacttcttccgttccataatataagggattctgagattttacttgcaacgtttgaccactcgtcttattcaaatttttttgaaattattatttattttatttgtgacttactttattatgtatagtactttaaacacaacttttcgttttttatatttaattttttttaataagacgagtggttaaacgttgcaagcaaaaactcaaaatcatgcatatatgctcccgtatatagtcccatgcatgcatgccttttcttatacgctaaagaaggcagcacagtgcacactattgacttatatatacgcgtaattagtcaattacaatggcctagtttgatttaattgtcaatagagtgcagaaccaaatatatgggcgaggtgtgcacatatatacatgttgcttgatcaatgcatgatcacaagactaaattaaaccctcaaataattatcacaaatcattctgctattcagggaaaaaaaaactccggcttgctaatgttcaacaaccaccattggtcccatgcatattttttttaaaaaaaaaagaattcctaaagtttttctatagaacgactcatgcatgtaatccaagcaaacattgcaatccattctagttaactgcgaatgaaggaataatgacagtaaaggaaaaaaaaacaaacaggatgtaccttttggtacctgatgttagttaggtcaagaaacgttctcactggttccctaatagctcacaaagatacgtgacgcgtcaagaatatattatacattattgctactgggaattttcaatagaatggcatgatatccccaaatcctgaagccttgtttctttcagtggaaatgtggaatattcagtgtctattcatcgaccttttgaatgatatgcaggaatggaattctatatttttaaatagatatgttcatgctaatattccacttaattttggaggaatatagcaccttgaacaaatttgcagtggaattattaggtttagatatatgtgcatttccctatatgtttacttgcccaattcttctgatcggaaagaacttctcttcgagattattcccaaattaagaattccttgttatgtttacggctggatcccctgctaatataataacgtgtaaagcttttacttgttcaggaaaaagatatttgcagctgcagatttattacagattcttttatcacacagtaaatccggtacttcacaacattggggctgcaaatatcattttccctagtatttttattgtttctaaacagtgcctctctgattttatttatttgtttttttgagggaacattttatttattggtttaataaatttatatactatagacctcatcttttcgcttattcttatactccctcattccaaagagatatttaactatttgatgaatagttaaagtcttattttattctttgatttttctaaaagtctaagtcatatttgtaattattatgtgttatattaaatttttgatcggatcccaagaaatcattttagtacttattagttgcatgttcgttggttttgtcacatgatgaatgagttaactacaccttggttttggtaaaaaagaaatactagaacttagacttttggaaggagggagtacttatcaaccaaaatttgatttttcaacattaaatttgaagctggttttggatttttttttatcgaagtttatttttcagcctttgcttttggatcactaacaacccgtatataaaagttttattcaaaatcactttttgtttgcaaatatgccgtttgttttattccaccagacgatggggttgcatatgactgtttcagttatttttctgcctactgcctttgaggtacacccatgcaaaggacaaatttgcagttttttcaaaggtatagtacggatcaaaaagcgcaagtagccaagagattagatagcatcatacgtaagcgcttacgataccgtacgagaaattatcctttgtgtccgtacaccggtactgcagctaatccaagaagattagattatcagaaagaatattatgccaaaactactgtagagcacagtgtacatcgccgttatattagaaaaaaaatgggtcgctttagtggcatcctgaatagtatttttctctcacgtgggggcttcgtatttcttactaactgaacacgattactgttgaactgttgaagaattatatgtactggtcggttgcgatcaaggcatgttggcgcaaccgtggccaagacaatgttattatgtgacactataaagtgtttgtgggtacgctattaaccattggcttattatcgagaaagcaccgtagtgtactggaagagttgggtgtatatgacttgatccacggagtattaggttacaaagcctgatactcacggatattagaatattttcattaaaaatatagagggaccagagatttatcggtagtcttcatctatttgagcgggaggtacatatgtaggaaaaaagaaatctaggccattagaaatagggtattgaagaaaaaatgaaggaaatttacggtattgtgatactatgaaaaacctactaggccctttagaataggggtggggaaaaaactcaaaactcgaatggcttggattggcttgaacttgtagttttaatgcgtcgagccagtcaccctgcagactgggcttttagctcatgagcgtaaagccaagccaactcacgagctgctcgttaatacaaagagagatcaccatatatccatgtattcagtgcttcttaaccagtatttagtcatttagctacattccaattatttgcatttaattatttttattagttacttcctccgtccaaaattaaatgtgtctaggatagggatatgacattacttagtataaataggggcatgtccaaatttattgtactaggtatgtcacatcgtatcttaagttggtctattttgaaacaaaatgaatagtttaatattatgtttatatatatatttgagaaaaatgataaatttgaaaaatataaaggtgatataaaggattagcctactttggaacaaaggattagcctcaacaaaatcctttgaatttcctgtaggatgacccattttcataagaattgtgaggtaaactaacaaaagatatagccttatgttttctctcccttgagtcttgaagtttcaatgtttttttctggtgctgttaaatggtattcgttgcaaattcccatggttcaattttctacaagatttaacacaacatggtattgtattcatgtgttttctttattggtgtatttttcgaatcctctgttttagaggagccccgagcccatactgatttgtatgtactccatccgtttcataatgtaagttattctaatattttccatattcatattgatgttaatgaacataggaaatgctagaatgacttacattgtgaaacggaggaagtatactgttgtccgtgtataatgggaaaaaaaagaaacatcggtccgccaccgccatcttaaacattttgacgtgattaaaatcgcatttttccaccatctgactttcatcatgttgtcttatttacagttcaaaaattatacatacttcctccatttctaaatatgtaacgccgttaactttttttaatatgtttgaccgttcgtcttatttaaaaaatttaagtaattattaattcttttcttatcgtttgattcattgttaaatatacttatatgtatacatgtagttttacatatttcacaaaggtttttgaataagacgaacggtcaaacatgtgctaaaaaatcaacgatatcaaatatttagaaacggagggagtatatctcaggtcaacgttgacggatccatcatgaatcaacgggagcaagccggcaagtggcaaccgtcagttgtcgtgcatcgctctgccgctgacaaatgctcctactgatccgaggcgttcggaggcgcaccatcacgatccaccgtacgggttagaacaaccgatgtacggatcttcatctgccaagtgcagtagattcgctttttggcatgttggcagtgcccgggttcaattgagaccgaccgtttaatccgatatgaaatccaaactgtacgtttaatacgcataataatactggtagtatcttgtttttctttttctttttttgaaaaaagtgctcgaataatccgtattagggtagttgacttgcatacaaattctcttccaaatccatacaaatactactcactccgtccctaa

SEQ ID NO: 33360 - DNA, 5142 bp, Oryza sativa
tagggacggagggagtatagcttttttaaaatctcatttcctctcgcctctccataatgttacctttttttattgttgaatgaccaccccttaatccttctacgcagtggcggagtcaggaatttaatcctgtcgggttagttactagcactggtttgtatttaagcgaggtcatttctttaatttttctagatatatacatgaaaaatcaaggtctacaggggtattgtttaaaatgctgtgggtcagcggatcccacaatttatacatagattcgccactgcttttacgtagtcatcttacttgatcatcggccgatcacgttctctcacctcaatttcctatgttttattcccgttgcgacgcgcatacacgttgctagtcctatttaatattgaagctaagaaggtggtgaatatttatatatggacgtaaggaaatccttagtacttctacttaccaatagagttagacgaagcttccacactcaagcttaaaaattacaataatgctcttaatcggagaaccgatcctaggcggaaatttaaatgtccacactactcaatcactcactcatttttttatgggcttctaaattaagagaaaagtacaaagaatcccttgagaaacacataatagggataaactcaaagttgttttctatcatatatcattataagagcaagttttatagtggagatggcaactatatctccagttttagttgcatcatccactcactgattaagaggcaacatgtaaaacaatttaccttctacacacaaactccaataatttttattggttcactctcacattatctcactttatttttggtgtttgtataaaggttgctctgtgcatgagtggtgtctcaccctctcttctcacttctcttctccatcttatcacataattctttatggcatttctagaggtggcatttttagaggtagcacaaaaatctgatctagtagtacttgctctaagtgttccttcttattattaaaatttaaatggtaaactagaatttctgtagtggtatggtcagactttttttttttaccgagaaagataatactccctctgttttaggttataagacgttttgactttgatcaaagttaaactacttcaagtttaactaagtttatagacaaatataataatatttataataccaaattagtttcattaaatcaataattgaatatattttcataataaatttgtcttgggttgaaaatgctattattgtttctataaacttagtcaaaattaaagtagtttgactttgaccaaattcaaaacgtcttataacctgaaacggagggagtagctaggaggagccgaggagctaataatctttaaattatttaagtttacgagtataagaaatttaaatatttaaattaaggtgctaagaaatctctacgaaaacaggcttggttctaggttcaaacctaggatcatcattaaccgacacacaccaaactatagtttccatgtggtatgactgacaggtgctttgtcccgtactttcctattcatatttatgcatgtgaggttgatgcctgccatgagcatcaaattcaaccgggggtgcaatgcatgttcgaaggttgttgggtgcaatgcatgttggaaggttgttggattctgcatgcacatcccatcaaacctacaaccccctgttgttaccaaagggattaattagaaaggtgatgtgcctgccctcttggtatattatttgaggcacaaattaagtgctcaatagctcgttctatcatgcggcttcctgttcctcctactcccaataatttgtgcaatgtcatgtcacgaataacacaaggttggccggcctttttgtgtggaggcggccagcgccgtaattcacaagtggtaccatcgtcttatccgtgtcattatcgttacggacctggttcataaatcttgtagttacaaattactttctctaatatagtagtataattggatgcacccgacactttgatatcctttttaagtgtgaacaaatatttctcaattttgaaagtgaatgcgagtgatattgaaaaaatgatggatcgaatttgtctaaataaaacttttattgcatttcaaattaaaccttgggattactatcaatgtcaaagcaaggatttagatatatagggaaagagtctaaataaagactattctttccgtcacaaaatataataacttgtgaacatttttagatacataacataaaaattactatattttaagataaaggtattatttcttaacttaattacttgattaattggataaccgtaaatgaaaaaagttggcggagggggctagccgtctgacggtccctccgcgctccatttcctgtttttttatagagaaatctacaaaccacttaatgacttgactcgcgaggtcgtggtcagtaaacataacatatggttctttcttatcaccagaaactcgatcaatcgagatgtgatgagagcacttggagtgaagaggataatgacagtctctgcatctctctctctctctctctctctctcctgatcaactgtccatcattataattaattatttgcatcatacccaaatcccaacagtggcctccaacgcatctgtctccctcgcttcggtcgctcgaccaccaaaattgccctgcactgcactgtgcggtgcgcctgcctgttcatcacagctttacaatgattgtgtagtgcaccatcctctgttcccgttctagattcagatgcatatatagcaaaggagtgtgacaaggttagggagctgtttgaatgccaaggtttcaaaaatcgtttgccgatcgaataccgctcccaaggggtttcttctgttttcgcagtaaccgactgaatttatcgaataaaataatctttgtttgattttttaaaaaaaacttgaccagtttatcgagtggcttctcaatgtgggagcgattcaactaattaccattgttttcaattataattgttggttttgtgaaccatgttgaatatggtattcactttgacaaaactttgaaatgctaaagagaaattaatctcattatattttctcagcagagcacaagttctgcaaaattccaatatgaaagttgattctacaaacgcttaacttattttcctctctctgttagccttagccaacctcctttttcaatgactaaaatactctccacattttcctttttagaattcttgacgaatgatatgtggcgcatgtgtttgactattgacgaatgatatgtggcggcagcccatgtggtaacctggcccagtgtcttgtggctttgtgcatgctggccctgcaaatttgatgggcctgtacttagttagcttcagtgctctacagtagttttggcccttcggcgagtcatttcacggtaaccactacagtatattctttattgatactacagtagtagtaagaaatactcctactaagtgataccccgtgcttcacagtatgtatggataaatttgtattaaatattatagaaattatagataaatatatgttaaaatattataaaaattacgtgaggatgatgattggaaatatttatgtgtaccatgtttgagtaagatgagatttaaatcgctatagaataataattgctattgaacgatgatatgacatatttagatgatgatcggaaatatttatgtgtaccatgtttgagtaagagataatagttgtgagcgagtgtcaactataagggttatcgtcaattggatttcgcttacctttcgagaagagaaaagaaaatagaggaaaagaatgtagaagccattgttataagacgtttttacttaggtaaaagtcaaactactctaagtcaaactactctaagtttaactaattatataaaaaatagtaatatttacaacactagcatagtttcattaaatctaaaattaaacaattttttataatatatttgtcttggattaaaaatactagtactacctttttcctataaaattagtccaacatagagtagtttgactttgaccaaagttaaaatgtcttgtaacctaaaacggagggagtaaatatttttttcaaatacatataaaaaatcacatacacatacataactatgcgcatatattattgaacgcgcaaagatatagtctagaaggggggggggtgaatagactttactgaaattcacaaacaaatcgcggcggaaaaattcagcaggaccggaacttccgggtgtagaacaccgaaacttctggtctgctcagactgtccggaacttccggtgttctaaataccggaacttccgagcaacagaaaaactgtaaaactagcggacacttaaattaaattgcacgaaatgaactataggaggacagagtagatacacattcacaacaacatgcacagaatcatcacagagaagacaaaggcgattttttcccgaagttcggatctttcgatcctactctccgttgaggtgctccaaagagccgggtctcgattaaccccttgcctcacctatgcaaagaactcagaagaagtccaaggtcttcaactcaacactcctaggtcattttctagaatttgagtgaccaccagatccaactcacaaatccttctagaaaagaccacaagtgcaagttgctctaccgaggagaacctctgaaatctcagcacaagaatctttactcacttacctcgtttccttgtggaggtgaggaaaaccttcacaaactttcccgagacatccacaagatctttgaaagctcgcgggcgacacctaaccgtctatgagatgatctccacgagtaataagcctcaagtgacagcccacaagatatccaaagtactcaaccacaccagtattcaaagcttctccaaatcactcctacactctcatctattctcacaatctcacaagaaagactctagatttgagtggaggaagcaaagggatcttgggagaggctagaacaacctagggtgtggaagaactgaagtgaaatggccaaaaggtgtgctgggtgtgatttggatatatataacggctaggtgatgtcatctagccgttactcacaattttgaactggaagaagtccggaagttcctgaccct

SEQ ID NO: 33361 - DNA, 3661 bp, Oryza sativa
cttccggccaacacttaggaaaatttcagccaatgcagggtccagaagttccgggtccagggaccggaacttcctgccagccttctctgttcggtctggacccatttgaaaaaatggctctcaaaaatattttatcactaggaacccactaagagcacttttttatatctcagaacaacacttggaaccccctcttaatagtacggtttttactaaaactcgattttaaaaattaaactatcctattgaccttcgagcttcaaatccgcttgaatgagtgttgttgggggtctccaagcatctcttgatcacctaagttaactatgggactaattaccttaaagtctcaataaacacattagtcccttaaccttattcatcattaatcaccaaaacacattaggggataaatgcaacttcaattatatgtgcacatacatgagtacaccttgtaacacagtggggattgtctgtagtattgctgatgcagtagcagacaccgatgcgtgggtccggaggccatcgctgaatcccttccctcgtattaaaatgcacatcgacgtgtactccatgaactcgctgaaatccgatcaaaattgacgcacccgctttgtaatcactggccagactaacacctgtttaaaacatacttgtgtatacgtaatattaattagcaacataatttaaaccttagcgattagtgcatgccccaacacttctactactacgcaattcagttcttttccaaattagtgcatactcatacaactacgcgtacacgaactcacaaagtaagccttatgatacagatgttggaattaatgaatgggccttagcccactcaaagattaattctttgaaaaatcacaaaagcccacctcatgggatggcatgcatgtggagtttagtaccaccttgcttattctaggaaagggagacctccttaaaagggaggatgccctcctagccacttgaagcatgtgtggtggagagaagagggggaacacacacgcgcgctcgctcgcctggctgttttgttttgctgcctctatataaaccgagccgccgccttcacgcaacacacgcgaaatcaatctagggtttgcctcctactctgtgctgcgccgtcgctcgtaggttactccatcctgctcgccggtgtgcacctgcgatcgggagagcaggtctccggaacctctgccttcgatgtcctgcaccgggagaaggcggcaataaggtttttgggaagcgctttgcgcgactgctccctgttcgtccacgacggctcgtcttcctcttcgctcgcgcgttgcgtgccttcgtagacacctgcgaaaagtttcgaccgagtagccggtctttccgccacctcggtacgtgttcaatatgttgcgcatgtttgatctgttcatgttatactgtgtagtttacatatatagatctaatgatgcgttcatgctagttttcatctgtaatgtcatgatttatttatggaatatattaaatcattatatgcctataatctcaacaatccaaaaaccttattataggcactgtgattttactatggctggttttgccgatgcactgaggccggataaattcaccggtgcattttaagagatggcagatcagagtcactctgtggctgacagctatgaaatgcttctgggtgagtactggcaaacctgaaggagttcttactgctgaacagcagaagcaattcgaggaagccactactctctttgtgggatgcattcttagcgttcttggcgatcatctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctatagtcgaacaggctcatgatatacaaaccatggctaaggaactcgaactccttaagtgtgtcttacccgacaaatttgtggtcgggtgtattattgcgaaactacctccatcttggagaagtttcggtactgcactcaaacacaagagacaggaatactccgttgaggggttgatagcgtctcttgatgttgaggagaaagctcgggaaaaagatgctgcgtctaagggcgatggtggccagtccagtgccaatgttgtgcacaaggcccagaacaagagcaaggggaaatacaaagctcagcagaccaccaacttcaagaagcagaagaagaacaacaataatcctaatcaggatgagaggacttgctttgtgtgtggtcaacctggtcatctggctaggaagtgtccacagcgcaaggggatgaaggcacctgcagggcagatttctaagtctgctaatgtgaccattggcaacactggagatggaagcgggtatggtaatttacctactgttttttcagttaatcagtctactaattggtgggttgatactggggccaatgtacatgtttgtgctgatatctcattgttttcttcttattaggtcgcacggggttccaccgtcctaatgaggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactgcagcgggaacaccactgcacaggcatcctagacggcacggacgaagcctacttctcggggaaaccttcatctgacataaactcatcctctggggttgggaaaaggagagcaagactgagtactacccactgtactcagcaagtcatcccggaataggggtatgatgcagggaattaacaaagaagagctagagtggttcatttgcataaatactggcatttataaacaggaattgaatacgaaaacggttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcgcggctattcgaatagctttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggtttcacccccactccttgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataag

SEQ ID NO: 33362 - DNA, 4911 bp, Oryza sativa
taagactactgaaacagggaacaaaaccatttttaatggattctacacatttttcttgatttactgagacttgaatgggataaacggagctcggatgaattagttatgaattttagaagattcactgtgtttattactataaccataatccttaaatactttattgcgcaataaattccagggctgacgtcagcacaggtggcgcggcgccgacatgcggggcccaccggtcagcgacacggggaggagagaggaggcgtcggcccgcgggcccaccggtcagcggcacgggaggggaaagaaggggcggcggcacccggcgcgaaccggctcaaggccggccgaccgaccgcggcgacggcgacggcgcgcgcgcgaacgggttgccggcgacggcaaccggcggcggaggcgacgcaaaagcggcggcagcggacggcggcaacgacccaaagcgacggttagcgcgggtggcggcgacgcacggggaaacggggaaggagaggagaggagatgcctcaccgagggtggccggcgcggaggaagacgatggcgaacggcgacggcaggccacgggaggcgacggcgaccggcggacgagcttcggcgtgccctaaggaaggagaagagagggattagagagagggagatagaccccggcgatcggaaaccatggccgaaggcggcggtggagatggcgctcacccgtgcgcgtggggatgagggctccggcgacgaacctcgacggaggaggggtggacgaggtggacctcggccgcgcgaagctaacggcgacgacggcgcaagacggcggcgagcctagcggcggctagtggcggccgaagtagcaaaaacggcggcggcgggtggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggagaagagagaggcgggattcggttttcgaatcccggccatctcgggcgcgggcgcgagcgggagagagaggggaatgggcgcgggagacgcggcgcacgcgcgggcgtggtcgacgtggcccgaggaaggcggagacgtgggcgcggcgacggttgcgggcgcggcggcgcgccggaatcggcgggaggagggagacgggtccgacaggtgggccccacctgtcggcgaccccgagagaggaggcagcggggcggcctggctgccggctgggcctcggcctgcggccggcccaacagagaggagggggaggaaaaggagaaatgggccgacggcccatttgacaaaaaggaggaaaaagagaggaaaaagaaaaagaaaaaggaaaaaggattttctctggaataaaatattgcttgctcaattttaattggttgaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgtaaattacgattttggcttgggaggaaaacttcggggtgtgacagtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtttcggctttccagcatgtgtttaattcctaagttttccattgtcaaaggttctaagtgccatagttgtgtgcaatcgaagcaacctcgcaagcctcacaaagctgccgaggaaagaaacttggcaccactagaactcctacattcagatctttgtgaaatgaaatgggtgttgacaaagggtggaaaacgatatttcatgactttgattgatgatgctactagattttgctatgtgtacttgttgaaaacgaaagacgaggctctagactattttaaaatttataaggcagaagttgaaaatcaacttgacagaaagataaaaagacttaggtccgatcgtggtggagagtttttctcaaacgagtttgacttattctgtgaagaacatggcttcatacatgagaggacgcctccctattctcccgagtctaatgggattgctgaaaggaagaaccgcacactgactgacttggtgaatgccatgttggacactgcgggactacctaaggcgtggtgaggggaggcattgttgatctcgaatcatgtgttaaacagagttcctaacagaaataaggacgaaaccccatatgagatatggattgggagaaaaccatcactttcttatttgcgcacatgggggtgcttggcgaaagtcaatgtaccagtaacgaagaagcgcaaactgggacctaagactgtggactgtgtctttctgggatatgctcatcacagcattgcctatagatttttaatagtcaaatctgaggtacctgacatgcatgttggtacaattatggagtctcgtgatgctaccttctttgaaagctttttcccaatgaaggatacacatagtagttcgagccaaccatctgaaataattcccggttcaatcacaccaccagaacaaactgaacatacacatgaacatgtcactaaggaggatgacagtgaagctcctcgaaggagtaagagacaaaggacggctaagtcctttggtgatgatttcactgtgtacctcgtggatgacactcctaagtcaatttcagaagcatatgcatctcctgatgcaaactactggaaggaggctgtccgtagtgaaatggattccattatcgctaacgggacttgggaggtgacagagcgaccctatgggtgtaaacctgtgggatgcaagtgggtgttcaagaagaagcttagacctgacggtactattgaaaagtacaaggctcggcttgtcgctaagggctacactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaagctcctaagcaatggcatgagaaatttgacaagacattgacatctgcaggcttcgcagtcaatgaggcagataaatgtgtgtactatcgccatggtgggggtgagggagttattttatgcttgtatgttgatgacatactgatatttgggacaaaccttgaggtgataaatgaggttaaatcatttttgtctcaaaattttgatatgaaggatttgggagtagctgatgttatcttaaacattaagctaattagaggtgagaatgtgattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgcgcgcttgagcgagtaatgcgctatctgaaaggtactgtggaattggggcttcactatactgggtatcctgcagtactggagggttatagtgattctaactggatctctgatgtggatgagatcaaagccactagtggatatgtcttcacactgggtggtggtgctgtttcatgaagatcttgcaaacagaccattttgacgaggtcaactatggaagcagagctgacggcactggatactgctactgttgaggcagaatggctgcatgatctattaatggatctgcctattgttgaaaaaccggtgccggctatccttatgaactgtgacaatcaaacggtcattgtcaaagtgaatagttcgaaggataatatgaaatcgtctagacatgtgaaaagacgattgaagtttgtcaggaaattaagaaactctggagttataacgttggattacatccaaacagctagaaacctggcagatcccttcacgaagggactatcacgaaatgtgatagacaatgcatcgaaggagatgggtttgagacccatgtgagttatactatggtggtaacccagtctatgtgatcggagatcccgtgaattggaatctgggaagaacaaaccataagtaaattagaggagagtaccaatctataccctctctaagtgaagatgcatgtactctcgtgaactgcaaggcaggttgactatgccttaatgagttctgttggctttaattggcgaagatgctgtcctgcagagcattcttgaaagaactcacctttgtgagcttgattgttggtcgcagtctatggagattttgggtgaatcttctaggaagcttactaaagacctaggagtatgacttatacgctccacccgaggggtagtctacagacggtctagtaccagataagactctgagtgaaacttgcttgcacaagacttgcaattcaaggcttagtctattgttcaagttgtgagtaagtgtagcttggagttctaggtggatgttcacccttaatcggtctccatcgaact

SEQ ID NO: 33363 - DNA, 12641 bp, Oryza sativa
  unsure (1)..(12641): unsure at all n locations
gtggagtttagtacccccttacttattctaggaaagggagacctccttaaaagggaggatgccctcctagccacttgaagcatgtgtggtggagagaagagggggaacacacgcgcgcgctcgctcgcctggccctggcctggcagggcaggcggcgctcgtgcacgacgtacgcgtcgaatggtccgtcaaaattggttcctcaccttgcgcagatgcagtctcctttggcagttttgttttgctgcaaattcggattcgtttttgttttggaaacatttcgaaaaatccggtgcgtgcaaacggcgtggagtccggataagttacgcgcgacttatccggttcggttacgcgcagtggagatcgttcgggcgccctgatcaagcgacccttctctatataaaccgagccgccgccttcacgcaacacacgcgaaatcaatctagggtttgcctcctactctgtgctacgccgtcgctcgtaggttactccatcccgctcgctggcgtgcacctgcgatcgggagagcaggtctccgaaacctctgccttcgacgtcctgcaccgggagaaggcaacaataaggtttttgggaagcgctttgcacgactgctccctgttcgtccgcgacggctcgtcttcctcttcgctcgcgcgctgcgtgccttcgtagacgcctgcgaaaagtttcgaccgagcagccggtctttccgccacctcggtacgtgttcaatatgttgcgcagtttgatctgttcatgttatactgtgtagtttacatgtgtagatctaatgatgcgttcatgctatttttcatctgtaatgtcatgatctatttatggaatagattaaatcattatatgcttataatctcaacaacagatgcttaaatagaagaggctgtatctccatttgtattgtaatattttacaacactatgattctaccaaattgaaacgataccgatcccatctaatatttaaattagtttacatagtattttcatacggttctatggaatcttagatattacattgatttctatgatctttataatcctacaaaatattattaaaaataatatgaataaatatgcttaagtttacataaaactgattaatttttttaaaatcaatactatatactataatttatacacaacacacacacacacacacatatatatatatatatatatatatatatatatatatatatatatatatatataatataaaaataagtactttctaaaatttgttagtattccaatcctacttagcatctcgatacggattacctttggatggagtggagccaattgtccctgtgtcacgaaaattgaattgacgaaaaataccctccgtgtgagtgtgacgcaccttacatcccagcacagagggaggtggagagcacgaatctcagcgcatggcctgcaccaaacatgatactactcggtgcagcagttagtgggcccgcattgccattggctgcagggaccagcggagtgggtagcaacgacggacggcgcaacgtgtgggcacgcgacaccgcacagcaaaaaaaaagggtaaaatgtcgggtgcaggcacaaccccaagtaaccaccactgaccaaagggccccacgtaccatcctaccccacctgtcagcgtgcgtaccgggtacagaacccggtgcaaaaaagaacaaaccagggccgtttcacgctttaccagcctggcgcgtcgcgtccgtccacatgcccccgcactacccctcccctccacatggcgcgccacacccacgagaccaccacgtgcttgaccacatgggcccacctgtcattcactccaagatctccggcccgggtcacgcgcgcgcggccgcattgattaataagggggaggggaaaaaaatctcccgtgggccgctgcaggtgggctccacgttagctccgggcccacgtgtcatcggctatgtaataataatataatataataataataattgcagtatataggggggatatagtcgcggtcgcggggagccctaggcgagcgagggagaaagagagaggcgttggtcggtggccgcccgtcgcttctcctcttccgacgccggcgcggccgagagaaatggcggtggctgcgagggctccgctcggggtggtggcggtggtggccgtgctcgtcgtcggcatcttcatgcccgccgcggcgcaggccccggcgcccgcgcccgtcagcgacggtgaggatatcgttgcccgcctctctctctctctctctccctctccgaagccgcattgcgcgccggagttctcgtctgctccgtagcctagcgcattctggttctctggcaccgtgcggcggctgactggttccctggttgttccccagttgttcgtcgatccaccaaaggggaaatttaatgccctctcgttaagagtagatttaattttgttttttcgacctgcgcctgaaatgtagtacgcattaaccttttttttttcagcaccagcatctatagcttgcgttagatccctctttttctaattttagacgttattaataattctagtatagtagtattggaccgagcatatatttagtgctataaatcattcaaaatcttcggcagattcggatctctgttgtgacgtccttgaaatttcctttcaatttcagttccatttggcaatttctgcagcgcattacacgaattaaatgctatatgatgcaaataccatatctctgttgtagtgagacgtatactagaacgatctttttttgttttgttttccaattactagatgatgtccaggagtagttgatctattgggcgtgctggatagatccacagtttacctttttgttgcaagtggaggcaggcagcttacacttgcctgtcattttatactattattggtggttcccgttcctggagtagctttcagttgatattggttgccgcccctttacacgtctctgactgatgttacagtttgggtagcctgaaaatgaccacaatttctatcaaaatgtgccatctgtaacaactgattagtggaggtggcaggtattacaactttacaaggatgcgccatttgtattactgaacgccgcaaatggcttatctttgtttagttatgaccttgacatataatctgttttaacttcggtttattattacgagtcttggtaacaaaactgtaaacaagaacaacctgtgacattttatagtatatgcaagagacttaaagttccattttctacttttctaggcctcacagccaacaattctctatctttgtgatcaccttgtatgatatgcttgttatatctctctgttcgcacgaattgaattaaaaaagcaacgtggtaactgtgatatgccatttcctatcaacatagcttcactatttttttttgttatgaacctagttgcaatttgccacatgctgttggtttgctatctattcgataactttctccatatgctgttttgatttaccatgacactgatgtgcattttgctcctgtaattgctttccgcaggcacatcgatcgacctggggatcgcatacatcctgatgctggtggctcttgtgctcacctacctaatccatccactggatgcttcttctccctacaagcttttctaatcccttgttcttccttcatctggcttggttagggtaaattctacttattatttagccatggcgacgattgttaacattttaggtgagatgttaggaggtttggagtgatttgtctgtccatgatgggggtggtatcaatcagatcgttgtttggtggtgcgattggctgtattggattccatgatttggtgccaagttgtgcgtgctggattcgttcattttctgtttcttttttagctggcctgtgactggttggcatgtgctctctgacgtgcggtggttttgtccttgtgacaactattgcgcctgcttgcctgctctctgtgtgtgtgttggtgctcgtcagcactactgactcgatgacggtttcggtttctctgtgggccgatgcaaatggtcattgttgtttttattcccaccttgtcagtcaaaaaagtttcaaacgactttcttcctgtgaaatagtagaggtaggccttgtttagttctaaactttttctttaaacttccaacttttccatcacatcaaaacttttctacatatataaacttccaacttttccatcacatcattctaatttaatccaaacttttaattttggcgtgaaataaacactcccgtagtagtagtagtagtagtagtagagctgataagtatcccttccggtcataataataatcatttgatgacaagatttgagcgctttgtgtttttggtgacatctcggtttaaaagggagtaaatttaattgtggtagacctgatgaacctcaaattaagatgcatgccgcacggtatataatccggattgtgttaagacggacgtaatcctgtctgcaacataagggagagcaataaatgtgttgatggctcgagtttagtcatttttaacaagacttttgatgttgcatggatccaccgttgtttatatccgataattttagtgcctcgagtagtgagttaagttgatatgtgtaggtaacttgtgcacgaaagaggatgctttggatgatctgatctgaaatagtaagaaactacgaagatgcgtcaaaaaccacgcagcacctaaactgggttgggcctaattaggctgtactaagggtgtgttcggcaccccttttcccccttttgtcacgtgcatgtttttcaaactgctaaattgcgtgttttatttgcaaaaagtttctatatgaaaattgtttaaaaaaattaaattaatataggcaaaatatataaatagtagaattaatatttccttaatagagaacatatggaaaatgattttattatttccgtgctataaacacatctccatcatcacgcaacaaagtaagcctagcaatgctttagttttccttcaaggcactaaacgaacgtaagatcagggcatccaggaagtgcccatgcgtaaaaagttggtaaaagattattttaactcttatctggcataaaagtttagcattgacaccgctcaacaatttaaaccaagaacgccaacttagatcagatgcaatgcaatggtgacacagctcagcaggtcttgcacgctttaattctagacaaattgcagaccgtctctcaggaaaagaaattgcgtgtgtcgaatgcataaaaaaaaaggtagacttcccctacaaacaattcgcgctaaaattgattattgctgctatccaatctgaactatctatggagtattaggagttaaaatttggatattcgtagatgaataataaccaaccctgtctttccattctgttcagtaatagaataaaaaatgacaagagccttattttccctaaattctctgaaaaaagaagaaattctacctctttatataagatttaatgaaaattgagatgatcactccaatcctttagttatattcaatcttgtaatcttgtatacttaaatttcaatcctgtaaccctgaacaaaaataatatatatgctccaataaacatcttcaatttcaatccagtacattgccaagacaaagaatagcaaaagaattatagtgaaaatagcaggatttctgcactcccctgtgttatatgcctgacatatattgtggcattcgatcgtagcctagatcaatctgtcctacaggataaaaaaaatatcataatgcaaataaacaagagatgctagccagtatagtactgttttggtgctgcaaaatttccttggagcaaactgtatcctgctgcctgttcatgtccattggtactgccctgcaaaatcaattggaagcaagatctactgcaaaaagggaaatgtaattgcaggagaacagagattggccaactcacagcatggtttcttggtccttgattgggtacatcatattatcctccatcctctgattgaaccaaaacaaaaattcccactcaaatctaagaaacataaccacatatcaaccccaaatcaaatgaagtcccaaatccagctatacaagagcagcacaaatttgttggatctggagaactaacatttaagggcattgtgttggttttggagaagaaaaaattctggataatacacgtatgtgcaattgtagatatagcgatagcacctagccgtgaggtccacactcaccaggccgaccacagctccccctttatatggtcgtactgttctggtatgcatttagcaaaaacattttctgaattcctcataaaacagagaaatgtcaatctctggaccgtaggaccagagatggggaaccaaattcactgcaaattaaggaaccatctgtttaacttttcacatagataaaaagaaagtagataaactttatagaggttgttgaggaaatatcataaataaatccaaattaaaggtcaccatatctgacaaattaaagctacacttgaccatagacaaattaattaaccgggcttgctagaaaaatctgagattgatttggtagcaaactgcacaagagtgcaatgaacgcacgggcatacaagcacctagaggaatcgatttcagataggttcagttggcattataaaacaatatgcaaacacctgaacaagcacctagaggaaccaattttaaataatgcatggtatatataatacaagtgcttctgaccaccatattctagataatcatgacacattgttcagaaatgcttttgaccacagtttttcaggtctccactgatttaaaattcagaaatttattttgatggattattaggaaggaaagcagcaactaccaaaattcagtatagcattataggatccaatcaaacaaagtaaaaatacacaaaactcaacatgtataaatttgacaaaggataaactgaccttgcaataaattaagagcacctcaatttcataaactccttttgttatctcatagctcattgtaagcagatattaggtgcaaaagatgatacttacaaataaggatcttgtattgatcagttcaacaaccaaacttctatttatcactaatcaaaagtaggattgtactgcattgatctgaaaaaatatccgtcgcatgagtataaggaggtcaatagtgcagatgatgtgtagcatgactacaaagtttgccggaatgaccgaaggaggtcattcaatgtaattaagataggaagaaaaagttacaagaaaaatttacatcgatagctggctgtcgaggaaggatgtgcaccagagcacacgccccgaaccatgtgccaaccgtccgaacacacactacagagagggaagccaagcaccgaaccggccatcgctatgcgagaccgatcgccaccgagctaacgacaccactacgacacgaagactctaaaatgacgccctcacgagggtcgcgacgccaaaagacgccgtcgtcatctatccaaagactggacaaggttttcacccagagctccttgccgagggaggagggatacctcaacagtgccctcaagagggttactacgtccgaaggcgaagtcactgttggcccaaagaattgggctaagctttcgctcggaaccccctgcccccgtggtacattacccaatccgaattcaccatctgaacatcggcggcacatgggtttcggcacacccgaccgacgccccttcgtngggcggcttcatcgaaccaccattcctgagagctggcccaggacctcttcgtttcaccacccgccgggcttcttcgcagatctgggcgaaggagaatccgggattggatggcatttgttcagcagcctgagcttcccccgctgacgagctgccacctcaatccagcttagaaactccccacagagaaggggaggagctccaggaagggtgagggtgttgaccggcaacgaggaagacgacccaccgccgccagctcccttagcacaaccatctgggcctacgccgacgccggaaacattgccgctctggctccggcgccaccctccggcctcccattgcccggccaccgctccccacctggccaccacggcgtaatgctggcagtacttacagcttacttagaaaatgaatagacacatagacaaccaaatttgcctcacatgactcacctttgccgcactcaatgtatcagctctgagtcctttttgttcataagcgaggaaggaatcaataagggagtactgcaatgttaaacaaaccaacagatcaaatccctaagtaagaatgcacaatttcttaatataggaaatatatgttcaaatcccaaaatgtgagtcatgttctgtacaatcagtcatcaatttcagtaaggaaactatatttctcataggcatatggactcgattatgacataatttgactataaatgaacagaataaacttgcagggatgtgagcgcatgttacttgcatgtaaggaccttgtggatattgacctgcatcgatagttggattgtgctgcagtgaacaacaataagatgaatttcatgagcataaacgggaatataatattgaccaaatgtaaacctcactctaataacacaaatggtcccatttatacaaaagtctgcttgtttttatactcactgtttgtattccgatttaatatttcatgctatcattatgtcaggcaataacaagcatccgaactcatccaattgtagaagttatatcatatagatagtgcaattcagtttatattttatttataatggccacgatcaaaggataactcatcagctgaatgaaattgtcacaagagaaggtttccaatactcaccttggagagagcagatagcatgacaatcctgatggggaagggatgattttgatttggaataaatttagcacaatatctacctaaatgaaatgaaaccaaatcaacgagagagattcaaaagaaaataccgatgacatcctaactgcagcaaccaaatgcagtttgaatgttttcaccagtaagttcacaactcgggcactaccataatgagctggtttcaacttttcacaaaaaaaagattctgaaaaaaagaaggcgggttcatgagatatttgaccatatttattcaatagttgccgtcaacagtggaacatgcatgacataaataaatataccagtggtgcaggcattaattctcttaatactccaggttaatatcattggttctgaagcgatctaccagtggtgcatacatttattttcttaattctcaaggttaataccactggtccttccttaccacttgaggctttgacaatgccatcagtccatattctaaagatgatgaactacaacacaaaatggacagttctgtaatttaaaagtaccgaacaaaatctcattaagaaatatgtatcttgaaccaaaacattcagactgaagcacctcgtgtatttctccgggctaatgatgccagggtttaactaacaaaacataaaccagaacggagatcgtaaattattggctttttctaaatagcaacataatgatatcttgggttttttttctcactgaacaccttttgaatcaagaagaaggaacgcctgctggttttgaattgaaaatcctaaaatgcgttctctaattacattagatcagactaaaaacaaaatcataaacaacacaatctgctatccctactgacatggaagaagcactatacctttcatcatcctcaaaacctcaagctacaacaatcaaaatcgatgaacaacatcaagagtaaggacaaattagagaatcggaaggaagcagcagaggagtagagtagcagaggagggaagcagagaagggttagtcgggttcgtcacaatggaggagcagatgaggaaagaatactccctctgtttcacaatgtaagactttctagcactgctaacattcatatagatgctaataaatctagatattactatatatatatatatatatattcattagcatatatatgaatgtgggcaatactagaaagttacattgtgaaatggaggaagtaccattttataacaccaagccttcatcacgagccaatacaccactactccctccgttcaaaaaaaaaaaaaaaaactctatcctaggatatctagattcgttgtcctacgataggtcacgtcgtatcatatcctatgatatgtcacattctatcctaacttgggttttttttttttaacggagggagtacttattggcgatgcaatagccaacggctgtgcatgcagtcaagacctgcatatgatgccattgaactggtgtacggtcaacttgtggtgtaactctaaaggagaacgtgaggctacctatactgagaggcggaggcagtttctgcgcgtcgtgtgaggccatggctgtcataaggaagatgtgtgggagagaacccgggtccatggcgaagatcagagccggcacagccgccatcgccagggcagagctagagcgaaatggagggtggtgccatttgcttaatttactctactttagatcgagtttaagctgatgcgggtgcctaagtttgtattgaggggggtgcatgcatggtgaaaataggtgaggtatagctaaaaaattttcttgaccgggttcctgggcaccccctattacatagtagctccgcccctgaattatttgccaccagcagaagccaccatgagcagcgccaccaccaccagaagcagcagaaaccgtcgccattgaactctggatgctgagggagcgaccgtgaactccgagaccgagttatgtgctaaactatattgactaaatatggacaaaacttgcatcagtaggttttaaaacttaaataaaatcatctacatgcacctgaattcacatggagctgctggtagcaaaaaatagaaactcacatttcctaatggctgacatatatacttgatcctagcatgtttgacaattctcaagggttgaacacaaattcagtgactacaacagaaattcagaactcatgtgaatcctcctgaactcggatgcattttgatttttgaaatgtattgtcaaatttaatcatagcgttagcacggggagaactcatgtgagtactcctgactagaggaaaaaggaaatgcaggagtaatacattacaaatgtcatctcttgaggtgctaaactgtcagatatttttccagaacaaagcagtatgaacatgatattgtactgccagatatataaatttgaattcctcagattacctcatagcagcctagcatgtagccttagatttaataaatctccaattgcttcagctggaaccacaagttgaaactaaaatgcagaaaacaaacaagtcattataaataccctttattgacatgttcagatccactacaaaagaaattgatggtgagactatactatataaaatgtcatctcacagattatataccatgtgtatataaatttggtggtggtatataaaactaactgagaaatgaatcatatagaggtttggtggtgatatctaaaactaactgagaaatgaatcatctagaggtatagaacagaggcaattgagagccgtagatcttcctattattcccatgttgtgacagtaaattttcagacttacctatcttatatttttcagaaactttcagtgttaaaatagatgatgttgcatccctatgtatgcctatattttatatatacatgtctattaagagaaaagttctgctgcagcagaatatgcatgacaatactaaagaccataagagaacatgtaagtaaccttaaattaaataaccgtgaacaactgacatgtgtaagatagtaggtgttgtctgattttagagttaggtatagcaatcaagagtttaggttttcacctagagattatagcatgtgggttcacaaaatctgaataactggagctgtatccttaaagcatcaatctgggaacagaaaaatgcaaaagaagaattcgtccggtgaaaacatgtgggtttgcaagttgaaaaatggaaaattcaatacattggggatgcaacaccatctatttcaacatcatctattggccggcggaggggttcgatatagtagaaggcataggttactaaggaggtttcatacatttaaaatattcatgtatagatttgaaagaggtttgaattatcaaatgaaaaccgctgctcacaaccatcaacttgaaagtcccaactcctaaaaaccaaaatctatagaattcaatattagttcgattgctaggtttctgaaattgtaatctctactgtcagtcagtcccagtcaacaaagcatcatgtatatagaagtgattccttgcatgagttgaagtcaacatgagcaatgaacaaatataattgatctctgcatgactcagatattaagcaagatagggatattatggaagagttgaggaccttctttttctgttatatgaatttttcactaagacaaaaacttttttggatacactattactaaacagtaggtaaagaatagacaaattagatgtatcagaaataaaagttgtaggaatcacgaccaccattatggtcttttttagtagtagagataatgatgtgaatgtgttaatg

SEQ ID NO: 33364 - DNA, 5044 bp, Oryza sativa
ccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacctaacaatggtatcagagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcagcgaaggggagtgggacggcgccgccgtgtcgccatgccgccgccggcgctgtgctagggtttcggcgacggcgacgccgctccgtgcaaccgcaagagaaagaagagaagaggagctagggtttcggcgccggcgggcgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacaggagattttaattttaggaacattaattatgtgctatgatgttgtaatttttctgaccaatgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcagttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagagccgggtgtctgtacccgctccgtcgactcagcaacctttcttctctctacctgctaatgttgtgccagcaatgcatgccgttgcggtaccaaacacctgttgtatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaatgagccaaaacagtaggctgtaaatgggtctacaaaaccaaatatgactctagagggaatatagaaaagtttaaagtgcgactcgtggcaaaaggcttcatgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcgaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgttacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcccagtgcactggaaattggtaaagaaagtcttgcgtgtttgcaaggaacaaaaggcctcatgatgtcttacagaaaagcagaatcgctctagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggat

SEQ ID NO: 33365 - DNA, 2718 bp, Oryza sativa
  unsure (1)..(2718): unsure at all n locations
tataggtagtcattaaaaaaggaataactctatttcgcctccctaaactcatgcccctggttgaaatacatccctcagtcgtaaaaccgggtataactcatgccccaacttccaaaaccgtagcaaatagactccccaagcggtttaaggggcggtttcgtcctacatggcacttacgtggcgagttgacttggtctttataccacgtggggcttacgtggcactaaaataacaacaaacctaaatgggacccacatgtcagtgagtaaaacaataaaaataaatttcagactcacgtgtcatttacattgtcacctcctcttaaacctctctctctctcatgtggatgttggatggcagtgacaggcaaaccgtgtcggaagtggatggcggtggcggcaagacgtagcacggcggagggcgaggactacggcggaagctgccgagtttgacggctaggtcaacaaggtcggcggatgaactctccactgcaggcggcgcgcgagcgtggtagcgtcaatcttggtgaaggggatgactccccacgccggctcagcagtcagcatcctctcctcctcgccggttccccacgccgccgccgncttctncccttcgctctccttccctaacgccgacctcgtcgtctgcctccgcctcgacccctgccccgacgacaatgcaaatttcgacgccactgagtatcaccgccgctatcccgaactttttctttgtttataggatatgaaagatgtaaaaaaggcttaagaatattttaaatctacaagtcacatggttggttcttgtgaagaaaatatcaaaaaaataacacaaaataaaaaagttgcacatctctcctctacactagagaggagaggagaggaaaagaatggggttggggccacattggtgcactccccctgccacctcggcgccgacccgccacggtggtaggaggacggcaccagagaggctggcactgtcccgttggatgactggcgccagtgattctggtgctccaaaaaggatcatttctgggataagtttttctaggggtctatttgtaaaataagttttttaaaagaaccaaattgtaaaaaattagaataaataacctgtaaagaagaatagatttttcttttgtcaaacaccacatcattcctacaaaaccttaatggccaacaaatagttgttgcccctaacaggataagtgacttaaggcttttcctaattccccgtagcaaattaccaaacatgttggatacaccacgaggcgggaaaagccctgtagccacttgtatagtgcaccacacaaaacaggcaaatttgcattcatgaaacaaatgtaaaattgtctatctttgtgacaaaaggaacaattcttaggaagctatatcaaatggacccttaggtgtttgtacaattcaatgaaatcaatccatttcaaatgtttttctttctctaaacaagattttcttttcttcatagggataattttttttccatctaagaatgacgcttttttactagacgtgttaagatttcttctaaatttgttaggcataccctcaattactacaccagtccatgtgactctagctacaaacactagttgaacctacaatgcattgagttaaacatccgtaattttgacattttaacccttttgataaacgtattctataagtaaacctggacaaaaaatataactaaaaataggccttcacctcagcatcacgggccttggcattgaggcccaacatcataacgccagacccattggctgtcacgcccagaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaaacctccacaccatcagcctcattgtagaactcttcctctgatgaatgattgcaaggtgagtatatgacatactcagcaagccacgcagcaaatatgtaagtgcacaggataacaaaggatggcataatagggttgcatttgcaaaagcagtatttagcaaacatttgagaatttaacaaaacagttgagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtaacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatac

SEQ ID NO: 33366 - DNA, 7784 bp, Oryza sativa
tgagtcccagctcgtcccaagccaacccaggccaaccattccacattttagttgttgagcaaattttaagaattaaaacactaacttgggtacattgctttgcttgcccataacagagggcgcggctattcgaatagattatactctgatcagaggtgtacatctttacccacaagacacatcttcctcacatgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgatcgaccatcgtgaactatcattaagccatcatgaaataatagtaaatcattagttatcccataagtgtactaatgtttctaagcagggctaagcaattatatctaatatctagttgaaccaatataattaaagctcaactagtcaaattaatataccccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcagaaaagagcaaaatcaccaaaacagcacatgaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttgatgacgccagcaatgacgtcaccgacggcggcggcggctcggcgaggcagacggctcgggcggcgcacgctcaccggcgaacggcggcaccacggcaccaacggagggcaccagcacgtagaggacaacacggcgaacacaccggtgaccaaaacggcggcggagaaggaacggacgacgacggcgacgagaaggaagcggcggctaccttcgggttgtcgacggcgacgaagctccggcgggttccgacggctgcgaaggggcggacggggacggcggcgacttggcgatgacgacggcggtcttcccgagcgacggcgacggctggaacgacggcggcgcacggctgaagcggcggcggcgaaggcaaagctagggcacacggcgctagggctactccggcgacgagaggcgaaggcgagggtggcggcgagtagaggagacaccgggggtccttttaaaggggctcggaggcgacggcggaggcccaaggcgacgacaacgacgaaggaaacgctcggcttggagagaggaaaaccgatccgaaacgaactcgattccacgacttccaaaacgatttagccaaagattccaaaggagaaaaggtagaggagatcccggagatcatttcccctctattgattcggccggagaaggaaaggaacggccagatttggaaaggaaacggcggcggcgcgaaactagggtttcggcggcggcggccgaaggaggacgatgggtccgacaggtgggacccacctgtcagcgaccgaacgcgcgcgcgcggcggctgcggactgggccggctgggccgaggagagagaagagaggttttgggccgactttcggcccaaagccaaaagagactttttaaaacctttttcaatttaaattattccttaaatgcaattctatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacattggcgctgaggccgtgaaatacaatatgaaaagagtaatagatctaaatgcatatgatttcttgtgtgttgtagtggtgagtggtgttttgatggtttctggagatcgccaaactacatggcgctaggatgttgggcctcagcgtgacccatgacgctgaggtaaaggactacttttggttatattttttttctggttcatttataaaataagttcttcgaaagagtcaaaatgtcaaaatttcaagttaaatatactggattacagctctttcaaaagtgtttttcttttcttttttgcttttgaattgtggggttgtaatgtttgttgggtcatgatgagcacaaacctgcacgtaagtgtacagaggtccacaacgttaaatatcagcaagcgtggcacaattttctgcaatatttatagtacgatagtaatattatttaatcctcttttgaattatttaaatgatgcctccaactacctgcctgcaaatcagctcagatccaacgaaatggtgctactttccaccctttttctttgggggcgacgaatccatccatctaccctataggcccctccattccgtgaatatttttttaaaacttcttttggaccgcacaaaaaaaatcgcataatatgacaaattttacatgaatttcatcagaataaataaaactcataaaatcgaaatatcctagctggaattttatacccaattgaaattgtccataggattatgctcctcaacttgtcactgtcaactgaaattccaaatcattctgttcccatttcaaaaataaaaaggtaaaaatcaaacgcatccaaacaaacgtgatatttatatttgcatcaaaaaaaaaaaagctctctctctctctctctcgctctctccacatcggtcgtgcggtcgtgccgccatcaccatcgcccctccccctcttcctcctctcttctttttccctccctttcgcttcgcttcctctcctcctctccaccattggcgacctcgcaaaccctagcgcggcgagcggggggaagatgagatgggacgcagcggaggcggaggaggtgctggagcggatctgggacctgcacgaccgcctcagcgacgccatcctcgccgtctcccgcgcgcacttcctcctcccgccgcctccgcctcctccgcctccgccgccgtctcagccgtcggcgccgcccgcgcgcgaggggaggaacgggtacgtgttcgtgaaggggttgaaggggggtggaggaggagaaggaggcggggtgggggatggtgtgggcgtgggctcgccgaaggccgcgccgccggaggcgatgccggaggcgaggagcctgcacgccatacggacggcgctcgaggacctcgaggagcacctcgagttccttcatgtgagattgcgctcgcctcctccccttcctctgttcttctagggtttttttttgctctggattggttacctggaggaccatgtatgagttgttgcaatgaatgggggagtgggggaatggatcctcgtcaggctgggggagagtgcgttgttcacgtgattgcggctatcatttagcttcgttttcattgcgcggcctgtagactgtaatttgagatggggctaatgatttcaatttcttcatgggagctagcttctgttgctatccacctggcgcttcgtttgatgtttcgattggatgttgattgcatcatgctgttcgcatggtaggatcattgagttgctgctcatgagttatgctgaattatgtggtttgttaatatcatgtcatgggtgctggattttggcctttttctttgggtgtttggttgtgcatatgcttttgactataaatttgctaattaaggcgcaaatagattggaaatgaaggcatgtggatgttaaaaaagtgatagtccacatggctttattctcttttttggtggttttttagttgatgcttgctatttgtctaggcaagaaaaaacatcatttgttctgtagtcatttgtcactggataaaagttcatagcataaaaccatgattaatatgatacttgaagatattatttggtctataatcattcatcactggttaaaagttcagcataacattggccaaggtatgtaagagaggctaattttgctgtagtaccttaccagaatgaaacagagtgaagtagctcttgctttgtcatgttccattttagttagttctgagcataatttggttactgtccttttatgagtggtgggttggaaacctgtgcatacatataggcaatgcacagttccctgtgtgtttagctaattcagttctatctttcctacttaatggtatggttatgaagcttgtgtttcttagtcgttaatattgttcttcctccacagaccgttcaatcacaacagcgggcagagcaggatgctgcaattgctagattggaacagagccgactagtccttgccatgaggctagctgaacatcaggggaagaagtatagagtcattgatgaggccttggcgtttgtaggcgaagttggtgacaagagtcgattcatctcaccggaagatgttcgtgcaactcataaccagtcaggggaggatgtaatggacagtgggagcaacggttcaagtattatggggaatgtgttatcttgtagtctatctttggccaagaactcatttcgagtggacaaaatcggtagtgctctgggtaacgctgcagcgtttgctgtaagtatgtttgctttcttgcagctgcatcaagttgcctttggaagcaaatctccagcaatggattacaggaggcacagttaccattctgggagctcactacagagtggcaaaggaaagcaactcgaagtgtacctagccagaggttgaggaatcatcaagtcacttgctgttgcctgtacagaagttttgaccaaataccagttttcaccggttttgttagggcactaatcattctttatgacgaaatggactatgtttcaggctactaggatactaattgttaattcgtttggacgtgttggactacgttccaattaatagacgtcatacctctaaacctgtaaatggatttttcattagagatggatggaatgcttgtaagtctgtattctgtcagccgattggaattgctgtgttaggtttgttgtgtcctcatgagttatgaggattgaggagtgttgaaaggacaactgtttgttgtgccctcatgagttatgaggattgaggggtgttgaagcattcaaggattcaaggttctttgcttaactgagaagtccagttttttcttttcttttcttgattattgactattttcgacatcggctaccttacaagtacatgtgatgcttcatgcttgtgttcttttaaggcagtgcacttgagggtataactttcctgtgtcatgtgcttgtgcttggtgattcctacatcctcctggcatttatctgtcaagtctggatcatatctggtgccgaagcttctttggttaggtccatacttcgccttggccactcctttacctcagtttactgcttttgctttgttggtttgccggctctttgcacactgctgtctcatgctgcaaagattgttaatgttgagtacctgtgattacatggaagccttttcttcaatacgtactaagcattagctttattcagccatatgggtactagaaatatatatttagtacatctgtacataagcctcacgggaattctgcataatctggtatgctcttactggacgactttatcagtggtatcaacgttaaaaaccatatttaacttgaataatatggttgctttggctaatcatagtatcactcatgccccttttcagggcatttcactcccatgttggagaaaagaaaaaagaaaaaggcgagattctatgcttatggttccgtggtttgttctttcgaaatttggcatccataaaggaaaaaaaaaaagagaagacaaacgctaacagtgagggaataaaggattaaaaaagtgaataaatgattaaagatgttcacttcttactaatcatgctcgacaagacaacctcttttggctgggaaacaagaaggaaaaagagggcacagaaacgatctcagcgtcgccgattaatattttatcctccgttaaacactgatatggaggagatgttgttctttttcctgcaaaacatttgtagtagatgttgtaaatcaggtcttggttgctattccagtcaatttcatcatactttattcgttcctagttacatgccaatataatctttcggaacatgtgagaattgttgagagaaaaatacccgaatgccggctacatcttgggccacttctggctgccattgattgcatgctctagacatcgcactgctttggggggaaaagtacaccgaaggtccctcaacttgtcatcgggacacaaaaacgtcctcgaaccgcaaaaccagatatacgaggtcccttaactatacaaaaccgttcacccgaggtccctaggtggtttttaccccggttttgtcctacgtggctgctaagtcagcgtgggacccatgtgggccccacctgtcagcgtaaccca

SEQ ID NO: 33367 - DNA, 5839 bp, Oryza sativa
ggcagtggcacagctatgctcagagcggtcgcgagatggggagagatggagatttgcctcgtgggtggcggccggcgggggagcccgcgcgctgctcctccgccgccgcgtcgcccgtcgccaacgccttgcgggtgccatggaggtgggctgcttgcgcgcggcgtccggcaggaggagcaggagcacggcagcgaccaccaccacgcggcggcgacggcggaggtggggccaggaggtggctagcgcagcggcgatgggtgcggaggtggacaagccgacattattcccgatgacaaggcagacaagctatcgctgccgaggttagaatggagtttcgcctggcggccaccgtgccgtcgccggtgctcacgggcgcgtccgactccatcgacagcctcgacttcgaccccaccggccaccacatcgccatcggcggcatcgcccgaaagatccggatttacagggtcgccgagccatctagccccgtcggctgcatctacatcccggcaaagctgagtagcgtgcggtggcggccggggcggcggcgaggtagtggcgcacgtgggttgcagcgactaagacggcgtcgtgacggagtacgatgtggagcgcggcgtgccggtgtgggagcgcgacgagcacgaggggcggcaggtgtgggcgacggcgcgacatcgtcccgtcctcttcgcgctcccccctagctaccgccgcagccgccatacccttctccccccgggctccggccgccgtcgcgctgccgccgccctcctctctcccgcctcgcctgccgacctctgcaccgccgctttgcctcgccgagaagccgcccagaaagagggaaggtgatgatgtggcttcctgacatgtggggcccacgtgggtcccacgctgactcagcagccacgtaggacaaaaccggggtcaaaaccacctaaggacgtcgggtgaacggttttgtatagttaagggacctcgcgtatctggttttgcggttcgaggacgttttttatcccgatgacaagtcgagggaccttcggtgtacttttcccctgctttgtgctgttgatttggcccaactggggcccactcttggctaggttttttctgcttttttaacatatctgtattaataactataaatattcgacatttaggacaagattaaattaatattttaaaactttaaacactaataacttgtcaaatgcttttgttttttcaaaaaaggtatgcatacttttgctttcaacttattcaatttattctaatataaaatttatggtaaaaaaaattaatagttagactgaatcttgtcttcaaatataaaatatttatgaccggatgaagtaattgataacttttctctcatttatttatatgaatttagatgaccgtgtgtgttgtgactgatgtaaaaaacctgtagtaccagatgaccttttttttttttttgaaagtaggctaaaggattgcctagctcattaataaaggagagaagtttatagaagttatttacagaaatgttccaggtaaccaaagaaatggcaacacacgcttgaattacaaattgtcatatagtcaccaatccatggatatgcttgggcaagcacaatctgtgatacagttcacatttgagaaaacatatgctctgaatatagcacatcatccttttgctaccagtcaactaacatgggctgttaatactttggtagctagctgtttacagaaatgttcagtgtaagtgtgtaacaaaaaaaaaaacaagaagaaacgatacacgcttcaattacacattgtcatatatagtcaccaaaccaatgcatatactcatattcagtgatattgttcacatatgagatatcagataacatatggtctgaacatagcatcaatttttttgctagtattcaccagtcaaccgatgctttggttttcaatccaatggtatcgtgattcttcccctcttctagccagcagcctcgaggccaggttcgccgggttcagtaatggcaagctcgggcccgccggatcaacgacggcgagctaccacggcggcggagacggctctgttcccaaccttgacgcctcttgctcgcccatccggtgtcgcaatgacatgatactccgttgagaatcatgatttcctccggacaattacatgcatgactggatcatctgcatagacctatacgcatacatggcaccatgagacagattacaaagtgtcctcaaacaagattgtcgagtcaccaggattgttattattattatttttttttgtgcttgatcttcagtaggaacaagaagggggaacggagaaccaactgaccgtgcagatcagcagatggtacatggaggattccttctcggctctgttaatagtatataaagatatgaactgtttttccgttgcaagttggatgggaaccacttttgtcttggaagcaagtacctggggaaagtatgcatcagattgcaacaactgttctgtagattgaactgaaggaaagcagatttagctaatgcaaagatctccaaaatatgcaggatgtaaaacgttttctagaggagatttctacctggcgatcgattgcgaggggcgatcagactcggatcccctccctccacctagtttccttttttggcatcgtattactttcctattttagtaaatttatacacctaaagtttacacatataaagtttagagacccaaagtttataaatcaaaagtttatatatccgactcaaatttgaatttgaattcaaatattttttatatatagtatttctatacatataaagtttatacacctaaagtttatagacccaaagtttataagtcaaaagtttatatactcgattcaaatttgaatttgaaatatatccgatttaaatttgaatttaaattcaaatatttttttatatataatatttctatacatctaaagtttatacacctaaaatttatagactcaaagcttataagtcaaaagtttatatacccgattcaaatttgaatttgaattcaaatattagtttatagacccaaagtttataagtcaaaagtttacatacccgttttaattttaaatttgaattcataaggtgtagtaggaagagaagaacaggagaagcaagggggaaaaggagggagtgatgtagcatatagggaaggggcgggcgggtgatcgttcctagccttacccttttctagatggtaaactctgcaggattgtactgagccgacgccagtatatttggataagcagataatgctcggcagtcagtacaagatggaggggttgataccccagaataaattctttttccctaacataaattgggtgatagtataagtgatcaagagcccatgaaaaaataaccacgtcagtatcctgtccaatatgttttaccttaactggtattttttctttcgcgaacgctccttactggttctgaatatactaacctttttcaatgtgaggttagttctttttccattccgttaccttggcattcctgtataccatagaagacttcgtaattcagagtggaaggaagtgattaaacggcttgataaacggttggcaagttggaaaggcaaatttttatcacttatagggcgactaacactaatcaattcagtgcttactagcctaccaatgtatatgatgtcctttttggaaatacctaaaggagtgatcaacaagattgattatttccgatcaaggttcttttggcaaggggatggacacaaaaggaaatatagactagcaaggtaggacatcatatgtcatcctaaagaccaagggggttgggaattcaaaatcttgaaattaagaacacaactttctttagcaactggttgtataaactactcactacaaatgctaaggaacaaatatttggggtcacagcctttgtctcaagctcagtggaaagcaggagactcacactttttgtcacgccccggactagccccgaacggaactagctcgtgacgctccaaattaacctgttgaccgataccagtcccaggaaacagtgctggtatcacaggaagacagaatatcacagcaacagaggtctctttattatagagtaggattacagtcatgttgggctgcggacagatcccgagctcacaactgcattacaaaaggaaagcggaagccagggattggaccaatcatcacaggcgcgacttgggaactaggccgaaacccttaaaactcatcgaagccgacttgctcctggaagaactcctcgtcagcaggatccacttcatcttcttcagcaactggggggggattatttatatagagcaagggtgagtacaggagtactcagcaagccaggggaaataagtatttaatacaggcttcaaggaaaggctgttgttttcgtaattgattttgtttgaactcttttctaaaaagactaagtgagtgcttctcaaacgacacggatgagacagtgcgtctcgtccggtcggagtatgtgcaatgtatcaatctttagatcttgaaccagggttggcatccggccaacagcttttcaaacggccacccgggccaacaacttttcaaacggccacccgggccaacaacttttcaaacggccacccgggcctagctgaccccatcagctgcagatttttcaaacatcgaactccttttcacaacagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcatccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctcttggcatcaaggctcccctgataagctagttactcagccaggggtgtcccattccacccatgtggtcatacttgtcttatgtttggatgaaattccaaggattcggtccttaagtgcgagagcgggaaaccgtactcccggtacgttccccggtccgcggttttgaaaattcatttagttcgcaagcaccgacccaggtgtcgggttttccaagtcttttgtaaaactccagttttacccaagttgttactcagattttaagtttgaaggcgaccgtcgatactcgcacggagtgcacgaatatcgaggtgcagctgggtggttacaaggggacatagcatggcaattaacaatggaaggatcaaatgcaacaagttaggtaagtccgccaatctgtcttgcagatgggataaaagatttagtgcgatcctatcaatgcataatattttgcaggcaatataattaaatttcaaatataggctcaagatgttcaaaggtggcttgccttgctcgagatccggagcttgatcctcgaaatcctcgcactgcgggtcttcgggctccgaaactacacgcaaaacgggacaactcaacaaacagtgaagataaggccctattattgacctctaagcgtgccattaggtagatctcgggatttgaggaatttaggaagttgaacggagtcaaacggatgctcggttgaaaagatatggaatttctaagattattggatttttggtctaaaggaaaaaggatttaatcctttttgaaaaagaaaagaaaagaaagaacagagggatggaaat

SEQ ID NO: 33368 - DNA, 763 bp, Oryza sativa
taactacggggaggctactcaagctactaccgaaagctaggggggagatggagcgaggaggaagaacggagagaggcactaccgtgcggaggaggggcgctgtgacgagaggccgacggcgcgggagtgatctctccggcctcgggccggggaaggggaagagaaagaagagggtgcggccgaagtccccttccgcgtcctcgaacgcaccggctctcctggcgctcggcgagggacggcggaggcgagacagagcacgggggcggcggtaatggcgtggagacgaaagggagaggaagggaaagggggaggctggggtttaaatgggcggcaatgtcggtttgagaaccgacttgcgcggtcaagggcgcgagctggcgatcggcggtcgcggccaaagcggcgacagggaggatgacgccggcgaggaggaaaaaggggaaaaggaggggggaaaagggggcttgcccctttgccgatttgggaaaaaggaggaggggagcggggcgacgcggcagagggaaaggagagctcggcctccgcctcttggcggcttgcgcgcggagtggcgagggccgggcagtgacgacggcgatgacggcgggcggattggagcggagcgacgacacgggcgacagacacggcagacgctgacgacggcggcgaccaggcggtcggccaccacggcacgcgcgcgcgggaggcaacgggcggcgcggctgggcagcgggaccgggcgacgcggacggcgcagacgacgcgg

SEQ ID NO: 33369 - DNA, 740 bp, Oryza sativa
ctccctatccaaacctttgcaacagatggctgacaatgagaaaggcaataaggtcagaagtcaggacattggtacctcaagctctcgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcgttgtggagaaatcggtcatgttgccagctcgtgtgcctctacatgcgttcattgtgaggaagaccatccacccgataggtgtccaacgagcaggatcactt

SEQ ID NO: 33370 - DNA, 1561 bp, Oryza sativa
aaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctacagaggtcagtttaaaatcacatgtaacagcgaagcctcagatttggcaggataatgattagacaataacaaatccagcagtaaagccatttgggaagacgtcaaagtatatcaagtaggataagttggctctcttgggaagcataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcgacacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggcaaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttccccccccttcctctcttgggccggctcggcccaactctccctccctctctttcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataaagaggggggaatcattccccgcgattccctctctctttccccccgtttttccctctctctctccctcggattcgtccggattcactcccgcaaacctcgccggcgccatcaatggcggcgagatctccgcgccggttt
